US010046015B2

(12) United States Patent
Mulder et al.

(10) Patent No.: US 10,046,015 B2
(45) Date of Patent: Aug. 14, 2018

(54) COMPOSITIONS COMPRISING BACTERIAL STRAINS

(71) Applicant: 4D Pharma Research Limited, Aberdeen (GB)

(72) Inventors: Imke Elisabeth Mulder, Aberdeen (GB); Amy Beth Holt, Aberdeen (GB); Seanin Marie McCluskey, Aberdeen (GB); Grainne Clare Lennon, Aberdeen (GB); Suaad Ahmed, Aberdeen (GB)

(73) Assignee: 4D Pharma Research Limited (GB)

( * ) Notice: Subject to any disclaimer, the term of this patent is extended or adjusted under 35 U.S.C. 154(b) by 0 days.

(21) Appl. No.: 15/357,936

(22) Filed: Nov. 21, 2016

(65) Prior Publication Data
US 2017/0143773 A1 May 25, 2017

(30) Foreign Application Priority Data
Nov. 20, 2015 (GB) .................................. 1520497.7

(51) Int. Cl.
*A61K 9/19* (2006.01)
*A61K 35/74* (2015.01)
*A61K 9/00* (2006.01)
*A61K 9/50* (2006.01)
*A61K 39/09* (2006.01)
*A23L 33/135* (2016.01)
*A23C 9/158* (2006.01)
*A61K 35/00* (2006.01)
*A61K 39/00* (2006.01)

(52) U.S. Cl.
CPC ............ *A61K 35/74* (2013.01); *A23C 9/1585* (2013.01); *A23L 33/135* (2016.08); *A61K 9/0053* (2013.01); *A61K 9/19* (2013.01); *A61K 9/50* (2013.01); *A61K 39/09* (2013.01); *A23V 2002/00* (2013.01); *A61K 2035/11* (2013.01); *A61K 2039/52* (2013.01); *A61K 2039/585* (2013.01)

(58) Field of Classification Search
None
See application file for complete search history.

(56) References Cited

U.S. PATENT DOCUMENTS

| | | | |
|---|---|---|---|
| 5,589,168 A * | 12/1996 | Allen | A23C 9/1203 424/439 |
| 7,749,494 B2 | 7/2010 | Renaud et al. | |
| 7,998,474 B2 | 8/2011 | Kelly | |
| 8,460,648 B2 | 6/2013 | Borody | |
| 9,011,834 B1 | 4/2015 | McKenzie et al. | |
| 9,314,489 B2 | 4/2016 | Kelly et al. | |
| 9,539,293 B2 | 1/2017 | Kelly et al. | |
| 2003/0147858 A1 | 8/2003 | Renaud et al. | |
| 2008/0069861 A1 | 3/2008 | Brown et al. | |
| 2010/0284973 A1 | 11/2010 | Schiffer-Mannioui et al. | |
| 2010/0303782 A1 | 12/2010 | Cobb et al. | |
| 2010/0311686 A1 | 12/2010 | Kasper et al. | |
| 2010/0316617 A1 | 12/2010 | Renaud et al. | |
| 2014/0037716 A1 | 2/2014 | Nowill et al. | |
| 2014/0147425 A1 | 5/2014 | Henn et al. | |
| 2014/0199281 A1 | 7/2014 | Henn et al. | |
| 2014/0335131 A1 | 11/2014 | Mazmanian et al. | |
| 2014/0341921 A1 | 11/2014 | Honda et al. | |
| 2015/0071957 A1 | 3/2015 | Kelly et al. | |
| 2015/0104418 A1 | 4/2015 | Flint et al. | |
| 2016/0067188 A1 | 3/2016 | Cade et al. | |
| 2016/0199424 A1 | 7/2016 | Berry et al. | |
| 2016/0279177 A1 | 9/2016 | Kelly et al. | |
| 2017/0143772 A1 | 5/2017 | Mulder et al. | |
| 2017/0143774 A1 | 5/2017 | Mulder et al. | |
| 2017/0143775 A1 | 5/2017 | Mulder et al. | |
| 2017/0173089 A1 | 6/2017 | Kelly | |

FOREIGN PATENT DOCUMENTS

| | | |
|---|---|---|
| CN | 101590081 A | 12/2009 |
| CN | 102940652 A | 2/2013 |
| CN | 103156888 A | 6/2013 |
| CN | 103981115 A | 8/2014 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| EP | 2687227 A1 | 1/2014 |
| EP | 2810652 A2 | 12/2014 |
| EP | 2832859 A1 | 2/2015 |
| JP | H08259450 A | 10/1996 |
| JP | 2003261453 A | 9/2003 |
| JP | 2005097280 A | 4/2005 |
| JP | 2007084533 A | 4/2007 |
| JP | 2007116991 A | 5/2007 |
| KR | 20100128168 A | 12/2010 |

(Continued)

OTHER PUBLICATIONS

Yang et al. (Trends Pharmacol Sci, 35:493-500, 2014).*
Azad, M.B. et al., Probiotic supplementation during pregnancy or infancy for the prevention of asthma and wheeze: systematic review and meta-analysis BMJ 2013; 347 :f6471.
Balato, et al., Effects of adalimumab therapy in adult subjects with moderate-to-severe psoriasis on Th17 pathway. (2014) J Eur Acad Dermatol Venereol. 28(8):1016-24.
Darlington, G.J., Liver Cell Lines. (1987) Meth Enzymol. 151:19-38.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.

(Continued)

*Primary Examiner* — Brian Gangle
(74) *Attorney, Agent, or Firm* — Wilson Sonsini Goodrich & Rosati

(57) ABSTRACT

The invention provides compositions comprising bacterial strains for treating and preventing inflammatory and autoimmune diseases.

16 Claims, 4 Drawing Sheets

(56) References Cited

FOREIGN PATENT DOCUMENTS

| | | |
|---|---|---|
| WO | WO-9919459 A1 | 4/1999 |
| WO | WO-03046580 A1 | 6/2003 |
| WO | WO-2007136719 A2 | 11/2007 |
| WO | WO-2009027753 A1 | 3/2009 |
| WO | WO-2009072889 A1 | 6/2009 |
| WO | WO-2011110918 A1 | 9/2011 |
| WO | WO-2011149335 A1 | 12/2011 |
| WO | WO-2011153226 A2 | 12/2011 |
| WO | WO-2011153226 A3 | 3/2012 |
| WO | WO-2013008039 A2 | 1/2013 |
| WO | WO-2013050792 A1 | 4/2013 |
| WO | WO-2014001368 A1 | 1/2014 |
| WO | WO-2014067976 A1 | 5/2014 |
| WO | WO-2014075745 A1 | 5/2014 |
| WO | WO-2014078911 A1 | 5/2014 |
| WO | WO-2014121298 A2 | 8/2014 |
| WO | WO-2014121304 A1 | 8/2014 |
| WO | WO-2014137211 A1 | 9/2014 |
| WO | WO-2014167338 A1 | 10/2014 |
| WO | WO-2014201037 A2 | 12/2014 |
| WO | WO-2015006355 A2 | 1/2015 |
| WO | WO-2015021936 A1 | 2/2015 |
| WO | WO-2015095241 A2 | 6/2015 |
| WO | WO-2015156419 A1 | 10/2015 |
| WO | WO-2015156519 A1 | 10/2015 |
| WO | WO-2016019506 A1 | 2/2016 |
| WO | WO-2016102950 A1 | 6/2016 |
| WO | WO-2016102951 A1 | 6/2016 |

OTHER PUBLICATIONS

Frank, D. et al., Molecular-phylogenetic characterization of microbial community imbalances in human inflammatory bowel diseases. 2007. PNAS. 104(34):13780-5.

Goldin, B.R. et al., Clinical indications for probiotics: an overview. Clin Infect Dis. Feb. 1, 2008;46 Suppl 2:S96-100; discussion S144-51. doi: 10.1086/523333.

Kallasapathy, K. Microencapsulation of Probiotic Bacteria:Technology and Potential Applications. Curr. Issues Intest. Microbiol. (2002) 3: 39-48.

Kanauchi, et al., Eubacterium limosum (probiotic) and its metabolites showed anti-inflammatory effects and increased mucosal barrier function in colitis. S1912.

Karaffova, et al., Interaction of TGF-B4 and IL-17 with IgA secretion in the intestine of chickens fed with E. faecium AL41 and challenged with S. Enteritidis. Research in Veterinary science. 2015:75-79.

Koenders, M.I. et al., Interleukin-17 Acts Independently of TNF-a under Arthritic Conditions. (2006) J. Immunol. 176:6262-6269.

Leslie, et al., Trehalose and sucrose protect both membranes and proteins in intact bacteria during drying. (1995) Appl. Environ. Microbiol. 61, 3592-3597.

Luger, D. and Caspi, R.R., New perspectives on effector mechanisms in uveitis. (2008) Semin. Immunopathol. 30(2): 134-143.

Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.

Masco, L., et al., Identification of Bifidobacterium Species Using rep-PCR Fingerprinting. Systematic and Applied Microbiology 26(4):557-63 • Dec. 2003.

Mitropoulou, G. et al. Immobilization Technologies in Probiotic Food Production. (2013) Journal Nutr Metab. (2013) 716861.

Numasaki, M. et al., IL-17 Enhances the Net Angiogenic Activity and in Vivo Growth of Human Non-Small Cell Lung Cancer in SCID Mice through Promoting CXCR-2-Dependent Angiogenesis. (2005) J. Immunol. 175: 6177-6189.

Pace et al. Macrophage activiation: Priming activity from a T-cell hybridoma is attributable to interferon. (1983) PNAS. 80:3782-6.

Schieck, M. et al., Genetic variation in TH17 pathway genes, childhood asthma, and total serum IgE levels.(2014) J Allergy Clin Immunol. 133(3):888-91.

Sgadari et al. Mig, the Monokine Induced by Interferon-g, Promotes Tumor Necrosis in Vivo. (1997) Blood. 89:2635-43.

Shabgah, A.G. et al., Interleukin-17 in human inflammatory diseases. Postepy Dermatol Alergol. Aug. 2014; 31(4): 256-261.

Simpson-Herren, L. et al., Kinetic parameters and growth curves for experimental tumor systems. Cancer Chemother Rep. Jun. 1970;54(3):143-74.

Tsukinowa, et al., Fecal microbiota of a dugong (*Dugong dugong*) in captivity at Toba Aquarium. J. Gen. Appl. Microbiol., 54, 25-38 (2008).

Workman et al. Guidelines for the welfare and use of animals in cancer research (2010) Br. J. Cancer. 102:1555-77.

Ye, X. et al., The Role of IL-23/Th17 Pathway in Patients with Primary Immune Thrombocytopenia. (2015) PLoS One. 10(1):e0117704.

Yutin, N. and Galperin, M.Y., A genomic update on clostridial phylogeny:Gram-negative spore formers and other misplaced clostridia. Environmental microbiology. 20136; 15(10): 2631-2641.

Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.

Zitvogel, et al., Type I interferons in anticancer immunity. Nature Reviews. Jul. 2015:405-414.

Arenberg, et al., Interferon-y-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.

Atarashi, K. et al., Treg induction by a rationally selected mixture of Clostridia strains from the human microbiota. Nature. 2013; 500(7461):232-236.

"Campeau, J.L. et al., Intestinal Epithelial Cells Modulate Antigen-Presenting Cell Responses to Bacterial DNA. Infectionand Immunity. Aug. 2012; 80(8): 2632-2644.".

Chen, S. et al., Live combined bacillus subtilis and enterococcus faecium ameliorate murine experimental colitis by immunosuppression. International journal of inflammation. 2014(878054). 7 Pages.

Co-pending U.S. Appl. No. 15/357,850, filed Nov. 21, 2016.
Co-pending U.S. Appl. No. 15/359,144, filed Nov. 22, 2016.
Co-pending U.S. Appl. No. 15/359,972, filed Nov. 23, 2016.
Co-pending U.S. Appl. No. 15/359,988, filed Nov. 23, 2016.

Duncan et al. (2002) "*Roseburia intestinal* is sp. nov., a novel saccharolytic, butyrate-producing bacterium from human faeces," International Journal System Evolutionary Microbiology. 52:1615-1620.

FDA Orphan Drug Designations. Total Orphan Drugs website. Aug. 2014. Available at http://www.orphan-drugs.org/2014/09/01/fda-orphandrug- designations-august-2014. Accessed on Apr. 13, 2016.

GB Exam and search report dated Aug. 30, 2016 for GB Application No. 1520638.6.

GB Search and Exam report dated Mar. 31, 2016 for GB application 1510469.8.

GB Search and Exam report dated Mar. 31, 2016 for GB application 1510470.6.

GB Search and Exam report dated Apr. 15, 2016 for GB application 1510467.2.

GB Search and Exam report dated Apr. 20, 2016 for GB application 1510466.4.

GB Search and Exam report dated Apr. 20, 2016 for GB application 1510468.0.

GB Search and Exam report dated Aug. 30, 2016 for GB application No. 1520631.1.

GB Search and Exam report dated Nov. 17, 2016 for GB application 1520502.4.

GB Search and Exam report dated Sep. 14, 2016 for GB application 1520497.7.

Ghadimi, D. et al., Epigenetic imprinting by commensal probiotics inhibits the IL-23/IL-17 axis in an in vitro model of the intestinal mucosal immune system. JLB. 2012;92(4):895-911.

(56) References Cited

OTHER PUBLICATIONS

International Search Report dated Jan. 27, 2017 for International Application No. PCT/GB2016/053622.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016for International application No. PCT/GB2016/051770.
International Search Report dated Feb. 2, 2017 for International application No. PCT/GB2016/053620.
Kitahara, M. et al., Bacteroides plebeius sp. nov. and Bacteroides coprocola sp. nov., isolated from human faeces. International journal of systematic and evolutionary microbiology. 2005; 55: 2143-2147.
Kverka, M. et al., Oral administration of Parabacteroides distasonis antigens attenuates experimental murine colitis through modulation of immunity and microbiota composition. Clinical & Experimental Immunology. 2010; 163:250-259.
Lodemann, U. et al., Effects of the Probiotic enterococcus faecium and pathogenic Escherichia coli strains in a pig and human epithelial intestinal cell model. Hindawi publishing corporation scientifica. 2015(235184) 10 pages.
Miyake, T. et al., Phylogenetic Analysis of the Genus Bifidobacterium and Related Genera Based on 16S rDNA Sequences. Microbiol. Immunol. 1998; 42(10):661-667.
Patel., R. et al., Determination of 16S rRNA sequences of enterococci and application to species identification of nonmotile enterococcus gallinarum isolates. Journal of clinical microbiology, 1998; 36(11):3399-3407.
Sakamoto, M. et al., Reclassification of Bacteroides distasonis, Bacteroides goldsteinii and Bacteroides merdae as Parabacteroides distasonis gen. nov., comb. nov., Parabacteroides goldsteinii comb. nov. and Parabacteroides merdae comb. nov. International journal of systematic and evolutionary microbiology. 2006; 56: 1599-1605.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivieri, K. et al., Probiotic enterococcus faecium CRL 183 inhibit chemically induced colon cancer in male wistar rats. Eur Food Res Technol. 2008; 228:231-237.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.
Zhang, B. et al., Oral administration of enterococcus faecalis FK-23 suppresses Th17 cell development and attenuates allergic airway responses in mice. International journal of molecular medicine. 2012; 30:248-254.
Zheng, B. et al., Bifidobacteriu breve attenuates murine dextran sodium sulfate-induced colitis and increases regulatory T cell responses. PLOS one. May 2014; 9(5).
Zhongyuan, T. et al., The inflammation regulation effects of enterococcus faecium HDRsEf1 on human enterocyte-like HT-29 cells. Animal cells and systems. Mar. 2016;20(2):70-76.
Zitomersky, N. et al., Characterization of Adherent Bacteroidales from Intestinal Biopsies of Children and Young Adults with Inflammatory Bowel Disease. PLOS one. 2013; 8(6).
Atarashi et al., Th17 Cell Induction by Adhesion of Microbes to Intestinal Epithelial Cells. Cell, vol. 163, No. 2, Oct. 8, 2015. pp. 367-380.

Dahya V. et al., Clostridium ramosum Osteomyelitis in an immunocompetent patient after traumatic injury, Infectious Diseases in Clinical Practice 20150312 Lippincott Williams and Wilkins USA, vol. 23, No. 2, Mar. 12, 2015, pp. 102-104, XP009193312, ISSN: 1056-9103 the whole document.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
International Search Report dated Feb. 17, 2017 for International Application No. PCT/GB2016/053676.
International Search Report dated Mar. 6, 2017 for International Application No. PCT/GB2016/053677.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Schwiertz, et al., Quantification of Different Eubacterium spp. in Human Fecal Samples with Species-Specific 16S rRNA-Targeted Oligonucleotide Probes. Applied and environmental biology, vol. 66, No. 1, Jan. 1, 2000; pp. 375-382.
Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
"Amedei, A. et al. Multiple sclerosis: the role of cytokines in pathogenesis and in therapies. Int J Mol Sci. Oct. 19, 2012;13(10):13438-60. doi: 10.3390/ijms131013438.".
Atlas, R. Handbook of Microbiological Media, Fourth Edition. CRC Press. 2010.
Ausubel, et al. Current Protocols in Molecular Biology. 1987. Supplement 30.
Ausubel et al., Short protocols in molecular biology. Fifth edition, 2002.
Bagge, et al., Diversity of spore-forming bacteria in cattle manure, slaughterhouse waste and samples from biogas plants. Journal of applied microbiology. 2010;109: 1549-1565.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.
Brand et al., Collagen-induced arthritis, 2007; Protocol 2(5):1269-1275.
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behget patients with active uveitis. Invest Ophthalmol Vis Sci. Jul. 2008;49(7):3058-64. doi: 10.1167/iovs.07-1390.
Collins, M.D., et al., Enterococcus avium nom. rev., comb. nov.; E. casseliflavus nom. rev., comb. nov.; E. durans nom. rev., comb. nov.; E. gallinarum comb. nov.; and E. malodoratus sp. nov. (1984) Int J Syst Evol Microbiol. 34: 220-223.
Co-pending U.S. Appl. No. 15/592,178, filed May 10, 2017.
Co-pending U.S. Appl. No. 15/631,945, filed Jun. 23, 2017.
Co-pending U.S. Appl. No. 15/631,952, filed Jun. 23, 2017.
Co-pending U.S. Appl. No. 15/673,270, filed Aug. 9, 2017.
Day, J.G. et al., Cryopreservation and Freeze-Drying Protocols. Springer. 2007. 2nd edition.
Duncan et al. (2006) "Proposal of Roseburia faecis sp. nov., Roseburia hominis sp. nov. and Roseburia inulinivorans sp. nov.,

(56) References Cited

OTHER PUBLICATIONS based on isolates from human faeces," International Journal of Systematic and Evolutionary Microbiology.
Eckburg, PB. et al., Diversity of the human intestinal microbial flora.Science. Jun. 10, 2005;308(5728)1635-8. Epub Apr. 14, 2005.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Gennaro, A.R., Remington's Pharmaceutical sciences, Mack publishin co. 1985.
Gennaro, A.R., Remington: The Science and practice of pharmacy. 20th edition. 2000.
Guide for the care and use of laboratory animals: 8th edition. The national academic press; 2011.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.
Holdeman, et al., *Eubacterium contortum* (Prevot) comb. nov.: Emendation of description and designation of the type strain. International journal of systematic bacteriology. Oct. 1971;21(4): 304-306.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jiao et al., Blockade of Notch Signaling Ameliorates Murine Collagen-Induced Arthritis via Suppressing Th1 and Th17 Cell Responses. 2014; Pathology, 184(4):1085-1091.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karin, M. Nuclear factor-kappaB in cancer development and progression. Nature. May 25, 2006;441(7092):431-6.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lejeune, FJ. et al., Efficiency of Recombinant Human TNF in Human Cancer Therapy. (2006) Cancer Immun. 6:6.
Machiels, K. A decrease of the butyrate-producing species *Roseburia hominis* and *Faecalibacterium prausnitzii* defines dysbiosis in patients with ulcerative colitis.Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
Macpherson, AJ., et al., The functions of mucosal T cells in containing the indigenous commensal flora of the intestine.Cell Mol Life Sci. Dec. 2002;59(12):2088-96.
Manni et al., A tale of two cytokines: IL-17 and IL-22 in asthma and infection. Expert Rev Respir Med. Feb. 2014 ; 8(1): 25-42. doi:10. 1586/17476348.2014.854167.
Maya, J.R. et al., Emerging Therapies for Noninfectious Uveitis: What May Be Coming to the Clinics. (2014) J. Ophthalmology. 310329.

Mazmanian, SK., An immunomodulatory molecule of symbiotic bacteria directs maturation of the host immune system.Cell. Jul. 15, 2005;122(1):107-18.
Miossec et al., Targeting IL-17 and TH17 cells in chronic inflammation, 2012; Nature Drug Discovery 11, 763-776.
Miossec, P. et al. Targeting IL-17 and TH17 cells in chronic inflammation. Nat Rev Drug Discov. Oct. 2012;11(10):763-76. doi: 10.1038/nrd3794.
Miyamoto-Shinohara, Y. et al., Survival of freeze-dried bacteria. J Gen Appl Microbiol. Feb. 2008;54(1):9-24.
Monteleone, I. et al., Th17-related cytokines: new players in the control of chronic intestinal inflammation. (2011) BMC Medicine. 2011, 9:122.
Mucientes, A. et al., Specific association of IL17A genetic variants with panuveitis. (2015) Br J Ophthalmol. 99(4):566-70.
Mukai et al., SH3BP2 Gain-Of-Function Mutation Exacerbates Inflammation and Bone Loss in a Murine Collagen-Induced Arthritis Model, 2014 PLoS One 9(8): e105518.
Numasaki, M. et al., Interleukin-17 promotes angiogenesis and tumor growth. Blood. Apr. 1, 2003;101(7):2620-7. Epub Oct. 31, 2002.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 6, 2006 for U.S. Appl. No. 10/285,224.
Office Action dated Nov. 23, 2015 for U.S. Appl. No. 14/232,475.
Office Action dated Dec. 13, 2012 for U.S. Appl. No. 12/760,926.
Office Action dated Dec. 19, 2005 for U.S. Appl. No. 10/275,706.
Overstreet et al. 'Dysbiosis Characterized by Reduced Abundance of Roseburia is Associated With Increased Severity of Colitis in IL-10-/-Mice'. Gastroenterology. 2011, vol. 140, No. 5, Suppl. 1, pp. S-696.
Park, S.K. et al., *Blautia stercoris* sp. nov., isolated from human faeces. International journal of systematic and evolutionary microbiology. 2012; 62(4): 776-779.
Rockwell, S.C. et al., Characteristics of a Serially Transplanted Mouse Mammary Tumor and Its Tissue-Culture-Adapted Derivative. (1972) J Natl Cancer Inst. 49:735-49.
Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schleifer, K.H. et al., Transfer of *Streptococcus faecalis* and *Streptococcus faecium* to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/ 00207713-34-1-31.
Schmitz, S. et al., A prospective, randomized, blinded, placebo-controlled pilot study on the effect of Enterococcus faecium on

(56) References Cited

OTHER PUBLICATIONS clinical activity and intestinal gene expression in canine food—responsive chronic enteropathy. J Vet Intern Med. Mar.-Apr. 2015;29(2):533-43. doi: 10.1111/jvim.12563. Epub Mar. 16, 2015.

Severijnen, et al., Chronic Arthritis Induced in Rats by Cell Wall Fragments of *Eubacterium* Species from the Human Intestinal Flora. Infection and Immunity, Feb. 1990; 58(2): p. 523-528.

Sgadari, C. et al., Interferon-inducible protein-10 identified as a mediator of tumor necrosis in vivo. (1996) PNAS. 93:13791-6.

Smith, T.F. et al., Comparison of biosequences. (1981) Adv. Appl. Math. 2: 482-489.

Song et al., Impact of Schistosoma japonicum Infection on Collagen-Induced Arthritis in DBA/1 Mice: A Murine Model of Human Rheumatoid Arthritis. 2011; PLoS One 6, e23453, 10 pAGES.

Spor, A. et al., Unravelling the effects of the environment and host genotype on the gut microbiome. Nat Rev Microbiol. Apr. 2011;9(4):279-90. doi: 10.1038/nrmicro2540.

Srutkova, D. et al., Efficiency of PCR-based methods in discriminating *Bifidobacterium longum* ssp. *longum* and *Bifidobacterium longum* ssp. infantis strains of human origin.J Microbiol Methods. Oct. 2011;87(1):10-6. doi: 10.1016/j.mimet.2011.06.014. Epub Jul. 2, 2011.

Stoll et al., Altered microbiota associated with abnormal humoral immune responses to commensal organisms in enthesitis-related arthritis, 2014; Arthritis Res Ther. 16:486.

Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.

Strobel, H.J. Basic laboratory culture methods for anaerobic bacteria. Methods Mol Biol. 2009;581:247-61. doi: 10.1007/978-1-60761-214-8_16.

Sun, D. et al., The role of Th17-associated cytokines in the pathogenesis of experimental autoimmune uveitis (EAU). (2015) Cytokine. 74(1):76-80.

Tesmer, LA. et al., Th17 cells in human disease. Immunol Rev. 2008;223:87-113.

Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.

Yin, X. et al., Combined effect of five single nucleotide polymorphisms related to IL23/Th17 pathway in the risk of psoriasis.Immunogenetics. Mar. 2014;66(3):215-8. doi: 10.1007/s00251-013-0756-z. Epub Jan. 14, 2014.

Zhang, B. et al., The Prevalance of Th17 Cells in Patients With Gastric Cancer. 2008. Biochem Biophys Res Commun 374 (3), 533-537.

Bottacini, et al., Comparative genomics of the Bifidobacterium brevetaxon. BMC Genomics, 2014; 15:170. DOI:10.1186/1471-1471-2164-15-170.

Co-pending U.S. Appl. No. 15/679,857, filed Aug. 17, 2017.

Notice of allowance dated Sep. 1, 2017 for U.S. Appl. No. 15/357,850.

Vetrovsky, T. and Baldrian, P., The variability of the 16S rRNA gene in bacterial genomes and its consequences for bacterial community analyses. Plos One. Feb. 2013; 8(2): e57923.

\* cited by examiner

TEFI Scores

FIG. 4

| Test | MRx0010 |
|---|---|
| Urease | Intermediate positive |
| Arginine dihydrolase | Positive |
| α-galactosidase | Intermediate positive |
| ß-galactosidase | Intermediate positive |
| ß-galactosidase 6 phosphate | Intermediate positive |
| α-glucosidase | Intermediate positive |
| ß-glucosidase | Positive |
| α-arabinose | Intermediate positive |
| ß-glucoronidase | Intermediate positive |
| N-acetyl-ß-glucosaminidase | Intermediate positive |
| Mannose fermentation | Positive |
| Raffinose fermentation | Intermediate positive |
| Glutamic acid decarboxylase | Positive |
| α-fucosidase | Intermediate positive |
| Nitrate reduction | Intermediate positive |
| Indole production | Intermediate positive |
| Alkaline phosphatase | Intermediate positive |
| Arginine arylamidase | Positive |
| Proline arylamidase | Intermediate positive |
| Leucyl glycine arylamidase | Intermediate positive |
| Phenylalanine arylamidase | Positive |
| Leucine arylamidase | Positive |
| Pyroglutamic acid arylamidase | Positive |
| Tyrosine arylamidase | Positive |
| Alanine arylamidase | Intermediate positive |
| Glycine arylamidase | Positive |
| Histidine arylamidase | Positive |
| Glutamyl glutamic acid arylamidase | Intermediate positive |
| Serine arylamidase | Positive |

■ Positive  ▨ Intermediate positive  ▧ Negative

COMPOSITIONS COMPRISING BACTERIAL STRAINS

SEQUENCE LISTING

The instant application contains a Sequence Listing which has been submitted electronically in ASCII format and is hereby incorporated by reference in its entirety. Said ASCII copy, created on Nov. 18, 2016, is named 49455-710-201_P067591XX_sequence_listing.txt and is 3,842,867 bytes in size.

CROSS REFERENCE

This application claims priority to GB Application No. 1520497.7, filed on Nov. 20, 2015, which is herein incorporated by reference in its entirety.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in subjects with IBD whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterized.

There is a requirement in the art for new methods of treating inflammatory and autoimmune diseases. There is also a requirement for the potential effects of gut bacteria to be characterized so that new therapies using gut bacteria can be developed.

SUMMARY OF THE INVENTION

The inventors have developed new therapies for treating and preventing inflammatory and autoimmune diseases. In particular, the inventors have developed new therapies for treating and preventing diseases and conditions mediated by IL-17 or the Th17 pathway. In particular, the inventors have identified that bacterial strains of the species *Enterococcus faecium* can be effective for treating and preventing diseases and conditions mediated by IL-17 or the Th17 pathway. As described in the examples, oral administration of compositions comprising *Enterococcus faecium* may reduce the severity of the inflammatory response, including the Th17 inflammatory response, in mouse models of uveitis.

Therefore, in a first embodiment, the invention provides a composition comprising a bacterial strain of the species *Enterococcus faecium*, for use in a method of treating or preventing a disease or condition mediated by IL-17 or the Th17 pathway. The inventors have identified that treatment with bacterial strains from this species can provide clinical benefits in mouse models of inflammatory and autoimmune diseases mediated by IL-17 and the Th17 pathway, may reduce levels of cytokines that are part of the Th17 pathway, including IL-17, and may alleviate the Th17 inflammatory response.

In particular embodiments, the invention provides a composition comprising a bacterial strain of the species *Enterococcus faecium*, for use in a method of treating or preventing a disease or condition selected from the group consisting of: uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection. The effect shown for the bacterial strains from the species *Enterococcus faecium* on the Th17 inflammatory response and on diseases mediated by IL-17 and the Th17 pathway may provide therapeutic benefits for other diseases and conditions mediated by IL-17 and the Th17 pathway, such as those listed above.

In particularly preferred embodiments, the invention provides a composition comprising a bacterial strain of the species *Enterococcus faecium*, for use in a method of treating or preventing uveitis, such as posterior uveitis. The inventors have identified that treatment with *Enterococcus faecium* strains can reduce disease incidence and disease severity in a mouse model of uveitis and can prevent or reduce retinal damage. In preferred embodiments, the invention provides a composition comprising a bacterial strain of the species *Enterococcus faecium*, for use in the treatment of uveitis. Compositions using *Enterococcus faecium* may be particularly effective for treating uveitis.

In further preferred embodiments, the invention provides a composition comprising a bacterial strain of the species *Enterococcus faecium*, for use in a method of treating or preventing asthma, such as neutrophilic asthma or allergic asthma. Treatment with *Enterococcus faecium* strains may reduce recruitment of neutrophils and eosinophils into the lungs, which can help treat or prevent asthma. In certain embodiments, the composition is for use in a method of treating or preventing neutrophilic asthma or eosinophilic asthma. The compositions of the invention may be particularly effective for treating or preventing neutrophilic asthma and eosinophilic asthma. Indeed, in certain embodiments, the composition is for use in a method of reducing a neutrophilic inflammatory response in the treatment or prevention of asthma, or the composition is for use in a method of reducing an eosinophilic inflammatory response in the treatment or prevention of asthma. In preferred embodiments, the invention provides a composition comprising a bacterial strain of the species *Enterococcus faecium* for use in the treatment of asthma, and in particular eosinophilic or allergic asthma. Also, *Enterococcus faecium* may have a particularly pronounced effect on neutrophils in asthma models and treatment with *Enterococcus faecium* may be particularly effective for treating neutrophilic asthma.

In further preferred embodiments, the invention provides a composition comprising a bacterial strain of the species *Enterococcus faecium*, for use in a method of treating or preventing rheumatoid arthritis. Treatment with *Enterococcus faecium* strains may provide clinical benefits in a mouse model of rheumatoid arthritis and reduce joint swelling. In preferred embodiments, the invention provides a composition comprising a bacterial strain of the species *Enterococcus faecium*, for use in the treatment of rheumatoid arthritis. Compositions using *Enterococcus faecium* may be particularly effective for treating rheumatoid arthritis.

In further preferred embodiments, the invention provides a composition comprising a bacterial strain of the species *Enterococcus faecium*, for use in a method of treating or preventing multiple sclerosis. Treatment with *Enterococcus faecium* strains may reduce disease incidence and disease severity in a mouse model of multiple sclerosis. In preferred embodiments, the invention provides a composition comprising a bacterial strain of the species *Enterococcus faecium*, for use in the treatment of multiple sclerosis. Compositions using *Enterococcus faecium* may be particularly effective for treating multiple sclerosis.

In further preferred embodiments, the invention provides a composition comprising a bacterial strain of the species *Enterococcus faecium*, for use in a method of treating or preventing cancer, such as breast, lung or liver cancer. Compositions comprising a bacterial strain of the species *Enterococcus faecium* may reduce tumor growth in mouse models of breast, lung and liver cancer. In certain embodiments, the composition is for use in a method of reducing tumor size or preventing tumor growth in the treatment of cancer.

In certain embodiments, the compositions of the invention are for use in a method of reducing IL-17 production or reducing Th17 cell differentiation in the treatment or prevention of a disease or condition mediated by IL-17 or the Th17 pathway. In particular, the compositions of the invention may be used in reducing IL-17 production or reducing Th17 cell differentiation in the treatment or prevention of asthma, rheumatoid arthritis, multiple sclerosis, uveitis or cancer. Preferably, the invention provides compositions comprising a bacterial strain of the species *Enterococcus faecium*, for use in reducing IL-17 production or reducing Th17 cell differentiation in the treatment or prevention of asthma, rheumatoid arthritis, multiple sclerosis, uveitis or cancer.

In certain embodiments, the composition is for use in a subject with elevated IL-17 levels or Th17 cells. The effect shown for *Enterococcus faecium* on uveitis, which is strongly associated with the Th17 inflammatory response, means that *Enterococcus faecium* strains may be particularly beneficial for such subjects.

In preferred embodiments of the invention, the bacterial strain in the composition is of *Enterococcus faecium*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Enterococcus faecium*. Preferably, the bacterial strain has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

In certain embodiments, the composition of the invention is for oral administration. Oral administration of the strains of the invention can be effective for treating IL-17- or Th17 pathway-mediated diseases and conditions. Also, oral administration is convenient for subjects and practitioners and allows delivery to and/or partial or total colonization of the intestine.

In certain embodiments, the composition of the invention comprises one or more pharmaceutically acceptable excipients, diluents or carriers.

In certain embodiments, the composition of the invention comprises a bacterial strain that has been lyophilized. Lyophilization is an effective and convenient technique for preparing stable compositions that allow delivery of bacteria.

In certain embodiments, the composition comprises a bacterial strain that has been lyophilized; and further comprises a pharmaceutically acceptable excipient, diluent, or carrier.

In certain embodiments, the composition comprises a lyoprotectant which is a pharmaceutically acceptable excipient, diluent, or carrier.

In certain embodiments, the composition is a lyophilized composition. In some cases, the lyophilized composition may be reconstituted prior to administration to a subject. In some cases, the reconstitution is with a diluent described herein. In some cases, the diluent may be sterile water, sodium chloride solution, or dextrose solution.

In certain embodiments, the invention provides a food product comprising the composition as described above.

In certain embodiments, the invention provides a vaccine composition comprising the composition as described above.

Additionally, the invention provides a method of treating or preventing a disease or condition mediated by IL-17 or the Th17 pathway, comprising administering a composition comprising a bacterial strain of the species *Enterococcus faecium*.

In developing the above invention, the inventors have identified and characterized a bacterial strain that is particularly useful for therapy. The *Enterococcus faecium* strain of the invention is shown to be effective for treating the diseases described herein, such as uveitis. Therefore, in another aspect, the invention provides a cell of the *Enterococcus faecium* strain deposited under accession number NCIMB 42487, or a derivative thereof. The invention also provides compositions comprising such cells, or biologically pure cultures of such cells. The invention also provides a cell of the *Enterococcus faecium* strain deposited under accession number NCIMB 42487, or a derivative thereof, for use in therapy, in particular for the diseases described herein.

INCORPORATION BY REFERENCE

All publications, patents, and patent applications mentioned in this specification are herein incorporated by reference in their entirety for all purposes, to the same extent as if each individual publication, patent, or patent application was specifically and individually indicated to be incorporated by reference.

BRIEF DESCRIPTION OF DRAWINGS

FIG. 4: Rapid ID 32 A analysis of MRx0010

DETAILED DESCRIPTION

Bacterial Strains

Figure 1:
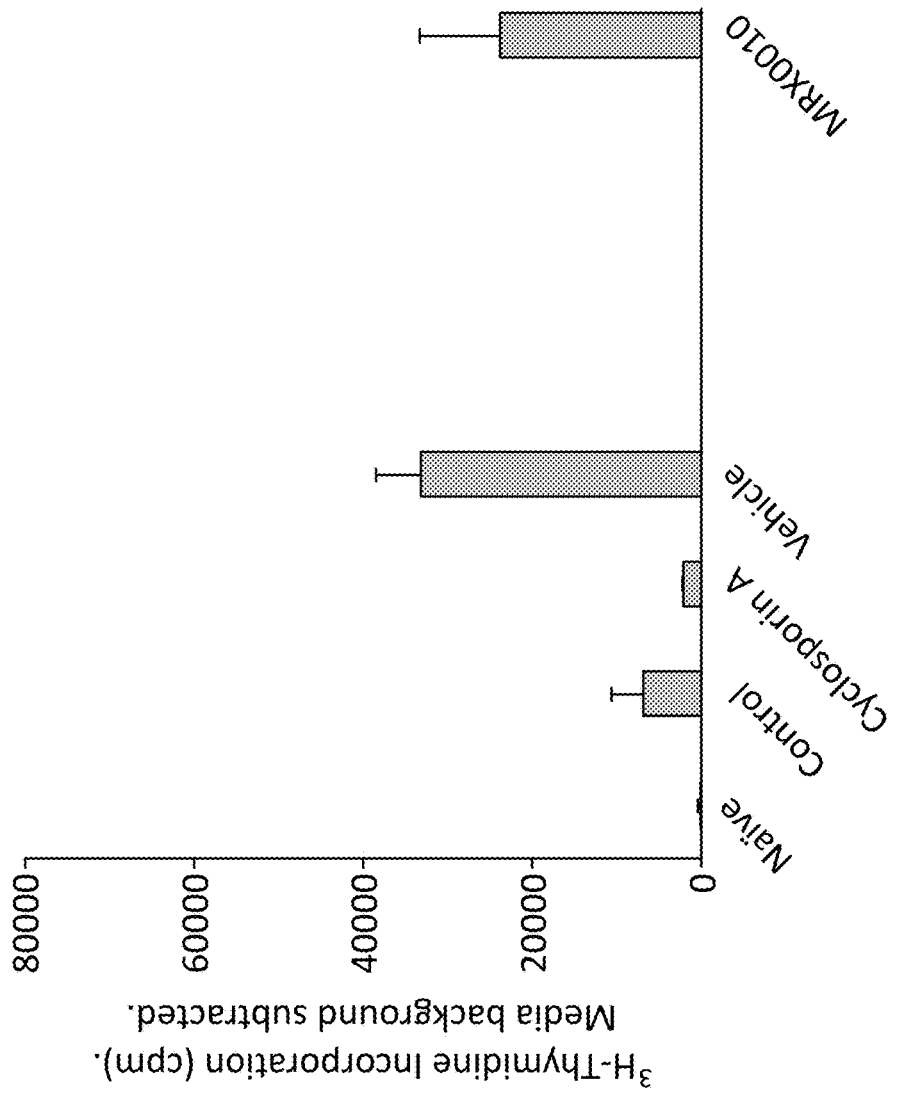
FIG. 1: Mouse model of uveitis—Lymph node proliferative response to IRBP peptide. Media background subtracted [IRBP peptide stimulated–media background] counts per minute based on 3H-thymidine incorporation. All data are presented as Mean+SEM (n=3).

The compositions of the invention comprise a bacterial strain of the species *Enterococcus faecium*. The examples demonstrate that bacteria of this species are useful for treating or preventing uveitis and diseases and conditions mediated by IL-17 or the Th17 pathway.

The invention provides a composition comprising a bacterial strain of the species *Enterococcus faecium* for use in therapy, for example, for use in treating or preventing an inflammatory and/or autoimmune disease. In certain embodiments, the compositions of the invention comprise *Enterococcus faecium* and do not contain any other bacterial species. In certain embodiments, the compositions of the invention comprise a single strain of *Enterococcus faecium* and do not contain any other bacterial strains or species.

*Enterococcus faecium* is a Gram-positive, alpha-hemolytic or nonhemolytic bacterium in the genus *Enterococcus* that often occurs in pairs (diplococci) or short chains. The type strain of *Enterococcus faecium* is ATCC 19434=CCUG 542=CIP 103014=CFBP 4248=DSM 20477=HAMBI 1710=JCM 5804=JCM 8727=LMG 11423=NBRC 100486=NBRC 100485=NCIMB 11508 (formerly NCDO 942)=NCTC 7171 [16]. The GenBank accession number for the 16S rRNA gene sequence of *Enterococcus faecium* strain LMG 11423 is AJ301830 (disclosed herein as SEQ ID NO:1). This exemplary *Enterococcus faecium* strain is described in [16].

Other *Enterococcus faecium* strains for use in the invention include: R13 [17], CFR 3003 [18], AL41 [19], DSM 10663 NCIMB 10415 [20], NCIMB 10415 E1707 [21], NM113 and NM213 [22]. In certain embodiments, the compositions of the invention comprise one of these strains, or a derivative or biotype thereof. A further example of an *Enterococcus faecium* for use in the invention is the D0 strain. The genomic sequence of this bacterium consists of a chromosome and three plasmids. The sequence of the chromosome is disclosed herein as SEQ ID NO:3 and the sequence of the three plasmids is disclosed as SEQ ID NOs:4, 5 and 6. The genomic sequence was obtained using whole shotgun sequences and is available using GenBank accession number NC_017960.1.

All microorganism deposits were made under the terms of the Budapest Treaty. Maintenance of a viable culture is assured for 30 years from the date of deposit. All restrictions on the availability to the public of the deposited microorganisms will be irrevocably removed upon the granting of a patent for this application. The *Enterococcus faecium* bacterium deposited under accession number NCIMB 42487 was tested in the Examples and is also referred to herein as strain MRX010. The terms "MRX010" and "MRx0010" are used interchangeably herein. A 16S rRNA sequence for the MRX010 strain that was tested is provided in SEQ ID NO:2. Strain MRX010 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 16 Nov. 2015 as "*Enterococcus faecium*" and was assigned accession number NCIMB 42487.

Bacterial strains closely related to the strain tested in the examples are also expected to be effective for treating or preventing uveitis and diseases and conditions mediated by IL-17 or the Th17 pathway. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Enterococcus faecium*. Preferably, the bacterial strain for use in the invention has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

Bacterial strains that are biotypes of the bacterium deposited under accession number 42487 are also expected to be effective for treating or preventing uveitis and diseases and conditions mediated by IL-17 or the Th17 pathway. A biotype is a closely related strain that has the same or very similar physiological and biochemical characteristics.

Strains that are biotypes of the bacterium deposited under accession number NCIMB 42487 and that are suitable for use in the invention may be identified by sequencing other nucleotide sequences for the bacterium deposited under accession number NCIMB 42487. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, (GTG)$_5$, or REP or [23]. Biotype strains may have sequences with at least 95%, 96%, 97%, 98%, 99%, 99.5% or 99.9% sequence identity to the corresponding sequence of the bacterium deposited under accession number NCIMB 42487. In some embodiments, a biotype strain has a sequence with at least 95%, 96%, 97%, 98%, 99%, 99.5% or 99.9% sequence identity to the corresponding sequence of strain MRX010 deposited as NCIMB 42487 and comprises a 16S rRNA sequence that is at least 99% identical (e.g. at least 99.5% or at least 99.9% identical) to SEQ ID NO:2. In some embodiments, a biotype strain has a sequence with at least 95%, 96%, 97%, 98%, 99%, 99.5% or 99.9% sequence identity to the corresponding sequence of strain MRX010 deposited as NCIMB 42487 and has the 16S rRNA sequence of SEQ ID NO:2.

Alternatively, strains that are biotypes of the bacterium deposited under accession number NCIMB 42487 and that are suitable for use in the invention may be identified by using the accession number NCIMB 42487 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Enterococcus faecium* strains.

In certain embodiments, strains that are biotypes of the bacterium deposited under accession number NCIMB 42487 and that are suitable for use in the invention are strains that provide the same pattern as the bacterium deposited under accession number NCIMB 42487 when analyzed by amplified ribosomal DNA restriction analysis (ARDRA), for example when using Sau3AI restriction enzyme (for exemplary methods and guidance see, for example,[24]). Alternatively, biotype strains are identified as strains that have the same carbohydrate fermentation patterns as the bacterium deposited under accession number NCIMB 42487.

In some embodiments, the bacterial strain used in the invention is:

Positive for at least one of (e.g. at least 2, 3, 4, 5, 6, 7, 8, 9, 10, 11 or all of): arginine dihydrolase, β-glucosidase, mannose fermentation, glutamic acid decarboxylase, arginine arylamidase, phenylalanine arylamidase, leucine arylamidase, pyroglutamic acid arylamidase, tyrosine arylamidase, glycine arylamidase, histidine arylamidase and serine arylamidase; and/or Intermediate for N-acetyl-β-glucosaminidase;

preferably as determined by an assay of carbohydrate, amino acid and nitrate metabolism, and optionally an assay of alkaline phosphatase activity, more preferably as determined by Rapid ID 32A analysis (preferably using the Rapid ID 32A system from bioMérieux).

Other *Enterococcus faecium* strains that are useful in the compositions and methods of the invention, such as biotypes of the bacterium deposited under accession number NCIMB 42487, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to the bacterium deposited under accession number NCIMB 42487 may be useful in the invention. A useful strain will have comparable immune modulatory activity to the NCIMB 42487 strain. In particular, a biotype strain will elicit comparable effects on the uveitis disease models to the effects shown in the Examples, which may be identified by using the culturing and administration protocols described in the Examples.

A particularly preferred strain of the invention is the *Enterococcus faecium* strain deposited under accession number NCIMB 42487. This is the exemplary MRX010 strain tested in the examples and shown to be effective for treating disease. Therefore, the invention provides a cell, such as an isolated cell, of the *Enterococcus faecium* strain deposited under accession number NCIMB 42487, or a derivative thereof. The invention also provides a composition comprising a cell of the *Enterococcus faecium* strain deposited under accession number NCIMB 42487, or a derivative thereof. The invention also provides a biologically pure culture of the *Enterococcus faecium* strain deposited under accession number NCIMB 42487. The invention also provides a cell of the *Enterococcus faecium* strain deposited under accession number NCIMB 42487, or a derivative thereof, for use in therapy, in particular for the diseases described herein. A derivative of the strain deposited under accession number NCIMB 42487 may be a daughter strain (progeny) or a strain cultured (subcloned) from the original.

A derivative of a strain of the invention may be modified, for example at the genetic level, without ablating the biological activity. In particular, a derivative strain of the invention is therapeutically active. A derivative strain will have comparable immune modulatory activity to the original NCIMB 42487 strain. In particular, a derivative strain will elicit comparable effects on the uveitis disease models to the effects shown in the Examples, which may be identified by using the culturing and administration protocols described in the Examples. A derivative of the NCIMB 42487 strain will generally be a biotype of the NCIMB 42487 strain.

References to cells of the *Enterococcus faecium* strain deposited under accession number NCIMB 42487 encompass any cells that have the same safety and therapeutic efficacy characteristics as the strains deposited under accession number NCIMB 42487, and such cells are encompassed by the invention. Thus, in some embodiments, reference to cells of the *Enterococcus faecium* strain deposited under accession number NCIMB 42487 refers only to the MRX010 strain deposited under NCIMB 42487 and does not refer to a bacterial strain that was not deposited under NCIMB 42487. In some embodiments, reference to cells of the *Enterococcus faecium* strain deposited under accession number NCIMB 42487 refers to cells that have the same safety and therapeutic efficacy characteristics as the strains deposited under accession number NCIMB 42487, but which are not the strain deposited under NCIMB 42487.

In certain embodiments, the bacterial strain for use in the invention has a chromosome with sequence identity to SEQ ID NO:3. In some embodiments, the bacterial strain for use in the invention has a chromosome with at least 90% sequence identity (e.g. at least 92%, 94%, 95%, 96%, 97%, 98%, 99% or 100% sequence identity) to SEQ ID NO:3 across at least 60% (e.g. across at least 65%, 70%, 75%, 80%, 85%, 95%, 96%, 97%, 98%, 99% or 100%) of SEQ ID NO:3. For example, the bacterial strain for use in the invention may have a chromosome with at least 90% sequence identity to SEQ ID NO:3 across 70% of SEQ ID NO:3, or at least 90% sequence identity to SEQ ID NO:3 across 80% of SEQ ID NO:3, or at least 90% sequence identity to SEQ ID NO:3 across 90% of SEQ ID NO:3, or at least 90% sequence identity to SEQ ID NO:3 across 100% of SEQ ID NO:3, or at least 95% sequence identity to SEQ ID NO:3 across 70% of SEQ ID NO:3, or at least 95% sequence identity to SEQ ID NO:3 across 80% of SEQ ID NO:3, or at least 95% sequence identity to SEQ ID NO:3 across 90% of SEQ ID NO:3, or at least 95% sequence identity to SEQ ID NO:3 across 100% of SEQ ID NO:3, or at least 98% sequence identity to SEQ ID NO:3 across 70% of SEQ ID NO:3, or at least 98% sequence identity to SEQ ID NO:3 across 80% of SEQ ID NO:3, or at least 98% sequence identity to SEQ ID NO:3 across 90% of SEQ ID NO:3, or at least 98% identity across 95% of SEQ ID NO:3, or at least 98% sequence identity to SEQ ID NO:3 across 100% of SEQ ID NO:3, or at least 99.5% sequence identity to SEQ ID NO:3 across 90% of SEQ ID NO:3, or at least 99.5% identity across 95% of SEQ ID NO:3, or at least 99.5% identity across 98% of SEQ ID NO:3, or at least 99.5% sequence identity to SEQ ID NO:3 across 100% of SEQ ID NO:3.

In certain embodiments, the bacterial strain for use in the invention has a chromosome with sequence identity to SEQ ID NO:3, for example as described above, and a 16S rRNA sequence with sequence identity to SEQ ID NO:1 or 2, for example as described above, preferably with a 16s rRNA sequence that is at least 99% identical to SEQ ID NO: 2, more preferably which comprises the 16S rRNA sequence of SEQ ID NO:2.

In certain embodiments, the bacterial strain for use in the invention has a chromosome with sequence identity to SEQ ID NO:3, for example as described above, and is effective for treating or preventing diseases and conditions mediated by IL-17 or the Th17 pathway.

In certain embodiments, the bacterial strain for use in the invention has a chromosome with sequence identity to SEQ ID NO:3, for example as described above, and a 16S rRNA sequence with sequence identity to SEQ ID NO: 1 or 2, for example as described above, and is effective for treating or preventing diseases and conditions mediated by IL-17 or the Th17 pathway.

In certain embodiments, the bacterial strain for use in the invention has a 16s rRNA sequence that is at least 99%, 99.5% or 99.9% identical to the 16s rRNA sequence represented by SEQ ID NO: 2 (for example, which comprises the 16S rRNA sequence of SEQ ID NO:2) and a chromosome with at least 95% sequence identity to SEQ ID NO:3 across at least 90% of SEQ ID NO:3, and which is effective for treating or preventing diseases and conditions mediated by IL-17 or the Th17 pathway.

In certain embodiments, the bacterial strain for use in the invention is a *Enterococcus faecium* and has a 16s rRNA sequence that is at least 99%, 99.5% or 99.9% identical to the 16s rRNA sequence represented by SEQ ID NO: 2 (for example, which comprises the 16S rRNA sequence of SEQ ID NO:2) and a chromosome with at least 98% sequence identity (e.g. at least 99% or at least 99.5% sequence identity) to SEQ ID NO:3 across at least 98% (e.g. across at least 99% or at least 99.5%) of SEQ ID NO:3, and which is effective for treating or preventing diseases and conditions mediated by IL-17 or the Th17 pathway.

In preferred embodiments, the bacterial strains in the compositions of the invention are viable and capable of at least partially or totally colonizing the intestine.

Therapeutic Uses

As demonstrated in the examples, the bacterial compositions of the invention are effective for reducing the Th17 inflammatory response. In particular, treatment with compositions of the invention achieves clinical improvements in animal models of conditions mediated by IL-17 and the Th17 pathway and may achieve a reduction in IL-17A levels and other Th17 pathway cytokines. Therefore, the compositions of the invention may be useful for treating or preventing inflammatory and autoimmune diseases, and in particular diseases or conditions mediated by IL-17. In particular, the compositions of the invention may be useful for reducing or preventing elevation of the IL-17 inflammatory response.

Th17 cells are a subset of T helper cells that produce, for example, IL-17A, IL17-F, IL-21 and IL-22. Th17 cell differentiation and IL-17 expression may be driven by IL-23. These cytokines and others form important parts of the Th17 pathway, which is a well-established inflammatory signaling pathway that contributes to and underlies a number of inflammatory and autoimmune diseases (as described in, for example, [25-30]). Diseases wherein the Th17 pathway is activated are Th17 pathway-mediated diseases. Th17 pathway-mediated diseases can be ameliorated or alleviated by repressing the Th17 pathway, which may be through a reduction in the differentiation of Th17 cells or a reduction in their activity or a reduction in the level of Th17 pathway cytokines. Diseases mediated by the Th17 pathway may be characterized by increased levels of cytokines produced by Th17 cells, such as IL-17A, IL-17F, IL-21, IL-22, IL-26, IL-9 (reviewed in [31]). Diseases mediated by the Th17 pathway may be characterized by increased expression of Th-17-related genes, such as Stat3 or IL-23R. Diseases mediated by the Th17 pathway may be associated with increased levels of Th17 cells.

IL-17 is a pro-inflammatory cytokine that contributes to the pathogenesis of several inflammatory and autoimmune diseases and conditions. IL-17 as used herein may refer to any member of the IL-17 family, including IL-17A, IL-17B, IL-17C, IL-17D, IL-17E, and IL-17F. IL-17-mediated diseases and conditions are characterized by high expression of IL-17 and/or the accumulation or presence of IL-17-positive cells in a tissue affected by the disease or condition. Similarly, IL-17-mediated diseases and conditions are diseases and conditions that are exacerbated by high IL-17 levels or an increase in IL-17 levels, and that are alleviated by low IL-17 levels or a reduction in IL-17 levels. The IL-17 inflammatory response may be local or systemic.

Examples of diseases and conditions that may be mediated by IL-17 or the Th17 pathway include uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection. In preferred embodiments, the compositions of the invention are used for treating or preventing one or more of these conditions or diseases. In further preferred embodiments, these conditions or diseases are mediated by IL-17 or the Th17 pathway.

In some embodiments, the pathogenesis of the disease or condition affects the intestine. In some embodiments, the pathogenesis of the disease or condition does not affect the intestine. In some embodiments, the pathogenesis of the disease or condition is not localised at the intestine. In some embodiments, the treating or preventing occurs at a site other than at the intestine. In some embodiments, the treating or preventing occurs at the intestine and also at a site other than at the intestine. In certain embodiments, the disease or condition is systemic.

In certain embodiments, the compositions of the invention are for use in a method of reducing IL-17 production or reducing Th17 cell differentiation in the treatment or prevention of a disease or condition mediated by IL-17 or the Th17 pathway. In certain embodiments, the compositions of the invention are for use in treating or preventing an inflammatory or autoimmune disease, wherein said treatment or prevention is achieved by reducing or preventing elevation of the Th17 inflammatory response. In certain embodiments, the compositions of the invention are for use in treating a subject with an inflammatory or autoimmune disease, wherein the subject has elevated IL-17 levels or elevated Th17 cells or is exhibiting a Th17 inflammatory response. In certain embodiments, the subject may have been diagnosed with a chronic inflammatory or autoimmune disease or condition, or the composition of the invention may be for use in preventing an inflammatory or autoimmune disease or condition developing into a chronic inflammatory or autoimmune disease or condition. In certain embodiments, the disease or condition may not be responsive to treatment with TNF-α inhibitors. These uses of the invention may be applied to any of the specific disease or conditions listed in the preceding paragraph.

IL-17 and the Th17 pathway are often associated with chronic inflammatory and autoimmune diseases, so the compositions of the invention may be particularly useful for treating or preventing chronic diseases or conditions as listed above. In certain embodiments, the compositions are for use in subjects with chronic disease. In certain embodiments, the compositions are for use in preventing the development of chronic disease.

The compositions of the invention may be useful for treating diseases and conditions mediated by IL-17 or the Th17 pathway and for addressing the Th17 inflammatory response, so the compositions of the invention may be particularly useful for treating or preventing chronic disease, treating or preventing disease in subjects that have not responded to other therapies (such as treatment with TNF-α inhibitors), and/or treating or preventing the tissue damage and symptoms associated with IL-17 and Th17 cells. For example, IL-17 is known to activate matrix destruction in cartilage and bone tissue and IL-17 has an inhibitory effect on matrix production in chondrocytes and osteoblasts, so the compositions of the invention may be useful for treating or preventing bone erosion or cartilage damage.

In certain embodiments, treatment with compositions of the invention provides a reduction or prevents an elevation in IL-17 levels, in particular IL-17A levels. In certain embodiments, treatment with compositions of the invention provides a reduction or prevents an elevation in TNFα, IFN-γ or IL-6 levels. Such reduction or prevention of elevated levels of these cytokines may be useful for treating or preventing inflammatory and autoimmune diseases and conditions, in particular those mediated by IL-17 or the Th17 pathway.

Uveitis

In preferred embodiments, the compositions of the invention are for use in treating or preventing uveitis. The examples demonstrate that the compositions of the invention achieve a reduction in disease incidence and disease severity in an animal model of uveitis and so they may be useful in the treatment or prevention of uveitis. Uveitis is inflammation of the uvea and can result in retinal tissue destruction. It can present in different anatomical forms (anterior, intermediate, posterior or diffuse) and result from different, but related, causes, including systemic autoimmune disorders. IL-17 and the Th17 pathway are centrally involved in uveitis, so the efficacy of the compositions of the invention for treating uveitis indicates that the compositions of the invention may be particularly effective for treating and preventing diseases and conditions mediated by IL-17 or the Th17 pathway. References [32-39] describe elevated serum levels of interleukin-17A in subjects with uveitis, specific association of IL17A genetic variants with panuveitis, the role of Th17-associated cytokines in the pathogenesis of experimental autoimmune uveitis, the imbalance between Th17 Cells and regulatory T Cells during monophasic experimental autoimmune uveitis, the up-regulation of IL-17A in subjects with uveitis and active Adamantiades-Behçet and Vogt-Koyanagi-Harada (VKH) diseases, the treatment of non-infectious uveitis with secukinumab (anti-IL-17A antibody), and Th17 in uveitic eyes.

In certain embodiments, the uveitis is posterior uveitis. Posterior uveitis presents primarily with inflammation of the retina and choroid and the examples demonstrate that the compositions of the invention are effective for reducing retinal inflammation and damage.

In certain embodiments, treatment with the compositions of the invention results in a reduction in retinal damage. In certain embodiments, the compositions of the invention are for use in reducing or preventing retinal damage in the treatment of uveitis. In certain embodiments, the compositions are for use in treating subjects with severe uveitis that are at risk of retinal damage. In certain embodiments, treatment with the compositions of the invention results in a reduction in optic disc inflammation. In certain embodiments, the compositions of the invention are for use in reducing or preventing optic disc inflammation. In certain embodiments, treatment with the compositions of the invention results in a reduction in retinal tissue infiltration by inflammatory cells. In certain embodiments, the compositions of the invention are for use in reducing retinal tissue infiltration by inflammatory cells. In certain embodiments, treatment with the compositions of the invention results in vision being maintained or improved. In certain embodiments, the compositions of the invention are for use in maintaining or improving vision.

In certain embodiments, the compositions are for use in treating or preventing uveitis associated with a non-infectious or autoimmune disease, such as Behçet disease, Crohn's disease, Fuchs heterochromic iridocyclitis, granulomatosis with polyangiitis, HLA-B27 related uveitis, juvenile idiopathic arthritis, sarcoidosis, spondyloarthritis, sympathetic ophthalmia, tubulointerstitial nephritis and uveitis syndrome or Vogt-Koyanagi-Harada syndrome. IL-17A has been shown to be involved in, for example, Behçet and Vogt-Koyanagi-Harada diseases.

Treatment or prevention of uveitis may refer to, for example, an alleviation of the severity of symptoms or a prevention of relapse.

Cancer

In preferred embodiments, the compositions of the invention are for use in treating or preventing cancer. IL-17 and the Th17 pathway have central roles in cancer development and progression, and so the compositions of the invention may be useful for treating or preventing cancer.

Although the roles of IL-17 and Th17 cells in cancer are not fully understood, numerous pro-tumor effects of IL-17 and Th17 cells are known. For example, Th17 cells and IL-17 can promote angiogenesis, increase proliferation and survival of tumor cells and activate tumor-promoting transcription factors [40-42].

In certain embodiments, treatment with the compositions of the invention results in a reduction in tumor size or a reduction in tumor growth. In certain embodiments, the compositions of the invention are for use in reducing tumor size or reducing tumor growth. The compositions of the invention may be effective for reducing tumor size or growth. In certain embodiments, the compositions of the invention are for use in subjects with solid tumors. In certain embodiments, the compositions of the invention are for use in reducing or preventing angiogenesis in the treatment of cancer. IL-17 and Th17 cells have central roles in angiogenesis. In certain embodiments, the compositions of the invention are for use in preventing metastasis.

In certain embodiments, the compositions of the invention are for use in treating or preventing breast cancer. The compositions of the invention may be effective for treating breast cancer, and IL-17 and Th17 cells have important roles in breast cancer [43]. In certain embodiments, the compositions of the invention are for use in reducing tumor size, reducing tumor growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The compositions of the invention may be effective for treating lung cancer, and IL-17 and Th17 cells have important roles in lung cancer [44]. In certain embodiments, the compositions of the invention are for use in reducing tumor size, reducing tumor growth, or reducing angiogenesis in the treatment of lung cancer. In preferred embodiments the cancer is lung carcinoma.

In certain embodiments, the compositions of the invention are for use in treating or preventing liver cancer. The compositions of the invention may be effective for treating liver cancer, and IL-17 and Th17 cells have important roles in liver cancer [45]. In certain embodiments, the compositions of the invention are for use in reducing tumor size, reducing tumor growth, or reducing angiogenesis in the treatment of liver cancer. In preferred embodiments the cancer is hepatoma (hepatocellular carcinoma).

In certain embodiments, the compositions of the invention are for use in treating or preventing carcinoma. The compositions of the invention may be particularly effective for treating carcinoma. In certain embodiments, the compositions of the invention are for use in treating or preventing non-immunogenic cancer. The compositions of the invention may be effective for treating non-immunogenic cancers.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising a bacterial strain of the species *Enterococcus faecium* and an anticancer agent. In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy® (ipilimumab, BMS); Keytruda® (pembrolizumab, Merck); Opdivo® (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin® (dinutuximab, United Therapeutics Corporation); Blincyto® (blinatumomab, Amgen); Cyramza® (ramucirumab, Eli Lilly); Gazyva® (obinutuzumab, Roche/Biogen); Kadcyla® (ado-trastuzumab emtansine, Roche/Genentech); Perjeta® (pertuzumab, Roche/Genentech); Adcetris® (brentuximab vedotin, Takeda/Millennium); Arzerra® (ofatumumab, GSK); Vectibix® (panitumumab, Amgen); Avastin® (bevacizumab, Roche/Genentech); Erbitux® (cetuximab, BMS/Merck); Bexxar® (tositumomab-I131, GSK); Zevalin® (ibritumomab tiuxetan, Biogen); Campath® (alemtuzumab, Bayer); Mylotarg® (gemtuzumab ozogamicin, Pfizer); Herceptin® (trastuzumab, Roche/Genentech); Rituxan® (rituximab, Genentech/Biogen); volociximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562

(AZ/MedImmune); AV-380 (AVEO); AV203 (AVEO); AV299 (AVEO); BAY79-4620 (Bayer); Anetumab ravtansine (Bayer); vanticutmab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vanticutmab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obintuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor); Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Ad1 (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1 (Genelux); T-VEC (Amgen); G207 (Medigene); HF10 (Takara Bio); SEPREHVIR (HSV1716, Virttu Biologics); OrienX010 (OrienGene Biotechnology); Reolysin® (Oncolytics Biotech); SVV-001 (Neotropix); Cacatak (CVA21, Viralytics); Alimta® (Eli Lilly), cisplatin, oxaliplatin, irinotecan, folinic acid, methotrexate, cyclophosphamide, 5-fluorouracil, Zykadia® (Novartis), Tafinlar® (GSK), Xalkori® (Pfizer), Iressa® (AZ), Gilotrif® (Boehringer Ingelheim), Tarceva® (Astellas Pharma), Halaven® (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan® (BMS); Oncovin® (Eli Lilly); Adriamycin® (Pfizer); Gemzar® (Eli Lilly); Xeloda® (Roche); Ixempra® (BMS); Abraxane® (Celgene); Trelstar® (Debiopharm); Taxotere® (Sanofi); Nexavar® (Bayer); IMMU-132 (Immunomedics); E7449 (Eisai); Thermodox® (Celsion); Cometriq® (Exellxis); Lonsurf® (Taiho Pharmaceuticals); Camptosar® (Pfizer); UFT (Taiho Pharmaceuticals); and TS-1 (Taiho Pharmaceuticals).

In some embodiments, the one or more *Enterococcus faecium* bacterial strains is/are the only therapeutically active agent(s) in a composition of the invention. In some embodiments, the bacterial strain(s) in the composition is/are the only therapeutically active agent(s) in a composition of the invention.

Asthma

In preferred embodiments, the compositions of the invention are for use in treating or preventing asthma. The compositions of the invention may achieve a reduction in the recruitment of neutrophils and/or eosinophils into the airways following sensitization and challenge with house dust mite extract and so they may be useful in the treatment or prevention of asthma. Asthma is a chronic disease characterized by inflammation and restriction of the airways. The inflammation in asthma may be mediated by IL-17 and/or Th17 cells, and so the compositions of the invention may be particularly effective for preventing or treating asthma. The inflammation in asthma may be mediated by eosinophils and/or neutrophils.

In certain embodiments, the asthma is eosinophilic or allergic asthma. Eosinophilic and allergic asthma are characterized by increased numbers of eosinophils in peripheral blood and in airway secretions and is associated pathologically with thickening of the basement membrane zone and pharmacologically by corticosteroid responsiveness [46]. Compositions that reduce or inhibit eosinophil recruitment or activation may be useful for treating or preventing eosinophilic and allergic asthma.

In additional embodiments, the compositions of the invention are for use in treating or preventing neutrophilic asthma (or non-eosinophilic asthma). High neutrophil numbers are associated with severe asthma that may be insensitive to corticosteroid treatment. Compositions that reduce or inhibit neutrophil recruitment or activation may be useful for treating or preventing neutrophilic asthma.

Eosinophilic and neutrophilic asthma are not mutually exclusive conditions and treatments that help address either the eosinophil and neutrophil responses may be useful for treating asthma in general.

Increased IL-17 levels and activation of the Th17 pathway are associated with severe asthma, so the compositions of the invention may be useful for preventing the development of severe asthma or for treating severe asthma.

In certain embodiments, the compositions of the invention are for use in methods reducing an eosinophilic inflammatory response in the treatment or prevention of asthma, or for use in methods of reducing a neutrophilic inflammatory response in the treatment or prevention of asthma. As noted above, high levels of eosinophils in asthma is associated pathologically with thickening of the basement membrane zone, so reducing eosinophilic inflammatory response in the treatment or prevention of asthma may be able to specifically address this feature of the disease. Also, elevated neutrophils, either in combination with elevated eosinophils or in their absence, is associated with severe asthma and chronic airway narrowing. Therefore, reducing the neutrophilic inflammatory response may be particularly useful for addressing severe asthma.

In certain embodiments, the compositions reduce peribronchiolar infiltration in allergic asthma, or are for use in reducing peribronchiolar infiltration in the treatment of allergic asthma. In certain embodiments, the compositions reduce peribronchiolar and/or perivascular infiltration in neutrophilic asthma, or are for use in reducing peribronchiolar and/or perivascular infiltration in the treatment of allergic neutrophilic asthma.

In certain embodiments, treatment with compositions of the invention provides a reduction or prevents an elevation in TNFα levels.

In certain embodiments, the compositions of the invention are for use in a method of treating asthma that results in a reduction of the eosinophilic and/or neutrophilic inflammatory response. In certain embodiments, the subject to be treated has, or has previously been identified as having, elevated neutrophil or eosinophil levels, for example as identified through blood sampling or sputum analysis.

The compositions of the invention may be useful for preventing the development of asthma in a new-born when administered to the new-born, or to a pregnant woman. The compositions may be useful for preventing the development of asthma in children. The compositions of the invention may be useful for treating or preventing adult-onset asthma. The compositions of the invention may be useful for managing or alleviating asthma. The compositions of the invention may be particularly useful for reducing symptoms associated with asthma that is aggravated by allergens, such as house dust mites.

Treatment or prevention of asthma may refer to, for example, an alleviation of the severity of symptoms or a reduction in the frequency of exacerbations or the range of triggers that are a problem for the subject.

Arthritis

In preferred embodiments, the compositions of the invention are for use in treating or preventing rheumatoid arthritis (RA). The compositions of the invention may achieve a reduction in the clinical signs of RA in a mouse model, reduce cartilage and bone damage, and reduce the IL-17 inflammatory response, and so may be useful in the treatment or prevention of RA. RA is a systemic inflammatory disorder that primarily affects joints. RA is associated with an inflammatory response that results in swelling of joints, synovial hyperplasia, and destruction of cartilage and bone. IL-17 and Th17 cells may have a key role in RA, for example because IL-17 inhibits matrix production in chondrocytes and osteoblasts and activates the production and function of matrix metalloproteinases and because RA disease activity is correlated to IL-17 levels and Th-17 cell numbers [47,48], so the compositions of the invention may be particularly effective for preventing or treating RA.

In certain embodiments, the compositions of the invention are for use in lowering IL-17 levels or preventing elevation of IL-17 levels in the treatment or prevention of RA. In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels.

In certain embodiments, treatment with the compositions of the invention results in a reduction in the swelling of joints. In certain embodiments, the compositions of the invention are for use in subjects with swollen joints or subjects identified as at risk of having swollen joints. In certain embodiments, the compositions of the invention are for use in a method of reducing joint swelling in RA.

In certain embodiments, treatment with the compositions of the invention results in a reduction in cartilage damage or bone damage. In certain embodiments, the compositions of the invention are for use in reducing or preventing cartilage or bone damage in the treatment of RA. In certain embodiments, the compositions are for use in treating subject with severe RA that are at risk of cartilage or bone damage.

Increased IL-17 levels and Th17 cell numbers are associated with cartilage and bone destruction in RA [47,48]. IL-17 is known to activate matrix destruction in cartilage and bone tissue and IL-17 has an inhibitory effect on matrix production in chondrocytes and osteoblasts. Therefore, in certain embodiments, the compositions of the invention are for use in preventing bone erosion or cartilage damage in the treatment of RA. In certain embodiments, the compositions are for use in treating subjects that exhibit bone erosion or cartilage damage or subjects identified as at risk of bone erosion or cartilage damage.

TNF-α is also associated with RA, but TNF-α is not involved in the pathogenesis of the later stages of the disease. In contrast, IL-17 has a role throughout all stages of chronic disease [49]. Therefore, in certain embodiments the compositions of the invention are for use in treating chronic RA or late-stage RA, such as disease that includes joint destruction and loss of cartilage. In certain embodiments, the compositions of the invention are for treating subjects that have previously received anti-TNF-α therapy. In certain embodiments, the subjects to be treated do not respond or no longer respond to anti-TNF-α therapy.

The compositions of the invention may be useful for modulating a subject's immune system, so in certain embodiments the compositions of the invention are for use in preventing RA in a subject that has been identified as at risk of RA, or that has been diagnosed with early-stage RA. The compositions of the invention may be useful for preventing the development of RA.

The compositions of the invention may be useful for managing or alleviating RA. The compositions of the invention may be particularly useful for reducing symptoms associated with joint swelling or bone destruction. Treatment or prevention of RA may refer to, for example, an alleviation of the severity of symptoms or a reduction in the frequency of exacerbations or the range of triggers that are a problem for the subject.

Multiple Sclerosis

In preferred embodiments, the compositions of the invention are for use in treating or preventing multiple sclerosis. The compositions of the invention may achieve a reduction in the disease incidence and disease severity in a mouse model of multiple sclerosis (the EAE model), and so they may be useful in the treatment or prevention of multiple sclerosis. Multiple sclerosis is an inflammatory disorder associated with damage to the myelin sheaths of neurons, particularly in the brain and spinal column. Multiple sclerosis is a chronic disease, which is progressively incapacitating and which evolves in episodes. IL-17 and Th17 cells may have a key role in multiple sclerosis, for example because IL-17 levels may correlate with multiple sclerosis lesions, IL-17 can disrupt blood brain barrier endothelial cell tight junctions, and Th17 cells can migrate into the central nervous system and cause neuronal loss [50,51]. Therefore, the compositions of the invention may be particularly effective for preventing or treating multiple sclerosis.

In certain embodiments, treatment with the compositions of the invention results in a reduction in disease incidence or disease severity. In certain embodiments, the compositions of the invention are for use in reducing disease incidence or disease severity. In certain embodiments, treatment with the compositions of the invention prevents a decline in motor function or results in improved motor function. In certain embodiments, the compositions of the invention are for use in preventing a decline in motor function or for use in improving motor function. In certain embodiments, treatment with the compositions of the invention prevents the development of paralysis. In certain embodiments, the compositions of the invention are for use in preventing paralysis in the treatment of multiple sclerosis.

The compositions of the invention may be useful for modulating a subject's immune system, so in certain embodiments the compositions of the invention are for use in preventing multiple sclerosis in a subject that has been identified as at risk of multiple sclerosis, or that has been diagnosed with early-stage multiple sclerosis or "relapsing-remitting" multiple sclerosis. The compositions of the invention may be useful for preventing the development of sclerosis.

The compositions of the invention may be useful for managing or alleviating multiple sclerosis. The compositions of the invention may be particularly useful for reducing symptoms associated with multiple sclerosis. Treatment or prevention of multiple sclerosis may refer to, for example, an alleviation of the severity of symptoms or a reduction in the frequency of exacerbations or the range of triggers that are a problem for the subject.

Modes of Administration

Preferably, the compositions of the invention are to be administered to the gastrointestinal tract in order to enable delivery to and/or partial or total colonization of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the subject's gut microbiota. Treatment may be repeated if delivery of and/or partial or total colonization with the strain of the invention is not achieved such that efficacy is not observed, or treatment may be ceased if delivery and/or partial or total colonization is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a subject that has been diagnosed with a disease or condition mediated by IL-17 or the Th17 pathway, or that has been identified as being at risk of a disease or condition mediated by IL-17 or the Th17 pathway. The compositions may also be administered as a prophylactic measure to prevent the development of diseases or conditions mediated by IL-17 or the Th17 pathway in a healthy subject.

The compositions of the invention may be administered to a subject that has been identified as having an abnormal gut microbiota. For example, the subject may have reduced or absent colonization by *Enterococcus faecium*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilized bacteria. Lyophilization of bacteria is a well-established procedure and relevant guidance is available in, for example, references [52-54].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of at least partially or totally colonizing the intestine. For example, in some embodiments, the bacterial strain in the composition of the invention is viable and capable of at least partially or totally colonizing the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [55] and [56].

The composition may be administered orally and may be in the form of a tablet, capsule or powder. Encapsulated products are preferred because *Enterococcus faecium* are anaerobes. Other ingredients (such as vitamin C, for example), may be included as oxygen scavengers and prebiotic substrates to improve the delivery and/or partial or total colonization and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a subject. A therapeutically effective amount of a bacterial strain may be sufficient to result in delivery to and/or partial or total colonization of the subject's intestine.

A suitable daily dose of the bacteria, for example for an adult human, may be from about $1\times10^3$ to about $1\times10^{11}$ colony forming units (CFU); for example, from about $1\times10^7$ to about $1\times10^{10}$ CFU; in another example from about $1\times10^6$ to about $1\times10^{10}$ CFU.

In certain embodiments, the composition contains the bacterial strain in an amount of from about $1\times10^6$ to about $1\times10^{11}$ CFU/g, respect to the weight of the composition; for example, from about $1\times10^8$ to about $1\times10^{10}$ CFU/g. The dose may be, for example, 1 g, 3 g, 5 g, and 10 g of the composition.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [57]. Acceptable carriers or diluents for therapeutic use are well known in the pharmaceutical art and are described, for example, in reference [58]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilizing agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavoring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated with a nutritious product such as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavored milks, ice cream; milk-containing food such as sweets.

In some embodiments, the compositions of the invention comprise one or more bacterial strains of the species *Enterococcus faecium* and do not contain bacteria from any other genus, or which comprise only de minimis or biologically irrelevant amounts of bacteria from another genus. Thus, in some embodiments, the invention provides a composition comprising one or more bacterial strains of the species *Enterococcus faecium*, which does not contain bacteria from any other genus or which comprises only de minimis or biologically irrelevant amounts of bacteria from another genus, for use in therapy.

In some embodiments, the compositions of the invention comprise one or more bacterial strains of the species *Enterococcus faecium* and do not contain bacteria from any other *Enterococcus* species, or which comprise only de minimis or biologically irrelevant amounts of bacteria from another *Enterococcus* species. Thus, in some embodiments, the invention provides a composition comprising one or more bacterial strains of the species *Enterococcus faecium*, which does not contain bacteria from any other *Enterococcus* species or which comprises only de minimis or biologically irrelevant amounts of bacteria from another *Enterococcus* species, for use in therapy. In some embodiments, the composition consists essentially of *Enterococcus faecium*.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism.

In some embodiments, the invention provides a composition comprising a single bacterial strain of the species *Enterococcus faecium*, which does not contain bacteria from any other strains or which comprises only de minimis or biologically irrelevant amounts of bacteria from another strain for use in therapy.

In some embodiments, the compositions of the invention comprise more than one bacterial strain. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. The invention comprises any combination of the foregoing.

In some embodiments, the composition comprises a microbial consortium. For example, in some embodiments, the composition comprises the *Enterococcus faecium* bacterial strain as part of a microbial consortium. For example, in some embodiments, the *Enterococcus faecium* bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain of *Enterococcus faecium* in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRX010, but which is not MRX010 deposited as NCIMB 42487, or which is not a *Enterococcus faecium*.

In some embodiments, the composition of the invention does not additionally comprise *Bacillus subtilis* and/or *Bacillus coagulans*.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human adult faeces. In some embodiments in which the composition of the invention comprises more than one bacterial strain, all of the bacterial strains are obtained from human adult faeces or if other bacterial strains are present they are present only in de minimis amounts. The bacteria may have been cultured subsequent to being obtained from the human adult faeces and being used in a composition of the invention.

The compositions for use in accordance with the invention may or may not require marketing approval.

In certain embodiments, the invention provides the above pharmaceutical composition, wherein said bacterial strain is lyophilized. In certain embodiments, the invention provides the above pharmaceutical composition, wherein said bacterial strain is spray dried. In certain embodiments, the invention provides the above pharmaceutical composition, wherein the bacterial strain is lyophilized or spray dried and wherein it is live. In certain embodiments, the invention provides the above pharmaceutical composition, wherein the bacterial strain is lyophilized or spray dried and wherein it is viable. In certain embodiments, the invention provides the above pharmaceutical composition, wherein the bacterial strain is lyophilized or spray dried and wherein it is capable of at least partially or totally colonizing the intestine. In certain embodiments, the invention provides the above pharmaceutical composition, wherein the bacterial strain is lyophilized or spray dried and wherein it is viable and capable of at least partially or totally colonizing the intestine.

In some cases, the lyophilized or spray dried bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is selected from the group consisting of uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection.

In certain embodiments, the invention provides pharmaceutical composition comprising: a bacterial strain as used in the invention; and a pharmaceutically acceptable excipient, carrier or diluent; wherein the bacterial strain is in an amount sufficient to treat or prevent a disease or condition mediated by IL-17 or the Th17 pathway. In preferred embodiments, said disease or condition is selected from the group consisting of uveitis; cancer, such as breast cancer, lung cancer, liver cancer, colon cancer, or ovarian cancer; multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); scleritis; vasculitis; Behcet's disease; atherosclerosis; atopic dermatitis; emphysema; periodontitis; allergic rhinitis; and allograft rejection.

In certain embodiments, the invention provides the above pharmaceutical composition, wherein the amount of the bacterial strain is from about $1 \times 10^3$ to about $1 \times 10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein when the composition is stored in a sealed container at about 4.0 or about 25.0 and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [59]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strains for use in the present invention can be cultured using standard microbiology techniques as detailed in, for example, references [60-62].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4.7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing diseases or conditions mediated by IL-17 or the Th17 pathway. This is likely to be a result of the effect that the bacterial strains of the invention have on the host immune system. Therefore, the compositions of the invention may also be useful for preventing diseases or conditions mediated by IL-17 or the Th17 pathway, when administered as vaccine compositions. In certain such embodiments, the bacterial strains of the invention are viable. In certain such embodiments, the bacterial strains of the invention are capable of at least partially or totally colonizing the intestine. In certain such embodiments, the bacterial strains of the invention are viable and capable of at least partially or totally colonizing the intestine. In other certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [63] and [64-70], etc.

A subject treated by a method described herein, or by contact with or administration of a composition described herein can be a mammalian subject who can be a human subject, a non-human primate, a canine mammal, a felid mammal or any other mammal. A subject maybe a patient who is a mammalian patient for instance, a human patient, a non-human primate, a canine mammal, a felid mammal or any other mammalian patient.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref [71]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref [72].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in a Mouse Model of Uveitis

Summary

This study used a mouse model of interphotoreceptor retinoid-binding protein (IRBP)-induced uveitis to test the effects of bacterial administration on uveitis. Uveitis is a sight-threatening condition resulting from intraocular inflammation and retinal tissue destruction. This disease can be studied in rodents in a model of experimental autoimmune uveoretinitis (EAU) [73]. EAU is an organ-specific disorder where Th1/Th17 cells are directed toward retinal antigens and produce cytokines that activate resident and infiltrating mononuclear cells leading to tissue destruction. EAU can be induced in mice by challenge with retinal antigens including interphotoreceptor retinoid binding protein peptide (IRBPp). Disease onset normally occurs from day 8-9 and peaks after days 14-15. Signs of clinical disease can be monitored using topical endoscopic fundal imaging (TEFI).

Strain

MRX010: *Enterococcus faecium*, bacteria deposited under accession number NCIMB 42487.

Biotherapeutic was provided in glycerol stock. Microbiological growth media (YCFA) was used for the culture of the agent.

Mice

The mice were strain C57BL/6 and were over 6 weeks old at the beginning of the study. 72 mice were used (+36 Satellite animals). Unhealthy animals were excluded from the study. Animals were housed in specific pathogen free (spf) conditions, in a thermostatically monitored holding room (22±4° C.). Animals were allowed to acclimatize under standard animal house conditions for a minimum of one week prior to use. The health status of the animals was monitored throughout this period and the suitability of each animal for experimental use was assessed prior to study start. Mice were housed in groups of up to 10 animals per cage for the duration of the study. Irradiated pellet diet (Lab diet, EU Rodent diet 22%, 5LF5) and water were available ad libitum throughout the acclimatization and study periods. It is unlikely that any constituent of the diet or water interfered with the study.

Experimental Outline

Adult female C57BL/6 mice were randomly allocated to experimental groups and allowed to acclimatize for one week. Treatments were administered according to the schedule below. On Day 0, animals were administered with an emulsion containing 200 μg of interphotoreceptor retinoid binding protein peptide 1-20 (IRBP p1-20) in complete Freund's adjuvant (CFA) supplemented with 2.5 mg/ml *Mycobacterium Tuberculosis* H37 Ra by subcutaneous injection. Also on Day 0, animals were administered with 1.5 μg *Bordetella Pertussis* toxin by intra-peritoneal injection. From Day −14, animals are weighed three times per week. From Day −1 until the end of the experiment on Day 42, animals are monitored twice per week for clinical signs of uveitis using topical endoscopic fundal imaging (TEFI).

Administration Schedule

All Groups are n=12

Vehicle for oral administration is YCFA medium.

Administration volume for twice daily oral administration is 5 ml/kg.

| Group | Treatment | Dose | Route | Frequency | Disease Induction |
|---|---|---|---|---|---|
| 1 | Vehicle | 5 ml/kg | PO | BID Day −14-End | Day 0: IRBP/CFA, SC |
| 2 | MRX010 | 5 ml/kg | | | Day 0: PTx, IP |

PO: oral administration,
BID: twice daily,
SC: subcutaneous injection,
IP: intra-peritoneal injection,
IRBP: interphotoreceptor binding protein,
CFA: complete Freund's adjuvant,
PTx: Pertussis toxin A positive control group was also tested using treatment with the drug cyclosporin A.

Readouts

Bodyweights.

From Day −14, animals are weighed three times a week. Animals with a bodyweight loss equal to or greater than 15% of their initial (Day 0) bodyweight on two consecutive occasions are culled.

Non-Specific Clinical Observations.

From Day −14 until the end of the experiment, animals are checked daily for non-specific clinical signs to include abnormal posture (hunched), abnormal coat condition (piloerection) and abnormal activity levels (reduced or increased activity).

Clinical Scores: Retinal Imaging by Topical Endoscopic Fundal Imaging (TEFI).

From Day −1 until the end of the experiment, animals are scored twice per week for clinical signs of uveitis. Retinal images are captured using TEFI in non-anaesthetized but restrained animals following pupil dilatation using Tropicamide 1% then Phenylephrine hydrochloride 2.5%. Retinal images are scores using the following system. The maximum cumulative score is 20.

| Score | Optic disc Inflammation | Retinal vessels | Retinal tissue Infiltration | Structural damage |
|---|---|---|---|---|
| 1 | Minimal | 1-4 mild cuffings | 1-4 small lesions or 1 linear lesion | Retinal lesions or atrophy involving ¼ to ¾ of retinal area |
| 2 | Mild | >4 mild cuffings or 1-3 moderate cuffings | 5-10 small lesions or 2-3 linear lesions | Panretinal atrophy with multiple small lesions (scars) or ≤3 linear lesions (scars) |
| 3 | Moderate | >3 moderate cuffings | >10 small lesions or >3 linear lesions | Panretinal atrophy with >3 linear lesions or confluent lesions (scars) |
| 4 | Severe | >1 severe cuffings | Linear lesion confluent | Retinal detachment with folding |
| 5 | Not visible (white-out or severe detachment) | | | |

Results

Figure 2:
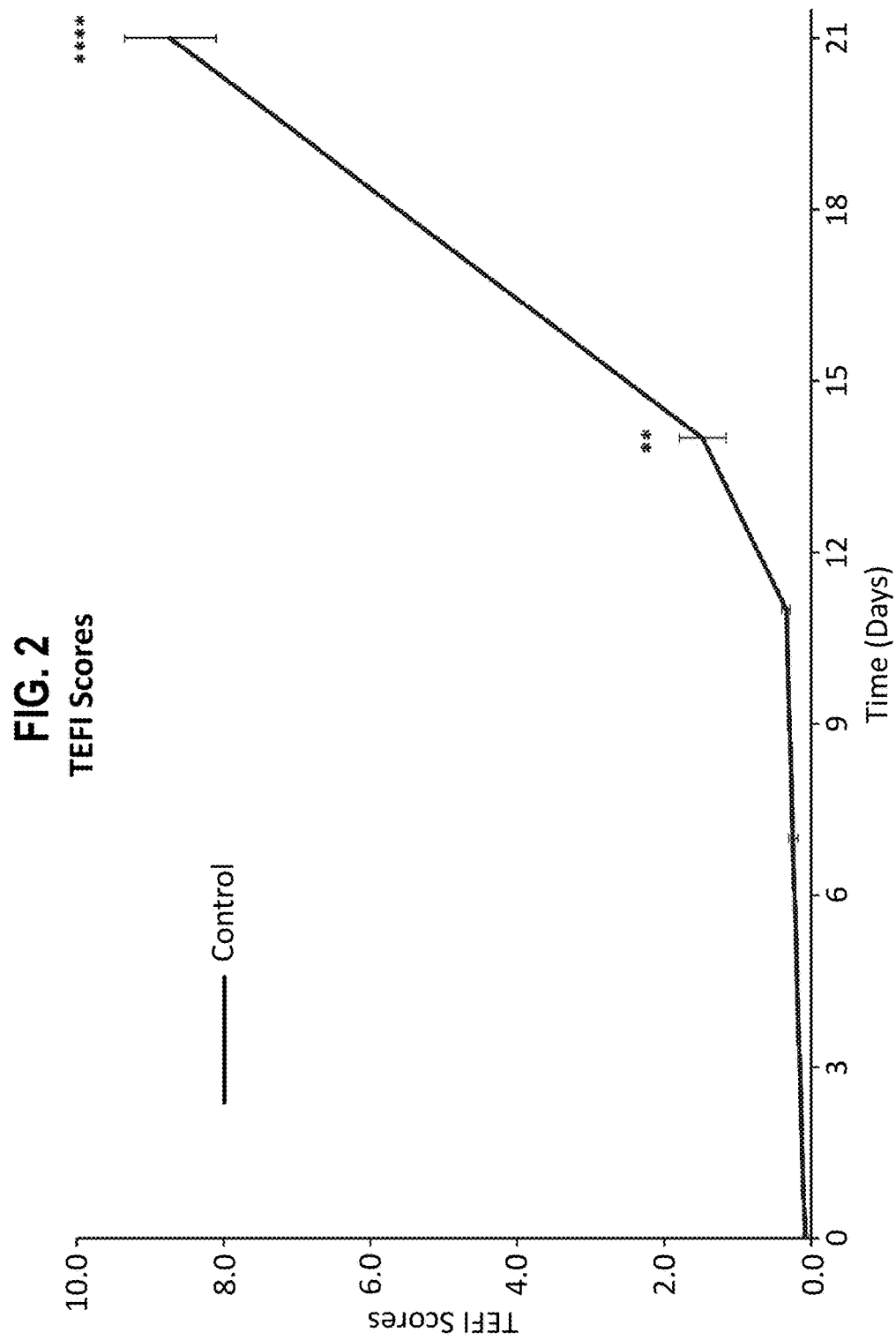
FIG. 2: Mouse model of uveitis—TEFI Scores in the control group. Data are presented as Mean±SEM.
Figure 3:
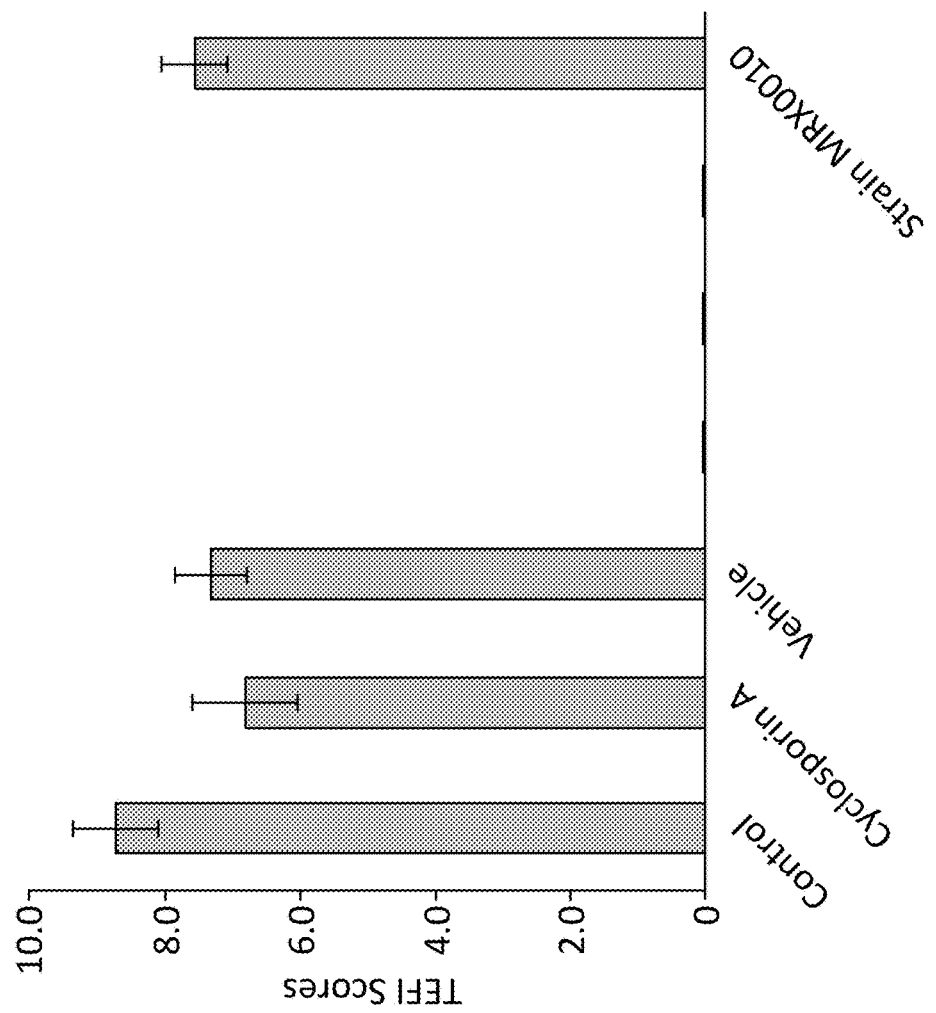
FIG. 3: Mouse model of uveitis—TEFI Scores on Day 21. Data are presented as Mean±SEM.

The results of the study are shown in FIGS. 1-3.

Cell Proliferation (Satellite Animals, Day 21).

Draining lymph nodes (DLN) were removed and cells were isolated. After counting, cells were cultured for 72 h in the presence or absence of IRBP peptide. Supernatants for cytokine analysis were removed prior to pulsing with 3H-Thymidine. Cells were then cultured for a further 18 h prior to harvesting and determination of proliferation by incorporation of 3H-thymidine using a beta-counter.

The groups showed cell proliferation to IRBP stimulus above that seen in the media control wells (these background values were subtracted from the IRBP result to provide data as Δcpm). Both groups gave strong proliferative responses to a positive control stimulus (anti-CD3/CD28) showing cells in culture were viable and able to proliferate (data not shown).

Proliferative responses to IRBP peptide were analyzed by one-way ANOVA followed by Dunnett's post-test for comparison of stimulated responses in the experimental group with the control group.

Proliferative responses to IRBP peptide in disease control animals were of the magnitude expected for this model. The positive control drug, Cyclosporin A, reduced proliferation, although this reduction did not achieve statistical significance (FIG. 1).

The treatment groups (including vehicle alone) showed non-significantly increased proliferation above that seen in control animals.

Proliferative responses to IRBP peptide were analyzed by one-way ANOVA followed by Dunnett's post-test for comparison of stimulated responses in treatment groups with the vehicle group. No statistical differences were seen.

Clinical Scores: Retinal Imaging by Topical Endoscopic Fundal Imaging (TEFI).

TEFI scores data measured in the Control group from Day 0 until Day 21 were analyzed by Kruskal-Wallis test for non-parametric data followed by Dunn's post-test for multiple comparisons between experimental days.

IRBP administration induced a significant increase in the TEFI scores measured from Day 14 (p<0.01) and on Day 21 (p<0.0001) when compared to Day 0 in the Control group (FIG. 2).

TEFI scores data measured in all experimental groups on Day 21 were analyzed by Kruskal-Wallis test for non-parametric data followed by Dunn's post-test for multiple comparisons between experimental groups.

At this stage in the experiment, there was no significant difference between experimental groups, but TEFI scores were lower in the MRX010 treated group than in the negative control group. Indeed, TEFI scores in the MRX010 treated group were comparable to the positive control, cyclosporin A treated group.

Conclusions.

Proliferative responses to IRBP peptide were seen in lymph node cultures from all experimental groups, excluding naïve animals, indicating successful disease induction. Clinical scores determined by TEFI increased from Day 14, as expected in this model of IRBP-induced uveitis. By Day 21, significant differences between experimental groups are not yet visible, but a striking reduction in disease incidence and disease severity was observed in the MRX010 treated group, which was a comparable reduction to that seen for the positive control group. In particular, these data indicate that treatment with the strain MRX010 reduced retinal damage, optic disc inflammation and/or retinal tissue infiltration by inflammatory cells (see TEFI retinal image scoring system above). These data indicate the strain MRX010 may be useful for treating or preventing uveitis.

Example 2—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Example 3—Characterization of Enzymatic Activity

Summary

The Analytical Profile Index (API®) test system consists of strips that contain miniaturized biochemical tests that assay for enzymatic activity in bacterial species. MRX010 (the bacterium deposited under accession number NCIMB 42487) was characterized using Rapid ID 32A—This system is designed specifically for anaerobic species and encompasses tests for carbohydrate, amino acid and nitrate metabolism as well as alkaline phosphatase activity.

Rapid ID 32A testing was carried out on bacterial colonies as per manufacturer's instructions. Briefly, bacteria were cultured on YCFA agar for 24 hours at 37° C. in an anaerobic workstation. Colonies were removed from plates using a sterile 5 μl inoculating loop and resuspended in a 2 ml ampoule of API® Suspension Medium until a density roughly equivalent to that of McFarland standard No. 4 was achieved. Fifty-five microliters of bacterial suspension was added to each cupule on a Rapid ID 32A strip, and the urease test was overlayed with two drops of mineral oil. Strips were covered with a plastic lid and incubated aerobically at 37° C. for 4 hours, following which the bottom row of cupules were developed using the following reagents: NIT: 1 drop each of NIT1 and NIT2; IND: 1 drop of James reagent; all remaining cupules: 1 drop of FastBlue reagent. Strips were incubated at room temperature for 5 minutes, following which the color of each cupule was recorded and assigned a value of negative, intermediate positive or positive.

Results

The results of the Rapid ID 32A analysis are shown in FIG. 4. MRX010 tested positive for arginine dihydrolase, β-glucosidase, mannose fermentation, glutamic acid decarboxylase, arginine arylamidase, phenylalanine arylamidase, leucine arylamidase, pyroglutamic acid arylamidase, tyrosine arylamidase, glycine arylamidase, histidine arylamidase and serine arylamidase. MRX010 showed an intermediate reaction for N-acetyl-β-glucosaminidase.

SEQUENCES

SEQ ID NO: 1 (*Enterococcus faecium* 16S rRNA gene, strain LMG 11423 - AJ301830)

```
   1 agagtttgat cctggctcag gacgaacgct ggcggcgtgc ctatacatgc aagtcgaacg
  61 cttcttttc  caccggagct tgctccaccg gaaaaagagg agtggcgaac gggtgagtaa
 121 cacgtgggta acctgcccat cagaaaggga taacacttgg aaacaggtgc taataccgta
 181 taacaaatca aaaccgcatg gttttgattt gaaaggcgct ttcgggtgtc gctgatggat
 241 ggacccgcgg tgcattagct agttggtgag gtaacggctc accaaggcca cgatgcatag
 301 ccgcacctga gagggtgatc ggccacattg ggactgagac acggcccaaa ctctacggga
 361 ggcagcagta gggaatcttc ggcaatggac gaaagtctga ccgagcaacg ccgcgtgagt
 421 gaagaaggtt ttcggatcgt aaaactctgt tgttagagaa gaacaaggat gagagtaact
 481 gttcatccct tgacggtatc taaccagaaa gccacggcta actacgtgcc agcagccgcg
 541 gtaatacgta ggtggcaagc gttgtccgga tttattgggc gtaaagcgag cgcaggcggt
 601 tcttaagtct gatgtgaaag cccccggctc aaccggggag ggtcattgga aactgggaga
 661 cttgagtgca gaagaggaga gtggaattcc atgtgtagcg gtgaaatgcg tagatatatg
 721 gaggaacacc agtggcgaag gcggctctct ggtctgtaac tgacgctgag gctcgaaagc
 781 gtggggagca aacaggatta gataccctgg tagtccacgc cgtaaacgat gagtgctaag
 841 tgttggaggg tttccgccct tcagtgctgc agctaacgca ttaagcactc cgcctgggga
 901 gtacgaccgc aaggttgaaa ctcaaaggaa ttgacggggg cccgcacaag cggtggagca
 961 tgtggtttaa ttcgaagcaa cacgaagaac cttaccaggt cttgacatcc tttgaccact
1021 ctagagatag agcttcccct tcggggcaa  agtgacaggt ggtgcatggt tgtcgtcagc
1081 tcgtgtcgtg agatgttggg ttaagtcccg caacgagcgc aacccttatt gttagttgcc
1141 atcattcagt tgggcactct agcaagactg ccggtgacaa accggaggaa ggtgggatg
1201 acgtcaaatc atcatgcccc ttatgacctg ggctacacac gtgctacaat gggaagtaca
1261 acgagttgcg aagtcgcgag gctaagctaa tctcttaaag cttctctcag ttcggattgc
1321 aggctgcaac tcgcctgcat gaagccggaa tcgctagtaa tcgcggatca gcacgccgcg
1381 tgaatacgtt cccgggcctt gtacacaccg cccgtcacac cacgagagtt tgtaacaccc
```

SEQUENCES

```
1441 gaagtcggtg aggtaacctt ttggagccag ccgcctaagg tgggatagat gattggggtg
1501 aagtcgtaac aaggtagccg tatctgaagg tgcggctgga tcacctcctt tctaaggaat
1561 attacggata ctacacactt tttttttact tttttcattt tgaatttact ctcaaacact
1621 gttcattgac actgcatatc tgaagtat
```

SEQ ID NO: 2 (consensus 16S rRNA sequence for *Enterococcus faecium* strain MRX010)
```
TTAGGCGGCTGGCTCCAAAAGGTTACCTCACCGACTTCGGGTGTTACAAACTCTCGT
GGTGTGACGGGCGGTGTGTACAAGGCCCGGGAACGTATTCACCGCGGCGTGCTGAT
CCGCGATTACTAGCGATTCCGGCTTCATGCAGGCGAGTTGCAGCCTGCAATCCGAAC
TGAGAGAAGCTTTAAGAGATTAGCTTAGCCTCGCGACTTCGCAACTCGTTGTACTTC
CCATTGTAGCACGTGTGTAGCCCAGGTCATAAGGGGCATGATGATTTGACGTCATCC
CCACCTTCCTCCGGTTTGTCACCGGCAGTCTTGCTAGAGTGCCCAACTGAATGATGG
CAACTAACAATAAGGGTTGCGCTCGTTGCGGGACTTAACCCAACATCTCACGACAC
GAGCTGACGACAACCATGCACCACCTGTCACTTTGCCCCCGAAGGGGAAGCTCTATC
TCTAGAGTGGTCAAAGGATGTCAAGACCTGGTAAGGTTCTTCGCGTTGCTTCGAATT
AAACCACATGCTCCACCGCTTGTGCGGGCCCCCGTCAATTCCTTTGAGTTTCAACCTT
GCGGTCGTACTCCCCAGGCGGAGTGCTTAATGCGTTAGCTGCAGCACTGAAGGGCG
GAAACCCTCCAACACTTAGCACTCATCGTTTACGGCGTGGACTACCAGGGTATCTAA
TCCTGTTTGCTCCCCACGCTTTCGAGCCTCAGCGTCAGTTACAGACCAGAGAGCCGC
CTTCGCCACTGGTGTTCCTCCATATATCTACGCATTTCACCGCTACACATGGAATTCC
ACTCTCCTCTTCTGCACTCAAGTCTCCCAGTTTCCAATGACCCTCCCCGGTTGAGCCG
GGGGCTTTCACATCAGACTTAAGAAACCGCCTGCGCTCGCTTTACGCCCAATAAATC
CGGACAACGCTTGCCACCTACGTATTACCGCGGCTGCTGGCACGTAGTTAGCCGTGG
CTTTCTGGTTAGATACCGTCAAGGGATGAACAGTTACTCTCATCCTTGTTCTTCTCTA
ACAACAGAGTTTTACGATCCGAAAACCTTCTTCACTCACGCGGCGTTGCTCGGTCAG
ACTTTCGTCCATTGCCGAAGATTCCCTACTGCTGCCTCCCGTAGGAGTTTGGGCCGT
GTCTCAGTCCCAATGTGGCCGATCACCCTCTCAGGTCGGCTATGCATCGTGGCCTTG
GTGAGCCGTTACCTCACCAACTAGCTAATGCACCGCGGGTCCATCCATCAGCGACAC
CCGAAAGCGCCTTTCAAATCAAAACCATGCGGTTTTGATTGTTATACGGTATTAGCA
CCTGTTTCCAAGTGTTATCCCCTTCTGATGGGCAGGTTACCCACGTGTTACTCACCCG
TTCGCCACTCCTCTTTTTCCGGTGGAGCAAGCTCCGGTGGAAAAAGAAGCGTTCGAC
TGCA
```

SEQ ID NO: 3 (chromosome sequence of *Enterococcus faecium* strain DO) - see electronic sequence listing.

SEQ ID NO: 4 (plasmid 1 sequence of *Enterococcus faecium* strain DO) - see electronic sequence listing.

SEQ ID NO: 5 (plasmid 2 sequence of *Enterococcus faecium* strain DO) - see electronic sequence listing.

SEQ ID NO: 6 (plasmid 3 sequence of *Enterococcus faecium* sirain DO) - see electronic sequence listing.

REFERENCES

[1] Spor et al. (2011) *Nat Rev Microbiol.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] Schleifer and Kilpper-Bälz (1984) *Int J Syst Evol Microbiol.* 34: 31-34.
[17] Ispirli et al. (2015) *Can J Microbiol.* 61(11):861-70.
[18] Divyashri et al. (2015) *J Med Microbiol.* doi: 10.1099/jmm.0.000184.
[19] Lauková et al. (2105) *Folia Microbiol (Praha).* September 9.
[20] Büsing and Zeyner (2015) *Benef Microbes.* 6(1):41-4.
[21] Schmitz et al. (2015) *J Vet Intern Med.* 29(2):533-43.
[22] Mansour et al. (2014) *Microbiol Immunol.* 58(10):559-69.
[23] Masco et al. (2003) *Systematic and Applied Microbiology,* 26:557-563.
[24] Srůková et al. (2011) *J. Microbiol. Methods,* 87(1):10-6.
[25] Ye et al. (2015) *PLoS One.* 10(1):e0117704.
[26] Fabro et al. (2015) *Immunobiology.* 220(1):124-35.
[27] Yin et al. (2014) *Immunogenetics.* 66(3):215-8.
[28] Cheluvappa et al. (2014) *Clin Exp Immunol.* 175(2):316-22.
[29] Schieck et al. (2014) *J Allergy Clin Immunol.* 133(3):888-91.
[30] Balato et al. (2014) *J Eur Acad Dermatol Venereol.* 28(8):1016-24.
[31] Monteleone et al. (2011) *BMC Medicine.* 2011, 9:122.
[32] Zhang (2015) *Inflammation.* August 23.
[33] Sun et al. (2015) *Cytokine.* 74(1):76-80.
[34] Mucientes et al. (2015) *Br J Ophthalmol.* 99(4):566-70.
[35] Jawad et al. (2013) *Ocul Immunol Inflamm.* 21(6):434-9.
[36] Maya et al. (2014) *J. Ophthalmology.* 310329
[37] Chi et al. (2007) *J. Allergy and Clinical Immunology.* 119(5):1218-1224.

[38] Chi et al. (2008) *Investigative Ophthalmology & Visual Science.* 49(7): 3058-3064.
[39] Luger and Caspi (2008) *Semin. Immunopathol.* 30(2): 134-143.
[40] Numasaki et al. (2003) *Blood.* 101:2620-2627.
[41] Zhang et al. (2008) *Biochem. Biophys. Res. Commun.* 374: 533-537.
[42] Karin (2006) *Nature.* 441: 431-436.
[43] Faghih et al. (2013). *Iranian Journal of Immunology.* 10(4):193-204.
[44] Numasaki et al. (2005) *J. Immunol.* 175: 6177-6189
[45] Hammerich and Tacke (2014) *Clin Exp Gastroenterol.* 7:297-306.
[46] Fahy (2009) *Proc Am Thorac Soc* 6.256-259
[47] Miossec and Kolls (2012) *Nat Rev Drug Discov.* 11(10):763-76.
[48] Yang et al. (2014) *Trends Pharmacol Sci.* 35(10):493-500.
[49] Koenders et al. (2006) *J. Immunol.* 176:6262-6269.
[50] Amedei et al. (2012) *Int J Mol Sci.* 13(10):13438-60.
[51] Shabgah et al. (2014) *Postepy. Dermatol. Alergol.* 31(4):256-61.
[52] Miyamoto-Shinohara et al. (2008) *J. Gen. Appl. Microbiol.,* 54, 9-24.
[53] Cryopreservation and Freeze-Drying Protocols, ed. by Day and McLellan, Humana Press.
[54] Leslie et al. (1995) *Appl. Environ. Microbiol.* 61, 3592-3597.
[55] Mitropoulou et al. (2013) *J Nutr Metab.* (2013) 716861.
[56] Kailasapathy et al. (2002) *Curr Issues Intest Microbiol.* 3(2):39-48.
[57] Handbook of Pharmaceutical Excipients, 2nd Edition, (1994), Edited by A Wade and P J Weller
[58] Remington's Pharmaceutical Sciences, Mack Publishing Co. (A. R. Gennaro edit. 1985)
[59] US 2016/0067188
[60] *Handbook of Microbiological Media, Fourth Edition* (2010) Ronald Atlas, CRC Press.
[61] *Maintaining Cultures for Biotechnology and Industry* (1996) Jennie C. Hunter-Cevera, Academic Press
[62] Strobel (2009) *Methods Mol Biol.* 581:247-61.
[63] Gennaro (2000) *Remington: The Science and Practice of Pharmacy.* 20th edition, ISBN: 0683306472.
[64] *Molecular Biology Techniques: An Intensive Laboratory Course,* (Ream et al., eds., 1998, Academic Press).
[65] *Methods In Enzymology* (S. Colowick and N. Kaplan, eds., Academic Press, Inc.)
[66] *Handbook of Experimental Immunology,* Vols. I-IV (D. M. Weir and C. C. Blackwell, eds, 1986, Blackwell Scientific Publications)
[67] Sambrook et al. (2001) *Molecular Cloning: A Laboratory Manual,* 3rd edition (Cold Spring Harbor Laboratory Press).
[68] *Handbook of Surface and Colloidal Chemistry* (Birdi, K. S. ed., CRC Press, 1997)
[69] Ausubel et al. (eds) (2002) *Short protocols in molecular biology,* 5th edition (Current Protocols).
[70] *PCR (Introduction to Biotechniques Series),* 2nd ed. (Newton & Graham eds., 1997, Springer Verlag)
[71] *Current Protocols in Molecular Biology* (F. M. Ausubel et al., eds., 1987) Supplement 30
[72] Smith & Waterman (1981) *Adv. Appl. Math.* 2: 482-489.
[73] Caspi (2003) *Curr Protoc Immunol.* Chapter 15: Unit 15.6.

SEQUENCE LISTING (6 sequences)

SEQ ID NO: 1 - DNA, 1651 bp, Enterococcus faecium
agagtttgatcctggctcaggacgaacgctggcggcgtgcctatacatgcaagtcgaacgcttctttttccaccggagcttgctccaccggaaaaagaggagtggcgaacgggtgagtaacacgtgggtaacctgcccatcagaaagggataacacttggaaacaggtgctaataccgtataacaaatcaaaaccgcatggttttgatttgaaaggcgctttcgggtgtcgctgatggatggacccgcggtgcattagctagttggtgaggtaacggctcaccaaggccacgatgcatagccgcacctgagagggtgatcggccacattgggactgagacacggcccaaactctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacacgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcgtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatctgaaggtgcggctggatcacctcctttctaaggaatattacggatactacacactttttttttacttttttcattttgaatttactctcaaacacttttgttcattgacactgcatatctgaagtat

SEQ ID NO: 2 - DNA, 1431 bp, Enterococcus faecium
ttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgcatcgtggccttggtgagccgttacctcaccaactagctaatgcaccgcgggtccatccatcagcgacacccgaaagcgcctttcaaatcaaaaccatgcggttttgattgttatacggtattagcacctgtttccaagtgttatccccttctgatgggcaggttacccacgtgttactcacccgttcgccactcctctttttccggtggagcaagctccggtggaaaaagaagcgttcgactgca

SEQ ID NO: 3 - DNA, 2698137 bp, Enterococcus faecium (residues 1-1,349,069 of 2,698,137)
tggaaaactattgaaaaaaatgctaaattagtactagttattcactttttaatgaaggaggaggccttatatggtatccctcgatgctttatggaatgaattaaaagcaacataccaaaaggatttatcgcctgctagctataatacatggatcgaaacagcgaaccctcgaacccttgatcaaaaccagctcgttgttgaggttcctagcaagattcataaagaatattgggaaaaaaacctggcgacaaaaatcgttgaagtcggttatatgttatcaggaaatgagattatccctcgctttattactggcgaagaagcagagcaagaagaagttatagaagaaaaaaatccaaaagttgtggcacctagtccgctaaaaaaagccatgctgaaccctaaatatacctttgatacgtttgtcattggtaaaggaaaccagatggctcatgcagcagcgctcgttgtagcagaagatccaggttctatttataacccgctcttcttttatggaggcgtgggacttggtaagactcacttgatgcatgcaattggtcatcaaatgctgcaaagtcagcctaatgccaaagtaaaatatgtaagcagtgaaacttttgctaatgatttcatcaattcgatccaaaacaaaacagcagaagagttccgtcaagaatatcgaaatgttgatttactgctagtggatgacattcaattttttgcagaaaaagaagctacgcaagaagagtttttccatactttcaatgccttgtacaatgaagggaaacaaatcgtactaaccagtgatcggttgccaaacgagattccgaaactgcaagaacgccttgtttctcgctttgcatgggggctgtctgttgatattacaccgccggatcttgaaacaagaacagcgattttacgtaaaaaagcggcggctgaacgtctagagatcccagatgacacactaagctacatcgcaggacaaattgattctaacattcgtgaattagaaggtgcgcttgttcgagtgcaagcttttgctgcgatgaatagtgaagatatttcgactagtctagctgcagacgcactgaaaacgttaaaatcaggaaaaggacatcctcaattgtcaatcctgcagatccaagaagaagtggcaaagtattatcacatccaattgaaagatctcaaaggaaagaaacgcgtcaaatctattgttgttcctagacaaatcgctatgtatttggcacgtgagctcacagataattctttaccgaaaatcggagctgaattcggtggcaaggatcatacaacggttatccatgctcatgaaaaaatccagcagctgatggattctagtgtcagtatgcaaaatgaagtatcagaaatcaaaaactttttactaaattaatttgtcgattctatcaactgaaaatagcatgtggataaaagaaaaaaacgttcaaaagttatacacactttttccacagctgttttttcgtttctctcttacgttttttgagttttccacagaatcaacatgccctattacttttattattctttttaactaataataaataaacaaacattcaaaggagatacatcatgaaagttactttaaaccgagctagctttatgcaggaattgcaaactgttcaacgagctatttcaagcaaaaccacgatccctattttgacaggtgtaaaaatcacactgacacaagaaggtttgactttgacggggagcaacgctgatatatcaattgaaacttttttgtctgttgaaaacgaaaaagcaaatatgcaaatcgaatctactggttccattgttttacaagcacgtttctttagcgaaatcattcggagacttcctgaagaaacatttactttagaagttttagaaaataaacaagtagcgatcacttctggaaaagcgaattttatcgtaaatggattagatgcagataactatcctcatcttcctgttgtcgaaagccataaccagatgaaattacctgtacacgtattgactaaactaatcaacgaaacagtttttgctgtctcacaacatgagagtcgtccaatcttgacaggtgtgcatttcattttatctgataattctttattagctgtagctactgattctcaccgtctaagtcaacgcgtgattccagtagaacaagcggctgatcattttgatattgttattcctggaaaaagtttgatcgaattatctcgctcattaacaaatgaagaagaaatcgtcgaaatcagcattatggaaaaccaagtgttgttcaaaacagaaacgatgtatttctattcccgtttgctagaaggaaactatccagataccaatcgtttgattccttcaagttttaatacagaggttgaattttctgttcctagctttttagcggcgatcgaacgggcttctttactttctcatgaaggccgtaacaacatcgttcgtttatctattcgtccagatgcggttgttttatacggaaattcgccagaaatcgggaaagtagaagaaagcttgagttatacagcaagcagtggcgatccattagatatttctttcaatccggattatatgaaagcagcgttgcgtgcatttggagatatgagcatcaaagtgaaatttatctctgctattcgtccatttacattggaaccaacggaagatggcgttcaatttattcagctgattactcctgtacgtacaaattaacaatgattttcaatgttcttgaaaatttaattgaaaagaaatagaaaaaataaaattttaaacagaaggccctaaaatctcttttaaggctttctgtttatttttgtttaaatcaccttttttagattaaatcgtcttatatggaaaaatatatggataaatttgttttattgcgaaaaaaaaggtataatagagtatacttttaataatgaaaatgagggatgggcattgaaacaacaagtcattctaaatacggaattcatgacgttgggccaaatgttgaaagaagtcacagttatcggtagtggcggacaagcaaaatggtatttggcagaaaacactgtgttagtcgatggcgaaccagaaaatcgtcgtggacgcaaactttatcccggcatgatggttgaagttccagaagtaggaactttttttatggtaaaaaaaggaaacgacgataatgaggctgaataagctgtatttaaaaaattatcgaaattacgaagagctgaacatcgaattttccaagaacctcgtcatctttttaggagaaaatgcgcaaggaaaaacgaatcttttggaaagtatctacgtattagctatgacgcgaagtcatcggacaagtagtgagcaggaattgattggctggactgacgatcaggcgatgattcaaggagagatcacaaaaggttcatccactcttccattagaaatcttattatctaaaaaaggccgaaaaaccaagatcaaccatatcgaacagaaaaagttaagtacttacgtgggacaaatgaatgtcattttatttgcaccagaagatctttctttagtaaaaggcagcccgcagatcaggcggaagtttttagatatggaattaggccagatcaatccaatctatctttatgatcttgtccaataccaagcaattttgaaacaaagaaaccagtacttgaagcaattgaatgaaaaaaaacaaactgatttgctttatttggatattttgtccgaacaactagcagcgtttggcagcaaagtattgaaagcaagagcacagttcgtcaagcgattggagttttgggctaattctttgcatcagcaaatcacccatcaaaaagagcagctggaaatcgagtatctcaccgcagtcgattctttagaaacacatacgcaagagcaaatccaagaacaatttctcgcacttttgaaccaaaataaaaagaaagacctttttcggggaacaacgacagttggtcctcatcgtgacgatctttccttttttattaatcagaaaaatgtgcagacttatggatcgcaaggacagcaaagaacaactgcactaagtgtcaaattagcagaaatcgatttgattaaagaagagacaggggaatatccaatccttttgttagatgatgtgatgagcgagctggatgataatcgtcaactccatctgctagaaacaatcgaaggaaaagttcaaacgttcttaacaacaacgacacttgaccatgtaaaaaataaaatgactgttgaacctgagattttttatgttcaacaagggaaactaaaaggagaagaaactgaatgacagaagaaagaagtttagtagaacgcgctaaagagtatgatgccagtcagattcaagtacttgaaggacttgaagccgttcgtaaacgacctggcatgtatatcggttcgactagttctgagggtctgcatcaccttgtttgggaaattgtcgataattcgatcgatgaagtattagcaggttttgcaacgaaaatccatgtgattattgaaaaagacaacagtatcaccgttattgacgacggtcgggggatacctgtagatatccaggcaaaaactggacgtcctgcagttgaaacggtctttactgttttacatgctggaggaaaattcggcggtggtgggtacaaagtttctggtggacttcacggagtaggatcttctgttgtaaacgcgctttctacacagcttgatgtcaaagtatacaaagaaggaaatgtgtactatcaagaatatcgtcgtggagctgtagtggacgacttaaagattatcgaacaaacggatcgccatggaacaacggttcactttacgccagaccctgaaatttttacagagacaactgagtttgatttttcaaaattggctacccggatccgtgaacttgctttcttgaaccgcgggatgcgtatatcgattgaagacaaacgagaagaagaaccagtcatcaatgaataccattatgacggcgggatcaaaagttatgtcgaatacttgaatgcaaacaaaaccgtgatttttccagaacctgtatatttggaaggtgaacagcaagatatcgcagttgaagtctctatgcaatatacagacggctaccattccaatatcatgagttttgccaacaatatccatacgtatgaaggtggaacacatgaatcaggattcaagactgctttaactcgtgtgataaatgattatgcccgaaaacaaaagctgatgaaagaaaatgacgacaacttgaccggtgaagacgtgcgagaaggattgacagctgttatttctatcaagcatcctgaccctcaattcgaaggacaaacaaaaacaaaattgggcaattccgaagtacggacagtcactgatcggttatttagcgaacatttcatgaaattcttgctggaaaacccaagtgtgggccggcaaattgttgaaaaaggattactagcttccagagctcgtctagcagcgaaacgtgcgcgtgaagtaacgagacgtaaaggtgctttagagattagtaatctgccaggaaaattagcggactgctctagcaacgatcctgaaaaatgcgaattgttcatcgtcgaaggagattcggccggcggatcagctaagcaaggtcgtaatcgagagtttcaagccatcttgcctattcgtgggaaaatcttgaatgttgaaaaagcaagcatggacaagatcttggcaaatgaagagatccggtctttatttactgctatgggtacagggtttggagaagattttgatgtatcgaaagctcgctaccacaaattagttatcatgactgatgccgatgtcgacggcgcgcatatccgtacattgctgctgactcttttttatcgttacatgcgtcctattgttgaagctggatacgtctatattgctcagccacctttatacggggtaaaacaagggaagaatattacgtatgtacaaccaggaaaaaatgcagaagaagagttgaaacaagtcgttgcttcacttcctgcctcaccaaaaccaagcgttcagcgttataaaggacttggagaaatggatgatcatcaactatgggaaacaactatggacccaagcaatcggatgatggcccgcgtcagtgtggacgatgctattgcagcagatcagatatttgaaatgttgatgggggatcgagtagaaccccgtcgtgcattcatcgaggaaaatgcacactatgtgaagaacttagatatttaatcatgaaggaggaaaaagaatgagtgaagaaatcagagaaaacatccatgatgtcaatctaaccagcgaaatgaaagactccttcatcgattatgcgatgagtgttattgtcgcacgtgcacttcctgatgtcagagatggtctgaaacccgttcatcgccgtattttatacggcatgaacgaattaggtgtaacaccggataaagcccataaaaaatctgccagaatcgtcggagatgtcatgggtaaataccatcctcatggagacagtgcgatctatgagtcaatggtacggatggcacagccattcagctaccgttatatgctagtggatggtcatggaaactttggttctgttgacggtgacggtgccgccgctatgcgttataccgaagcacggatgagcaaaatcgctacagaaatgctgcgtgatatcaataagaacactgttgatttccaaagcaactatgatgatacagaaaaagaaccagttgtactacctgctcgcttcccgaatcttttagtgaacggaacaacggggatcgccgtaggtatggccacgaatatcccacctcataacttgtctgaggtagtagcggctatcgatttgctgatggataatcctgatgtgacgaccaatgaattgatggaagtattacctggaccagattttccaacaggtggtttggttatggggaaatcaggaatccgaagagcgtatgaaacaggtaagggttctattaccgtacgtgcaaaagttgagattactgagatgccaaatggtaaagaacggatcatcgtgacagaattgccttatatggtcaataaagcaaaattgatcgaacggatttctgaactgcacagagacaagcgtatcgaagggatcacagatttgcgggacgaatcttcccgtgaaggtatgcggatcgtcattgacatccgtcgtgacgccagcgcatccgttatcttgaataacttatataaattgacatccttgcaaaattcatttggattcaatatgttggcgatcgaaaaaggtgtgccgaaagttttgagcttgaaacaaatccttgaaaactatatcgaacatcaacgcgaagtcatcacacgacggacggtctttgaaaaagaaaaagcagaagcaagagcacacatcttagaaggtttgcgtattgctttggatcatatcgatgaaatcattgcgattatccgcgggtctaaatcagatgacgaggcaaaagcaacaatgatcgaacggttcgatttatccgatcgccagtctcaagctattttagatatgcgtttacgccgattgaccggtttggaacgggaaaaaatcgaaaatgaataccaagaactcttaaaactgattgaagatttaactgacattctggcaagaccagaacgtgttacagaaatcatcaagaatgaattagcagacttgaatcaacgatttggtgataaacgacgcacagaattactagtcggtgaggtcttaagtctggaagatgaagatttaatcgaagaagaagaaatcgttattacattgacaaacaatggttacatcaaacgtttggcaaataatgaattcagagctcaacgaaggggtggacgtggtgtccaaggaatgggtatccacaatgacgacttcgtcaaaaatctggtttcttgttctacccatgatacattgttattctttacgaataacggaaaagtgtatcgggcaaaaggatacgaaattccagaatacgggcgtacagccaaaggaatcccaatcatcaatttactaggtatcgattcgagtgaaagcatccaggcaatcattgcggtgacgggagaagcagaagaaggccactatctcttctttacgacgcgtcaaggtacagtaaaacgtacttctgtcactgcttttgctaacatccgaagtaatggtctgatcgcaattggtttgaaagaagacgatgagctcgtcaatgtgctactgacagatggtcaatctaatatcattattggaacacataacggctactctgtcactttcaaagaagaagcagtccgcgatatgggacgtacagcttccggggtcagagggatacgcctgcgtgaggaagattatgtcgttggggcagccttaatgaaggaaaatcaagaagtattagtgatcacagaaaaaggttacggaaaacggacaaaagtatcggaatatccagtgaaaggccgcggaggtaaagggatcaaaacggcgaacatcactgaaaaaaatggtccactagctggattgaccactgtttctggagatgaagacatcatgctgattacagataaaggtgtcattatccgtttcaacgtatcgactgtttctcaaactggacgttcaacattaggcgtacgtttgatgaagatggaagctgatacgaaagttgtcacgatggcagcagtcgaaccagaagctgcagaacaaacagttgaagaacaaggatcagaagaataaccatcaagactaagtgtgtaagctagcaagaataaccgattaaaaaatctggttattcctgctggcttttttgattagttgaatttctcttaaaatattcgaaactgttcattctgtattgcttttgaccaaaatagagtgtataattagagcttgtgagtagtctaattaattagataactctccttgctcttaggaacctaagagccgaaagtccacagggaggtgaatatcaatggaaaacacgaaatatgaaatcatgtacattattcgtccaaacattgatgaagaagcaaaaactgctttaatcgaacgtttcgatgcaatcttgaaagataacggagcagaagttatcgaatcaaaagattgggaaaaacgccgtttcgcttatgaaatgaacggttaccgtgaaggtatctatcacatcgttaaagtatcttctccatcatcagcaaatgctgtcaatgaatttgaccgtcttgctaaaatcaacgacgatatcattcgtcacatgattgttaaagaagaagcttaattgttgtttcatgtgaaacaatagaaaacgatgagaggagatgactattttgattaataatgttgtattagttggacgtctgacgaaagatccagatttgcgttacacagcaagtggtacggcagtcgcaacatttactttggctgtgaatcgtaattttacaaaccaaagcggcaatcgcgaggctgattttatcaactgtgtgatttggcgcaaatcagcagaaactttagcaaactatgctcgtaaaggaacacttttaggtgttactggacgtatccaaactcgttcttatgataatcagcaaggacaacgtgtatacgtgacagaagtagtagctgacaacttccaattgctggaaagtcgttctgcatctgaaaatcgccaacaaagcggcggattccaaagttctggtcaatcagctggcggatttggcggaaacaataactctaatcaaacatctcaatcatccaacggtatgcctgatttcgaccgtgatacttctgacccattcggctcaagttcaacgatcgacatttcagacgatgatttaccattctaaacgaatttgataggagggaaatagaatggcacaacaaagaagaggcggacgtaaacgtcgtaaagtagactacattgctgctaaccatattgaatatatcgattataaagatatcgaattactaaaaagatttatttcagaacgcggtaaaatcttgccacgtcgtgtaactggtacaggcgctaaaaaccaacgtaaaattactgttgcaatcaaacgcgctcgtatcatgggcttgctacctttcgttagcgaagactaataaatcctaggaattgaatgactgatccttttgatcagctattcaattcctttttttctgtaaaaataacctctattcgtttagtcgctcgaatgacgaaagttatggtaaaatcaaattagtcatatatgggaggaaaattatggaaaataaaaacaatcatttatccccgaaacctctcttccttatcctgtttatattaatcgaagtattggtagtcttaattttaccatttcgttttgttagcgcttcggtcattctattgatgaatttatggggtgttcgctattggttgaaaatgaaacgttggcttattttaaataaacgtgaaaaaatccagcaggcttcgactgtagctgaaaccaatctagcttatgtctcagaagtcatgcctgtaggagtgattgcttatcagccatcaagccaaaaaatcgaatggctcaatccattagcattgaaaatcaaagatcaaagtggattaacagaggaagaattgctagatactttttttactgcaaaagaaaaaaagaaaaaccaagtctatctagcagataaaacatttcagtttgatatggatacagtaaagggtgttgtttattttaatgatattacccaaaaccagttgttaaaactccatcagacgaacagtcagccggtgattggtattttatctattgataactatgcagatgccattgataaattagatgacaaagagatttcttatttgaactctttcgtcactacactagtttctgactggatgaatgaataccatgtctttttcaaaagaatcaacgcagaacggtttttcttcgtagcacagatgatcgatctgaaaaagatgatggataaaaaatttgatttgctggatcgctttcgagcagaagctgaaaaacagagctcgcctatcacccttagtatggggattgcttatggctcaagaaccctcgatgaaatcggtggagaagctcagaataatttagatgttgctttagtccgtggaggcgaccaagttgtcgtgaaagaggtaaaagaaggagcaaaacctgtttattatggggggaaatctgctaagaatgtcaaacgcacgcgtgttcgttctcgagcgatgagtaccgctttgcgtcggatttttgatgaaacaggcgatgtgtttatcatggggcacaagtttccggatatggatgctttaggctctgcttttggtgtcagttgtctggcacgcttcaaccagaaaaaagcttacatcgttatcaatgagaacgagatcattccagatgtagaacggtgtcttgaagaaatccataagcatcctgaattagaaatgcaactaatctctccagaacgtgccatagagctgaaaaaagaagaggacctcctcgtgatggtggattaccataaaccttctctatcgatctctcagggcctatatgagcaatttgataagattgtgatcattgatcaccatcgtcgtggggaagagtttccaagtaaacctctgctgacttatattgaatcttcagcttcttcagcttcagagctagtttctgagctgatccaataccaaagcagcaaaacaaatcgcttagatcgttttgaggccacattattgcttgcagggatggttgtagatacaaatagtttcaatgtccgtacaactgcacgaacttttgacgttgccagctatttaaggtcttgtggagcagacgcatccttagtacaatatttattgagctcggatttagcgacatacttggagatcagcaatttgattgctggaagcgactatgtgacttctgatattgttgtggcggcagggacagacgaaaaagagtataatagtgttatagcagcaaaaacagcagatacattgctttcgatgatcaatatcaatgcagctttcgtcattacaaagcggacagacggcttgattgggatcagtgccagaagtaccggcacgatcaacgtccaaatcatcatggaatccttaggtggcggaggacacttcacaaacgcagctactcaactggaaaatacgacagttgaggaaacaaaacagaagctatttgctgcaatcaaagaaaatatgaatcaaatatatgataaggagtaatccaaatgaaagtaatttttttacaagatgtaaaaggaaaaggtaaaaaaggggacatcaaagaagttccagcaggttatgcacaaaattatctaatcaaaaataacttggcaaaagaagcaacgaaaagcagtatcagtcagttagcaggacaaaagaaagcacaagaaaaacacgaagctgaaatcttggaagaagctaaaaagttaaaagaattcttggaaaaagaagatactgtagtcgaattgaaggcgaaagcaggggaagacagccgtttgtttggttcgatcccttcaaaacaaattgctgaagggttaaacaaacaatacaaaatcaaattagataaacgaaaaatcgaattagaaaatccgatccgttcactaggctacacaaacgtacctgttaagcttcatcatgaggtgacggctacgatcaaagttcatgtcgtacaagaataacaaatcttgatagcgatgttcagctggtaagtataaccagaaggaaaaaagacaaaccgaaatttatctgagaaaacagctgcagcaatgaaagcaaaagctgcaaatcgatttcagattgatttcggtttcttttttgggaacagcaaaatagcataaagaaaacgagtataataaaagagaactatttttttattacactttcggtacgaatgatgacttttctctcattttcttgtaaaatgaagcaattgaagacaaggagcgatacgtatgaatgaagtgtggcaggatcgaatcccaccgcaaaatattgaagctgaacaagcggttttaggctctgtttttcttgacgcagaaacgatcattgatgccatggagtacatagagccaaaagacttttatcgtcgtggccatcaaattatttttgagacaatgatcgagttaaatgatcgtaatgaagcgattgacgtggttactgtcaaagaccggctggaacaagccaatttgttagaagatgccggtggtttaagttatctctcagacttggcattagcagttccgacagcagcaaatatcgtctactatgcgaaaatcgttgaagaaaaatcattgctgcgtacattgatccagacagcaacaggaatcgttacgaaaggattcgagcaaggagaagaagttcaaacaattttagatgatgccgaacgcagtatcttggaggtttcggaaaaaagaaatcgaagcggctttttatctattgctgaagtactgaactccacgattgaaaatatcgatcgactagctcaaaacaatgaagaaatcacaggtctaccaactggctatcaaggtctggataaaatgacagcaggtttccagcccgaagaactaatcattcttgctgcacgtccagcggtaggtaaaacagcgtttgcattgaatattgctcaaaatgtaggaacaaaaacagatcgttctgttgcgatatttagtttggaaatgggggcagaatctcttgtaaatcggatgctttgtgcagaaggttcgattgaggccagccatttacgtacaggtcagctttcggaagaagaatggtcgaatctgatcgttgcgatggggagtctttctcgagcaaatatttttatcgatgatacaccagggatcaaaatctctgaaatccgtgcgaaatgtcggaaactagcgcaagaaaaaggcaatctaggcttgatattgatcgattatttgcagttgattgaaggtaacggtaaagagaaccgtcaacaagaagtatcagatatctctcgccaactgaaaaaactggcgaaagagctgaaagtacctgtcattgctctttcacagttatctcgtggagtagaacagcgacaagacaaacgaccagtgctaagtgatattcgtgaatccggatcaattgaacaagatgcggacatcgtagccttcttgtatcgagatgattattatgaaagagaaggcggagatgacgatgatggaaacgagccaaaaaatgacaacgtcatcgaagtcatcatcgagaagaaccgaagcggtgcacgaggaacagttgaactactgtttatcaaagaatacaataagttttcgtcgctttcgccaagagaagaattttaaagaagaggttgtgagccttgagcaatcccgagagctctcgtaagaagatgcaaggagtaaccgcaggaacgactagagtacttaatttaaacagatctccaaagggattgtgacaaaagtcttgtcacagtccctttttccgaataaacggtgttcaatcagctgacccttggtattagctcagcaaacgtcaaaatatgaggaactattttgacgtttgtttctctaatactcagatcaaaacgctgatcttacgacctcttttccttaaacggtgttctcctgccaactcctcggtcacaagtcacaatatcatcaaacatgagaagcagttttttgaaattgctccttgtgactcagagttaaacggcaggctcacaacctctttcttaaacggtgttcaaaagcttgcatctgcggtaatacgcccaatcaaacgaaaaatatgagaagctatttttgtttggctgttcttattacttgatgcaggacagctttttcacaacctctgattcacggtgttccaaaagtagcttcttcgaaaaataagtcgaaatttcacaaaaatttgagaagcaattttcgtacattccttcttatttcttgaagctgaccacttctgttacaacctcttttttaataaccattctaaaaagataaagttcgttttttaagcgtttttataaaataaaaataaaaatcattcgattttatttgaaatatgtatctattattgatacaatggttcaggattaaataatatagaacgaggtgttcacatgtcatctgtagtagtagtaggtacgcaatggggcgatgaagggaaaggaaaaatcacagactttctcagtgaaaatgctgaagtgattgcacggtaccaaggtggcgacaatgcagggcacacaattaagtttaacggtgtgacttataaactgcatttgattccttctgggattttttataaagacaagatcagtgtgatcggaaacggcgttgtagtcaatcctaaatcattggttaaagaattagcttatttacatgaaaaaggtgtagaaacaagtaatttgcgtatttctgaccgcgcgcacgtaatcttgccttatcatatcaaattggaccaattacaagaagatgctaagggcgaaaataagattggtacaacgattaaaggaatcggacctgcctatatggataaagcagctcgtgtaggtatccgtattgcagacttattagataaagaaatttttgaagaacgtcttcgtttgaatctagatgacaaaaaccgtcaatttgtaaaaatgtttgattcagaaccacttgattttgacgatatttttgaagaatattatgaatacggacaacaaatcaaacaatacgtcacagatacttccgttatcttgaatgatgctttggatgcaggcaaacgcgtgttgtttgaaggcgcacaaggtgtaatgctggatatcgaccagggaacttatccttttgttacttcttctaacccagtagccggtggggtaacaatcggaagcggtgtagggccttcaaaaatcaataaagttgtcggcgtctgcaaagcctatacgtcacgtgtcggtgatggaccatttccaactgaattatttgatgaaacaggagaacaaatccgcgaagtaggacgagaatacggtacgacaactggtcgtccgcgtcgtgtaggctggtttgattctgtagttatgcgccattctaaacgagtttcaggtattaccaacctatctttaaactcgatcgatgtattaagtggattggaaacagtaaaaatttgtacggcttatgaattagatggcgaactaatctaccactatccagcaagcttgaaagagttgaaccgctgcaaaccaatctatgaagaattgccaggctggtcagaagacattacaggatgcaaaacacttgcagaactgccagaaaacgcacgtaactatgtacgtcgtatctcagagcttgttggtgtacgtatctcaacattttctgtcggacctgatagaacacaaacaaacatcttagaaagcgtctgggcgcaaatctaaggataaaaacgacgactgaatcaggacgttcttaccagagcgagtcgaagtgtttatctatacgataataataacttgaagaggtagtgaaagagacgtttagccttattgccgataggctgtctcttgaacactgtttattcagaataagggactgtgacaaaaaccgtgtcacagtccctttttccgaacaaacggtgttcaaaagcttgcatctacggcactaagcccaatcagatgaaaaatatggagtgctatttttatctgattgttcttactgcttgatgcagagcagctttttcacaacctctccactaaacggtgttctcctgccaactcctcggtcacaagtcacaatattcaacaaacatgagaagctgttttttgaaattgttccttgtgactcggagctaaacggcaggctcacaacctcttggtaaacggtgttcaatcagctgaccctcggtattagctcaaaaaacggcaaaatatgaggaactattttttccgtttttttctctaatactcaggtcaaaacgctgatttcacaacctctgattcacggtgttccagaagtagcttctacggaaataagccgaaatttcacaaaaatttgagaagcaattttcgtaaattccttcttatttcttgaagctgaccacttctgtcacaacctcttattttgattagaacttgcgaaaataaaccggttaaagtgtgtctagcgcaagagatttgctataatagacgataagggtaaaatgtaacgagaaggggttgaaaaatgtgtatcaaattgtaacagattcttgttgtgatctgccataccatgtattagcaaaagaaaaagttgattttttatcaatgaatctccaattgaatgatcaagagttagtagatgacctcggaaagacattcaattatgaccgctacatgaatcagctgaaaaatggtgcgatgcctacgacatcacaaatcaatgttggccgatatttagaatttttccgttcttatgcggaaaaacagattcctgttttatatgtggctttttccagtggattaagcggctcttacagtagtgcgcttcaagcggttgaattgctgaaggaagaatatgaagaccctgagatctatgtttttgatacaaaagctgcaagtattggggaagggcttttagtattggaagctgtaagattgaaaaaagaaggtaaaagcatcgaagaaaccctagagtggctggaaagtaattatttgaaagtccattcatgggtaacagtagacgatctgaaatatctagaacgaggcggtaggatttccaaagcaagtgctactcttggcagtctattgagtgtaaagcctattattacggtggataaagaaggaaggctgacgaatgttgacaaagttcgaggaagaaacaagtcgatccagacaatcgtcaatgagacggtaaaaacaatcgttgcaccacttgatcaaatcgtttatgtggcttacgctggggatctagagagcgcggagaaggcaaaacggcttttggaagagcagataaagatgaaagatgtgaagctttatcccttaggaccaacgatcgccagtcacacaggctatggctgtatcgcgattttttcgatgggaatcagtcgataaaagcagtaactcattctgtaaaaaagcccagaaattgattgtaacaaaaacagcgactcttaaaagatagatgagcatcctatctcttagaggtcgctgtttttttattttttaagctaaataggccattatgcccataactcgttcaattgtttttgaatatctgcattttccaaaaattcatcatatgtcgtatcagctcgatcgatcacacctttatccgaaacggcaatgatgcggtttgccaatgtttggataaattgatggtcatgtgacgcaaataagattgagccagtaaatgccatcaagccgtcattcaatgctgtgattgattctaagtctaaatggttcgttggatcatctaatacaagtacgttagctttcgaaagcatcatttttgaaagcatgcaacggactttctctccaccagataaaacattcactggtttcaatacttcttcaccagaaaacaacattcttcctaagaagcttcttaagaaggtgttatcatcttcttctttacttgcatattgacgcaaccagtctaaaatcgttagatcagtatcgaattctttcgttgtatcctttggtaaataagaattacttgttgtcacaccccaacgtactgttccagtatctggcgtaatttcacccatgataactttgaatagcgttgttgttgttatatcattttctgcgacgaaagcgaccttgtcttctttgctcaaattaaaagatatatcatctaaaattttctttccatcaatcgttacacttacattttctacctgcaataagtcgtttccaatctcacgttcaggtttgaatccaacgaatggataacgtctagaagaaggttggatatcgtctaaagtaattttttcaagcatttttttacgtgaagttgcttgttttgattttgatgcattcgcactaaagcgggcaataaattcttggagttctttgatttgttcttcttttttggcatttgcgtttgcttgaagtttagccgctagttgactagattccaaccaaaaatcataatttcctacataaagtttgattttaccaaaatctagatccgccatatgtgtacatactttgttcaaaaagtgacggtcatgggatacaacgatcacagtattttcaaaattgatcaaaaattcttccagccaattgatcgattggatatccagaccgtttgttggttcgtctagcaaaagaacatcaggtttaccaaatagtgtttgtgctaataacacttttaccttttgtccaccagttaattcactcatttgctgatggtgcaattcttcagggatgttcagaccttgcagtaaaacagctgcttctggttcagcttcccatccattaagctcagcaaattctccttctaattcagctgctcgaataccatcttcgtcagtgaaatcctctttcatgtaaatcgcatctttttctttcagcacttcatacagacgcttgtgtcccatgatgactgtttcaagtacagtatagtcttcatagtcgtaatggttctgtttcaatacggccatccgttcatctggtcccatagtaacggaacctgtggaaggctgcagatcccctgataacactttaaggaacgttgatttacctgcaccatttgcaccaatcaagccatagcagtttccgggggtaaatttaatattcacatcatcaaatagtttgcggtctgaaaagtgcaaactcacatcatttacagtaatcaatttttttcctcacttttatcattattagttttgacaagtcttatagaattatataggggaaaggtaaaagattcaaggcaatcgaacattctttgtgtttcacgtgaaacagaatgaaaaaaataaaaataaaagcggagcgaaaatagctactataggatttattagtttgcaacagcataatttttgacgttatttataagagggagtactataaaactgtaaaagaaatgaaagaaggattgaaaatggatgaaaaaagaaccatcgactggggctcattgattttgggaattttatttgtacttgtctcattgttatcatttcaagaccctgtcggaaatttagttgcaattgtagtagtctttgcgatttttgcctttattaaagggatatttgaactgtttgtacggaacagattaaaagagctaacaggatataaaggaaagatgcccttaataatcgggatcatcgatattctagttggcgtctttttcttattcaatattggtgcaggagtcgcagcattgccttttgtttttgcagtatggtttattgctgattcagttttagcgttatttactgctgacttggcaagaggagtaagtgaaggatattattggtttacgatcatcgtcaatattttaggaattttattaggaattttcttattgtttaatccaatttcttctgcgttgacattaagctttttagttggattctattttatgttatttggtatcacacatatcgtctatgcatttagataagtaaaatcaaacaaataaaaaagccggcttccgattacagttttactgttgtaattggaagccggcttttttatcatggacaaatatgcacgaggtgatttttaggtgtcgagacaaatttatgcaaaaatgtgagaagctatatacacaaattttatcttaatactcgaagcatagcgcagttgtcacaacctcttttcatataattcattcaatactggcaaatcatggacttcatatttttctttgaatgcttggatttcttcttcagaatattttcttggatctaaatgcagatcttctactggcaatgggcgcttgttattgatcttcacatcgattactacaggacgatctgattttgcagctgcatcaaaggcaaatcgaagttgcgagtattctgtgactgtaaagctatttgccccgagcgcttctccaactttaccgaaatctgcatcttctaaaaatacaccaaatttcttttgttccgtatcttcttgttctgcttcgatgaaaccaaaagaatcattcgaaaagacaacattaataattggaagctgatatttgacttgtgtaatgatatcttgcatgaccatagcaaacccgccatcaccacttaaggtaaatacttgtttttctgggtagcttagttgtgcggcaattcctcctggcacaccattacccatagttgcgaaccatccagatgtcgtatgtttttgtttaccgttcatattcaataaacgaatagaatggatagtcgtgttaccgacatctgtgacgaaaatcgcatcgtcttcagcaatacgattgatttctttatagacagcctctggacgaatcggttcttcctctcgatcttcaaaagatttcaaccaatttacccatttttctttattttcttgatttgctaggtaccagctatcagcagggcgagcatcccctaactcgacaagtctttgcaaagctgtgtttgcatcaccgaggatcgacaaagatgtttcatggcgtcgtccaaattttgacgcatcgatatcgatttggataaattcagcagttggattaaaaaatgcacgtccaaatgggaagtcgctaccgacaaataagatcagatcggcttctgccaatgcttcatttccgggtttagtagcgacacgtccagcaaaaccaagaaagttttcataatcatcaggaataattccttttgctagaacggaagcgacaacaggaactgaaaaatgttctgagaattctttgatttgcggaaatccgtttcgcgttccttgaccaacataaagaactggtttttttgctttttcaagataaggcaaagcagctagcaaatctttttcttctggtaatatcacacttgttttgtgagtgtgagcggtggagaaaggttgttcgtcaatttcttcaaaaccaagatcaacagggatagtcacgatagccacgcctttatgctcataggcggctttaatggcttcatctactacatgcggaagactttgtggtgtcatgactgtacgattgtatacgctaacatctgcgaaaataggattttcatttagttcctggaaagagttatagttcatggatgtagaagcaacttgtcctaagaacgctactagaggcacatggtccatctgtgcatcatacaaaccattgatcaaatgtgtcgcaccaggtcctgcagagccgaagacagcgccgactttccccgttaattttgcatctgcagcggctgcgagtgcgccgacttcttcatgacgaacttgaatgtagttgatttcggttttttcttgatatagcgcatccataattgaattgaaagatcctccgggaatgccgtaaatatggtcgataccccagctttcaagaacttttaccattgcgattcctgcattgatttttgacatggtgtttcactcctttagcaatgatgatacataaattttttgtatctagagtatagaactttttatcgaaaatcccaactaattcgtcttttcacaaaaatgtagtcatgtttttgggaatatgctagagtagtacatagatagattcaagagaggggaatggcatggttgaatggctattgagacttgaaccttggcagcaagcacttgctgggacagcttttacttattttatgacagctcttggtgccgggttggtttttttctttaaagaaatcaaaaaagaagtgctaaacttgatgttaggatttgcttctggtgtcatgattgctgcaagtttttggtctttgttagatccggctattacaaaagcagaagaaaatggagatattgcttggctagttgtaagtattgggtttggtttaggcggtgtgtttttatatatggcagataaaacactgccccatatgcattttggaccacaacatgaagcagaaggattgcctacccatttaaaacggacgatcttgcttgttttttctattacattgcataacattcctgaaggtttagccgtgggggtagcattcggtgcagcagcaactgcggataatccgacagccgctatattagccgctgtttcggtggcgctaggtattggtatccaaaacttcccagaaggagcagctgtatcaatcccgttgcgacaagaaggtctgagtcgtaaaaaggcctttgtttacggacaagcttctggaatcgttgaaccaattgctggagtgattggagcgctactagtaacgaaagtggagctgctgcttccttatgcacttgcttttgccgcaggagcaatgatttatgtcgtggtggaagaattgatccctgaagcacagcagacattgtccagcaaacgtcattttgcagtttttggcgtcatgagtggatttatcattatgatgattttggatgtggcattaggataaataaaaaaaatatatatgatatatcaaatagggccgcgaacttatatcgcgaccctatttttttagtaagttatatcataatgaagtgaatggtatcatacattaataatagttttttctatgtgtatttcctttgatccagcgaacaagccagatgataagtgcgattgggattagaactttgaccgcaaaccataaaagcccgcttaggacactgacaaaaagactgatgacgaagctagctgcaattagcactaaaagaaccatgaagatatttaagaacatatttttttgacgcatacaaaaccctcctcttgttcattctttactatagaaaaagtataacagggattgtttaaaaacacctccaactgaagactgatttttacttcatctacttaaatgatcaaacaattgctttttctctggtttatcatctaaaatagagcggaaaaggaggagaatatcatgcctaaaaatcgtcttgaagcatttacagatgctgtaatcgcgattatcatgactattttagttttagaacttcatgaacctaacggagacacgtgggaggcgctcgctgcattaggttaccgattttttatctatattgtcagttttatcattttagcgatttattggaacaatcatcatcatttatttcaagttgtacataagataaatggacgggtcttatgggcgaacagtttctttgtttttgcgctttcgctttttccgtttgcaacttcatggatcagtgagtacatcaatagcctggctccagaaatgacttatggttttgttaccttgaccgctaatattgcgtattatatcttggcaaaagaacttgtcaaagcaaataaaggccacgagaaagcattgaaggcgatgttgaataattacaagaaatcgtatctatcgattggtttgaatgtgttaggaattgtcttagggtatttagtagcgccagtagccgtgctgatcgcaaacatcgtgattctagctgcttggatcatcccaagtcgtaccatcgaatcacaatatcggtaaaatgatccgtgtttaaaatttaagagaaaaatatagaaaaaataaataaacgatcaaatatccgagtgatactagtattcaaagagggatgcagatggatcaaaaaagaattcatgtaggactgattactagttttgtcacgatgcttatttatttggatcaaggtcatttgacttggacagtagttggtgtcgtaggatttttgacattattcacagcaataaaaaaataaacatctttatgtaatctgatgttctatctatttaagaaaagcatgtttacagcagtatgattctgttgtaaacgtgtttttatttgtggaaaatttaatttttagaaaagtgtatcgaaaaatagatagttagtttttccacagtggataacttcgtaagagataaaaataaaaaattagtcaaagaagggcgtatagatttcttttgataggagatatacaacagaaatgaataaatattaacgtgttttcaaacagtataaaacggtgtggtttttggaataaaaaaataacatatctcattttacacttttgttattttatacttaaaaaataacgacacagaaaataccgtgtctcagatttctctactacttctaaaaactactgtttttttcctttgaaatgccttcaaaaagtaggatcaggcagaatatactggcagaatcaaggagaagggagcctaaataaggagaaaaaccatagaaaatataaagtaattacttataaaacaagctttttatagaaaaataatatacctgagtagggtataaattaagacggaattcctttctagattgagatattgactaggaagaatgttaagattttaagcctttaagctaaaaaaaaaccctttttgttaaataaggggaatatagcctgtcagtttcaaactgcaagtcgtcctgctgcaataatatagtagattagagatgaaaatagatttttttaaaccaatgactgaataaaaagaccgtcatagatacacattggaatgtgtctattacggtctttttttacgaacgattttattgaagacggacagttcgggtcaaaaataaaaaagctacgatcagaaataagaataaaatgtatcccaaaataatggctagacggtctaacttatttgtcgatagatgtttgtttagaagttgataggcccataaacctatcagtcctcctgttgtattagttatcaaatcagtgatgtccgctacgccaataccgaataggaattgaatcaattctgccaagaagcttacaaggaaaataatccctaattttttagaaaaagaaagtctcttgaaattgacattcaaaagcaccccaaaaggaaaaaagacaatcaagttataagtggtctcacgtaataccgtcgtattttcaaaagaaaaagtagaaaaagggacgagattgacattgctgtaagaataagtgagaaattgtggaagattaaatgatagcttgaataaaatcaaccataatagaaagaataaataaatccctaataaaaattttgatacataccgcatagacatctcctccatttaaaaagtataccatcgaaaaccgctgaaaaatcataaaaaagtatgaagtttaaggaccaacgtagttatcgtacgaaaattagaagcttttttttgttgggaatccggtttctttaacaaagctaagatagcgagttgcttggaaaagttgctatcttttttctgtcaaaacgactcggaatgttcgttttttgttctaatttctccaagttgtttactttttgatactaagtttatgaaaaatcaagaaatagttgttatactaggtaatgctgacaaacgggattggcatttcatcttggttcagctttttttccaattactaggaaggagggatagattgttcaagacttattttcgtttcaataaaatacaagataatccttttcgtatcatgaatctgatgctacttatctttattgtattatggttaggttacataaatcatgattttttgatttcaagtttttcatcattagggatctttacttttttctattatcaaaacataccgatgaaatatttgctgaaacgtatgtttctgatcggttgcggactgttggttgctttcgttttggggatcttatcgacttatgttttatggcttgaaccatttgccgtagctttggttgctttttccagcagattcgtgttgcgattattccatatttctaaaccaggtggcttgttttttgcgatgctttctgccatgggaacgagcatgcagctgccaatcgctcaattaccgatcgtctcactttatttttttatgggtgtcgtttttgccctgattgcggcagtgattacaaaattactggattcacggcctgagcagacaattgaaaaagcaactttaaaagaaagatttcacgaagagcctttagtgatcattgattctgttttctacagcgctgccttatttctttccgtttatgtcagtcacggcttgaatctgcataatccttattggttgaccttgtcatgtgcatcgattttgctagcagaaaacttggatgcgatgaagcatcgacaagtccaatatctgattggatcgatgggtgggttatgtgtgtcggcattcttgtcatttgtgccgtttacgcagttgcagaccatttttctgatcacttttctatatggaatcgcacaatttctagttgctagaaattatgcagttgctaatatttttcttaatccgatggcgttgatgctatctacacttattcgtggagcatacttgatttctttgatcgaatatcgttttttagggatcgtcataggaagtttcatcggtttaggtgttgcgtgggtaatgacggttggtttgcaacattatttaacggttgttcgtcaaaaattagaatagaaggacaaatatatgtgccaaaagaggttatgacaagatttttgtcacaacctctaattcaaggtgttcaaaagccagattctcagcattaagtcaaattcacacaaaaatgtggaaaggaactttcaaaaaaattttatatttattctatcaaaaaattttgtttatgatggtaactgaataaactttcctgagatggtcaatgctttccttgaaagtcttacagatattctttcttcatagaaagtttaagttttatagttagtgtacaataaaagtatgtttataccatatggtgtccggataatcagtcatttaaacaatgaggttcaaagatatgaaaaggggaaatttgatgaagaaaataagcaatgaaatccaaattctggcagaaactttaactcttcccaaagtcgttatagagcaaatgattgtacaagcaaaaaacatccttgatgaggtgtttgagcaatatagtcatgaactaatggatcctaataaagcaaaggcgactgcaaagaaaatagacaaagtctatgaagaggaaccttttgcagcattagctatttatctatatgcagcttctcaaagttggaaaaaaatttatcaaccattgaagattccaagaactatctatttggcaacaatgaatgcttttactagatttattcatgaacatttccaagtaacaggaagctatcgctttgaccgtggtttttggatttggcattacactagtggcttgatctttcggattggtgaattggagtacgaaatgacatattttccgaaagggtacacggatctaagattagaaggaaagcagtgcctttctcttcatattccttccgatgcagatttatctcagaataagataagagatagttacgaaagtgccattcgtttttttgaactttattttcctgattaccattaccaagtgatgtacacagatacttggttactatcacccaatcttactaaatggttgaaaaaagagtcaaaaatctgtctttttgcagccgattatcgattattatcagttgatgaacaggacgatagtggagtcccttggatctttggacgagtagatgcccaaatacatgattatccagaaagtacgagtttacagcgacaagcaaaagagcaattgcttgcaggcgagcacattggctctggcttaggtattcttacttcataagtttagtacttcgaaatagtttaaaagagcgtgagacaaaagtaaagaacacttttgtctcacgctctaaacacgtataaacggcggaagcagaagcaactccttcggaaataagctgaaattcacaaaaatttgaaaagcaattttcgtgaatttcttcttatttcttggagttaaacgcttctgtcccagcctcttttttagtgttctatcgaacacacagtacgttcaataggtaaactagctataacaatagatattaaagttaacggacaagagggccttttttaggtagctaaaacgtaataatgaaaatttatttccagagataggagtcaatcagctagtctgatcgactgttttaacaagttgactttcattttaacttttgataccatttaaaacacaaatcgtaattgtttcgatttgtgttttttagcatgactacaatcaaagaagaaagtgggtcgtccatatggaaaaaacagatatctcaagtgcataccgccgcttgaaaagcccaaatatcaaaacacgaaaacgtgcgctgaagatcatcaaagatgtgaaacggaatagtgggaaaaggtaagaagaaggaaacttaattaaaaaaatagccgaaaaacgtttttcggctattttcaataatcggtttttgtgtaaggtttccgaaagaactgctgttgattttccatttttaacatatgataaattggtagaatctttcttttcaaattgataccattccctaattccagttatatagttaactacagaaccacaaagcacgtacgtttataaaagtattatctgtagttatttttcaattccctttcaacctcttattttgaccagtagtattgatcactttaccttttaacacctttgttcgtttttgaaacatttttagtcaagaatggaaacgtaactacataatcaaaggttttgcgaaatatttcatgaaatatttcatgtagaagcgagcaatacggttgcaaataaccattatcgtttaataagcagttacgaaagctcccaatatctctaacgttcagctcactccatttcttttcttcaaaaaaatcagtgattcgtatctctttctatttgtcgaaaaagttaactttaaaaagtaacgccgaaaaaatatgcaaaaaaataaaaaagcagttactattgctagaataacatcaaggaataataagttttggttttcagataatagtcgataagttgtgtattggaattttagatacagtaataaagtatttttcatgaaattttgtgagaatcactattacaagtatctttaataaaattaatggttaaggaggaacttaaagtagaatgtaaatgaatagttgtagtcagtcgattgtgatactagactcaaagttgcaggaataagtttttcaatttgtgattggaagataaaaaatgaaaaagaagggcttttttttatactttgttgattgtagtgtttattttccctctgtttagccaagtaacattttctatgactcaaccagtttcaagtgaggaacatgataacctttttcgtgctacagaagagtttaagaaatatcaggaaaatattgttccggagactccattagctagtgagccaattactgatattgatggaaaccaaataggatggtatatacagtacgaagttatggtggtaaataatgactcaatagtaaaaaatacagtaggcttagagctaacaccgattgaaaaggtgagttcattgttaacgtatatttatactgatgaaagtgacgagactgagatcattttaacggattactcaaaaattgctactgataaaaagtatatattgtggatgtagacactagtgaaatactttatgatatagaaattgatgaaaatttactagatgtagcacaagaaatcgatcatcaaaagcaggaagctattcgatatgctggtagaaaagggaaaagaaaatatttattacgtgaatgtagcaaaagttagagaagatgaaaatgagtggaaagaattcaagagtcgctactcaattaactcgactccgacatttacagtttacagagaaggatcgatagaaaaaactgttttttggactaaagaaagtggaatgtctttagctgaagtagaagagtttttggattatgttagtatgcaacagtaagggagttcttattatgaaaaattttgacacatattatgttattgttttttcgatatctttgctgttaatattactaactttaatgcagtataaagagtatccagagtattttattttaacttttgtatatttagtaagtagctacacacttctatataaattcagaagttcttctagagtttctaaagtttgtttcttaattagcttattgattctataatatttttgatttatataggaaattaaaaatattatagaatcaacactcagagaacgggttggtttttaatagatttaataagtactgataatgaaatttctcctggttgggaaaacgaagttggttaccctgtagaagaattttttcaagattactttgcggagtatgccgataggataatgagagattacgtaacagataaaactcaagaagtcatcaatcaatcccagtcattaaatgaattatctgataaggcgaaagaagaagcagttgccattatttcttcagggattagtgactatattgatatgagtggtgaaatcaattatggcgataaagacaaaattgtacgcatgataaaagcttttatcaaaacttttgatgtgaaggcagatcttaagtttaatgatacttacctagtaggaaaattaattaatatccttgggacagagaaagatacggaaacgtttatttcctctttgtctatgttgtttacagataagcatttttcaactcagcttggtggagaggaactagtggaaatcttttaaccattacgcccagcattaataaaagtatatcaaaaaagtactcctgatgatttttaagattggtttgagaaataatgtgaaaacactatttttaatgttaattatagatagagatgaacgcgtcatatggttaaaagaatgaaaaagtcaaagatacactgctatatttcactaaggatatagcagtgtatctttcatgtcgtttcactggcagttttttataaaaggaggtgtgcatttcagttgcttttctttggtagttagttgaatcgtttaagaattaacggatgtggcagacaggtgctctgtccaaaaaccagtaaaatctttgatggttccatctttatttagctgtgcctgttcaaatactgttttgtttttaccgaatggatcaattgcaataattgttccgatccccgcacgtttggcagcaagtaatcctgagtaagcatcttcgataacaagacaatcagccggagctaagctcagtttgtctgccgctttaagaaaaatatccggttgcggtttcccagggaaagagccgtcgtcatagacaatcttgtcccagtcaaaccagcgggctaaatcgaaaatatcaaaataaaaagcaacattctctttgacagtagccgtggcaatcgttaatggaatctgttggtcagtcagctggtcaagagtcgcttcaagcccttttgtcaactgaagctcgttttcattttgcaagcaaagcatacgataatagctttctttttcttctgacaatacggcgatctcagaggcggtcaaatgctctgaaatgaaatgtttcaaaatctccgtattcgtccgaccatgaatattttttaaaatatcctcgtctgataaaccatcttttgtatgatcatgtatcatatgcagccaagcagcttcatgcagatgagagtccaaaaacattgttccgttgaaatcaaatataatccctttcatagttacgctcctatagtggtattttcggttgaatcagcaatttgcagatcgacatattgtgcatagtgctcttgaacctcccgcgagatctggcgatccgtaatgagcagatcgaaatcatgcaaattataaaacacataaaaatcatctcgattgaattttttattatcaacgagtagatatttcttacgggaattatttagagcgatctgctgtgcttctccttcttcggtactgtaagtagagatcgcttcgttgtgaacgccatttgaactgataaatgcttttgtaaactttagtcttcttaaattgtcgttggtgatcggtccgacaaatgcgccggtatttttccggaaatcaccgccaatcagtagaatttctggtccatctgcttgagcaagaatatcaaaaactggataattatttgtaatgatccgaattttcttgttcagtaaatgcgtcgccaatagttcgattgttgtacctggtcctaagaaaatcgtttctccctcgtgaatcaaggaggctgctgtggcagcaatttcttttttttcttgaatctgcagagtggctttttcagtgtgagaaagttcttgatctaaagtgtaggaaagactttgagcccctccatggacacgcagcagcttgcccgatttttctaattcatctaaatctctgcgaacggtcatatcagaaacatctaattgattgatgatttcattaacggtaaggattccttttttattgaccatttctacgatagtaagcaatctttcttttttcaacattgtcttcacctctaatttaaggataatctatcatataaacggacaacagtcaatctaattcgaacaaaagtaaacatttagggtggtttttatgtttgttacaatagattttattgctgttttctggtttttatgattatttgtgtttgtttttgttgacaaatgttttggatgcgtttacaatgcaatcagttagaaagagcgaaaactgattatagatttgaggagagatgtacatgcttaaattaccagaagattttatttttggcggagccacagcagcctatcaggttgaaggagccactaaggaaggtggcaaaggcgctgttgcttgggatgactttttagaggaacaagggcgattcagtcccgatccggcaagtgatttttatcatcaatatgcaaaggacattgaattgtgtgaacgttttggtgtaaatggtctaagattatccattgcttggagccgcatttttcctgatggagctgggaaaccaaatccagaaggaatcgctttttatcatcgtgtgttcgaagaatgtaagaaaagaaacgtaacgccgtttgtgacgttgcatcattttgatacccctaaacgtttgtttgaccatggagattttttgaatcgagaaacaatagaagcatttgtttcctatgccattttttgttttcatgaattcaaagaagtcaaggtgtggagtacctttaatgaaatctatccagttgcaaccaatcaatatttgttaggtgttttcccaccaggaatcaaatatgattttacaaagatcgtcgcctgtcttcataatatgatggttgctcatgcccgtgtagtgaactatttcaaagaaaacgaacttccgggtgaaattggtgtagttcactcattagagacgaaatatgcggcaacagacgcgccggaagataagcatgctgcctttttagacgatgcattgtcgatccgtttcttattagatgctacctatttaggctattattcaactgaaaccttgactgctcttgatgagatatgtgaagcaaatcaggccagctatcattttcctgaagaagatttcgttgaattgaaaaaagcatccacgcgtaatgactacttagggatcaatcactaccaatgccattttgtcaaagcttacgatggagaaaatgcaatccatcataacggtacgggtgaaaaagggacctctgtttataaagtgaagggaatcggagaacgtatttataaagaaggaattcctcgaactgattgggactggctgatttatccagaaggtctatatgacttgttgctgcgaattaaaagcgattacccacattacaacaaaatctatatcactgagaacgggatggggtataaagatcagtttgaagatggcattattatggatcagccgagaatcgactatttgagagtctatttggaatccttaagcaaggcgataacagccggggtaaatgtgaaggggtattttttgtggtcgcttatggatcttttctcatggacaaatgggtataacaaaaggtatggcttgttttatgttgattttgaaacccagaagcgttacccaaaagaatcagcttactggtacaagttggtcagtgaaaccaaaacgattatttaataagtgataatggaggaagaaaagatgaataaagaggaattacaaatgcttggttttgagatcgttgcatattcaggcgacgctcgcagtacattattgaaattattgaaagaagtaagacaaggaaactttgaacatgttgattcggcgttgaaagaagccgacgaaaatttaacccttgcacataattcgcaaacaaaaattttagcggaagaagcatctgggaaagagatggagatgggattcatttttatccatgggcaggatcatttaatgaccactttattgctgagagatctgattcaagactttattgtactgtacagacagaatcaaggataggagaagaacgctatggatggaatcattaaacaaatcgaaaaagggaaaccattttttgaaaaaatctcacgtaatagttatttaggagccgttcgtgacggatttttaacagcgatgccagctattttattttcaagcattttcattttgattgctgcggttcctgagatttttggttaccaatggcctgaatctgtctccacatggctatggaaagtctataattattcgatgggtgttgtagggttactcgtttcagcaaccactgctcgctgcttggctgattcgatgaatcgtcgcttaccgaaaaacaaagtaatcaacaccacctctgtgatgctggcctctgtggtaagtttcctgttgttaagcgtctctccgattgaaggtggattttcaacggaatatatggggacaaagggactactggcttcctttgtcgctgcatttttaacagttaatttatataagttttgtgtgctgaaagatattaccattaaaatgcctaaagaagttcctggaacgatttcgcaaaccttccgagatatttttcctttctctttttcagtatttgcggccgttttaattgatttaggcattcgacaaatcttccaaatctcatttgcagaagcaatcattacggtgctgcagccgctatttacagcagctgacgggtacttaggaatcgctattatctggggagcgatggcgctgttttggtttgtcggtgttcatggaccgtcgatcgtggagccggcaattgcggcaattatctatgccaatgtggaaaccaatctgcaattgttcaattccggtgaacaagcttctaaagtactgacggtgggtttagggaattttgtaggaactatgggaggaactggggcaacattggttgttccttttatcttcctactctttgctaagtctaagcagttgaaggcagttgggaaagcttcctttattccagtaagtttcgctgtcaacgaaccattgctatttgcggcacccatgattttgaacccttatttttttattccatttttgttaacacctgttgtaaacgtttgcctgttcaagttttttgtcgatgtattgggcatgaacagctttatgtacgttttgccttgggcaactccagcaccgatcggtttggttctaggaacgggcatgggtatcttagcttttgttctagcagcggttctaatcgtcgttgacttcctgatctatctaccattttgcaaagcatacgatgctgtcttagtagagaaagaagcacaaaaagcagaggtgatcgcaaccgaggaaggtgcttctgccgatgtacgtgaggaagtacctgtggcagcgagtcaagttatcagcgatgcaaataaagaaatcaatgtgttggtactttgtgctggcgcagggacaagtgcgatgttagctaatgctttaaaaaaaggtgcatctgaatcgaaagcaccgatcagtgcaatggcgggtgcttatggttctcattacgaaatgctgcaggattttgatatggtggtcttagcaccgcaagtcaattcttactatgatgatatcaaagaagacaccgatcgcttaggaatcaagctggttgcgacaaaaggagcagaatatatcggattaacgagagatcctgaaaaagctgttcagtttattctgaaccaatttcaataaaggaggagccataatgaaaatgggaatttggttgcgtaaagctgttttatttgcagctgtgttaggggctttgggggctgtttcaaaaactgttgaagcatctgccagcgaatttattcgcggagcagatatttcgatcctgtcagatatggaaaaatctggtgcaaaatattatgaagacgatatttcaaaagatgccttagagattttaaaaaataatggtgtcaactatgttcgactgcgtttgtggcaggatccttataatagtaatggagaaagttatggagcagggacaaatgatctggaaacgacgattgaccttgcaaaacgagcaaaaaatctgggacttaaggtgctgctggattttcactacagtgatttttgggttgatcctgggaaacagaatcttcctaaagcatggcaaggtctgacctttgaagaaatgaatacggcattgtacgactatacaaagaacgttctgtcggaaatgaagcagctggacgtttatcctgatatggttcagatcggcaatgaactgaatagcggaatgctctggccttatggcaagtcttggggagaaggcgggggagaatttgatcgattggctgcttttttgaagtctggtatccaagctgttcgagacactcaacctaaaacaactccagtaatgctccacttagctgatggtggcgatacaggagcatttacttggtggtttgatgaaatcacgagtcgaggtgtgtcatttgatttaattggagtgtcgtattatccgtattggcacggttcaatgaatgaacttcaaaccaatatgaatgcgatcagccaacggtatggtaaagaagtgatcgtagttgaaacagcttatgggcatacaacagcgaatgccgatactatgccaaatgcttttggtgaagccgaagcagctgcggggggatatgaaccaacaccgacaggacaagcagagtatttgctggatcttgccgatcggattcaggcagtaccgaataatcgcggggcgggcttcttctattgggaacctctttggtacaacggaaatgtgagttgggcaacacaagcaggtatgaattatctcagtgttcaatccactatgggaaacgaatgggacaaccaagcgatgtttgattttgctggaaacgccttgccaagcttgcgtgcgtttaaacaagcaggggcgcaaataaatctagttaaaaatgcaagtttcgaaagcgatggaccaacgaccagtccttccaattggcaaacctggtttcaacaaggaaccgctaagggtacgatcaaaacggaagcgggcactttttttggggactacaaactaactttttggcaggatcaagcatacgaggcatcagcttatcaaaatgttagtggcataagcaaaggaacttacacattgagtgcctatgtaatgtctgggggagagtttgatactaatcagttatatatcaaaaattatggtggagcggaactaaatactgcggttgttaaaacaagtgaatggacaaaaattacaatcaaagacattccaattacaacaggtgtttgtgaaattggggtttatagcaaggcttcaggaaatgcttggacgaacgttgattttgtttcattggtgaaacaatagactgcggatcgtttcgattcaagatcggaggttcccttcagccacatcgttagcgtagaaggcaggaatcgaacctgcacctcgcctttgccaaaaataaccagaaacgatttccagtcatttttaccaaaacgagtaaagcaccagacttcatctacactttgtattatgctaaagagagttcaacgatttcgtaagaagcaatgaaaaaattgcaaaaagttgtgcagataacataaagtttgtttaagaaagggtaaccttagaattccgtcgtgaatatgatttgagcacttagatggatagaaaaaagttctcggaaaacagttcgtttttcgagaacttctttttatgataagaatgaaacaaattaacttatattatagtctcttttggtagggaaccatcttatttttaatgaaaatcaagcattttagctattgaagaatgttgatttatagggattccccctccatattatgttggctctttattcccactccactgttgctggtggtttagaagtgatgtcatacacgatacggttgacgtgggctacttcgtttacgatacgtacagagattttttgcaagacttcccatgggatacgggcaaagtcagcggtcattccgtcgattgaagttacagcacggataccgactgtgtagtcgtaagtacgtccgtcacccataacaccgacagagcggatccctggaagaacagtgaaatattgccagatatcacggtcaagtccagcagctgcgatttcttcacgcaagatagcatcagattcgcgtacgatttctagcttgtcttcagtgatttcgccaagaacacgaataccaagaccaggaccagggaatggctgacgccaaacgattgaatcaggcatgcctaactgagtccctaattcacggacttcgtctttgaataatgtgtttaatggttcgatcaattcaaattgcatatcttctggcagtccacctacattatggtgagatttgatcgtctgtgctgtttctgtaccagattcgataacgtcagtatacaacgttccttgtgctaggaaagagacgccttcttcaccagcaagttttgttgcttcgtcatcaaaaacatatacgaattcattcccaatgattttacgtttttgttctgggtcagatacacctttcaacttgtctaagaagcgatctcttgcattgactttgatgatgttcaagccgaattttccgcctagactttccattacttgttccgcttcgcctttgcgtagcagaccgtggtcaacaaagatagatgtcaattggtcaccgatcgctttttgtaaaagaaccccaacgacactagaatcaacgccacctgaaagaccaagcaagacttttttgtcaccaacttgttcacggattttttctacttgcatatcgataaagttatccattgtccagttaccttcacagtgacaaacatcaaaggcaaagtggcgcagcaattcgattccgtattcggaatgacgtacttctgcatggaattggataccataaaaattacgtgttgtgtcttggatagaagcaatcggacaatctttgcttgttccgactgtttcaaagccttcaggaactttagttaccaagtcaccatggctcatccatactgtttgttgttttggtgtttctttaaacaagacagcttgatcgcttgttacttctaacaaggctttcccatattcgcggtttttagcaggctctacggaaccgccaagtttgtacgtgatcaattgcataccatagcaaatccctaatacaggaatacctaaattgaagatctcaggatcgatcccaaatgcattctcatcatatacactgtttggtccgccagaaagaatgattccctttggattcatcgcttttacttcttctgcagtaatgcggtggctcaataattcggaaaagactccaagatcacgaatacgtcttgtgatcaattggttatactgactaccgtagtctaatacgataatcttttcaacgttcgtcatatcggcaacgtttgtcaaatttattacccctatccctttaaattttatctcaaaatagtcaaactattttaaaatgctaatattttcgcatgaaaatcgaatcgatgatatgattttcagttttatggagaattatatcggctcttcctcgtgtaggcaagatatattcctgtaaatttttcaaattcacatttttccatacatcttttgccattttaaaggcttcttcacgatctccgatagcaaaacgataataataattctctggattttggaaagccgtatccagtaacgcaccaaaacgatccaaataccatttttcgatcagcacgggatcggcatcgacatagacagaaaaatcaaaaaagtcgctgacgtagatttgctgattcgcaggtaattgaagcgtattgatcccctcaacgatcaagatatcaggctgctggatcaattcgtacttgtctggaatgatatcatacacatcatgtgagtaaacaggtacttttatctcttcctgaccagattttacacggttcaagaaatcgatcagcatctccatatcataactttcaggaaatcctttacggtccatgattccacgctcttttaatatacgatttggataaagaaatccgtcagtcgtgatcagctgaacgtttcttcgtttgaaggtacgagacaaaatcgtctgcagcagtctggctgttgtactttttccaacggctacacttccggcgatcccgataataaaaggcggtacttctacgtatttatgaagaaataaacctttactcaagaacaaagattcaaattctttcatataaagataaatcagatgagcaagaggtacatagatatctcgaacatcctgcatggaaatgcggtcattcaaacttttgatattatctagttcatcttgtgtcaaaggtgcttgcccattacgataaaattctcgccattcttctcttgccacacggtagtagttcattggatcattcatattagcctcctgcgttctcccatcaatggaactattttaacacaaaataaacgcaaaccccaccacttaagagagattgccgatctttttgtataatctttataatagaaagaaacggagtcttattcttgacttgcgcacggatacataaaaggatagactgttgtcatgaaagaaatgagaaggatggaagacatgacaaatcattactattctgaacgcccagatacggcgcacgattttgaacaatgggcttttgagttaaaaggcagaacctttcaatttgtaacagattctggtgtattttcacgtgaaacagtggattatggttcacgtgtcctgattgatgctttcgattgggaagagttacctgatgaaggaaagatcttagatgtgggatgcgggtatggaccgattgggttagctttggcatttgcgacacagcggtttgttgaaatggtcgacattaatgaacgagcggtaagtctagcgcaaggaaacgcaaagcgtaaccaaatcgaacatgttgatatccatcaatcgaatatctatgaagcagttcatgaagaaacctatgcagctatcgtaagcaatccgccgatccgtgctggaaaaaaagttgtacatgaaattttgacaggcgcatatcctcggttgaagaagggcggtacactgacaattgtgatccagaagaaacaaggagcgccgagtgcgcaaaagaaaatggaagaaacatttggtaatgcagaaatcgtcacaaaagataaaggatattatatcatcaaaagtgtgaaagaataactagctgaaaaatagtggagcgacgaaagagtggaactgggcgtgcatgtacgggtacgtatcagttctttttttgttgagaagtttttaaaaacaaagaactattttttcttcaaaaagaaatagtaggaacagagtcgttgttttttacgataaaataaataagatacagaacttgtatagaaggctgccaagtcggtagataaaggaggtttttatcaaaaaacatactttccttttttctctattcttttcttgggggttttggtacactgatagggaatttagatagaagggagccaataggatgaagctgaccatcagagatatcgcagaaatggcaggcgtatcagtaacaactgtctcacagattttgaataacaaaggaagcagatttagtgataagacaagaaaaaaagtgttgtcgatcgtgaatgaacatcattataagcccgattatttcgcttcaaatgtgatcaatcgacattcaaagaccatcggaatgatcgtccctgatgtcactgatttcttcttctccaaactgatcgaaggtgtagagagctatttgaatcctttgggctatgtgatcatgttatgcaattctcgtcatagccaagaaaatgagatcaagtatttacaagagctttcccaccgctcagtggacggaatcttgctggccacaccaaatattttacctgagaaatatgcattagacagcggtttttatcaaaaaatgccaatcattttaatcgatcgcggattgaatcgtcgggataacggacggcttatcgtaaaggaatatgagggcgcctatcaagctgtttcgctgtttattgaaaatggccatacgaagatcggcatgctgaaggaaaccactggatactatcaattagaagaacgtttcaacggatatcgtcatgcgctgaaagatcatggcctgccttttaatgggaaatttgttgaacatggagagttgactgtccaaggtggatatactgcatcaaaaaaattactcaaacataaagatatcacggctattttttgcgggaatgatgccatggcgatcggatgctatcaggcgatcgatgaattgggcaaaaaaatcccagaagatatctcagtcataggattcgatggattaaagctgtcagaatacatgattccgcaattgacgacagtgcagcagccaagttttgatattggattttatgctgcacgtttcctgatcgatacgatcgaatttcctcaaagaaaagttccgaacaaagtgttcgaaacaaaattaattattcgtgagagcgtaaaagtattgacaaagggctaactcggcggtatattgcttatgtaagcatttacaaaggctagttagtgctttttttatttttagtaaaccagtttactaaagtggtttacctttcctaaaaataatgtataataccgaatgaagacaaggaggatcaggcaatgcgaatggtggatctgattgaaaaaaagagggatggaaacgagctgtcgaaagaggaaatcgagtacatcgtcacgaactatacgaatggaaagattccagattatcaagtcagtgcattattgatggcaattttttatcaagacatgacaaatgaagaaatcacgaacttaacattggcgattgctaattctggtgatgtcatcgatttgagttctcttgaaggaataaaggtagataagcattcgacaggtggcgttggtgacacgaccacattgattttagcccccctagtagctagtgtcggagtgacagtggctaaaatgtctggacgcggtctaggttacacaggtggtacactagacaagctagaagcaattcccggatttcagatcgagctttcggatgaagaatttgtacgcattgttaatgaaagtaaagtagcggtaattggtcaatcaggaaacttggcaccggcggacaaaaaattgtatgccttgcgtgacgtcacagcgaccgttgattctcttccgctgattgccagttcgattatgagtaaaaaaatcgcggcaggagcagatgcaatcgttttggatgtgaccactggagacggtgctttcatgaagaacatcgaagatgcaagacgtctggcaaagaccatgacgagcattgggaaactggctaaccgagaaacagtggcggttatctcagatatgtcagaacctcttggcgaagctatcggaaatagtctagaagttgtcgaggcaatcgaaacattacaaggaaatggtccagaagatctagtagaaatgtgctacgccttaggaagccaaatggttgttcttgctggcaaagctaagacaaccgatgaagcaagaacgttgcttcaagaagctctggaatcaggtaaagcgttagcaaaattcaaagaaatgatccaaaatcaagggggagacccagcgatcgtggaacatccagaacgaattttgactgcacgctacacaatggagcttcctgctaaacaaagcggagttgtgtcaaaaatcgtggcaaatgaattaggaattgctgcaatgatgctaggtgctgggcgtaaaaccaaagaagaagatattgatcacgctgttggattgaaactgcataaaaaaattggtgacactgtgacaaaaggtgagtcactattgacgatctatagtaacgacgaagaaatcacttctgtcattgaattattatataaaaatattgaaattggtgaatcggcaatgaagccaacgttgattcatgacatcatcacagaataaaggaaaaaagcggactttaccgttttaaagaaaaggggaaaagaaatggaactaaaccgaatgatcgaccatactattttgaaagcagacgcatctaaagaagctgtgatgcaaattatcgaagaagcaaaaaaataccatttttattctgtctgcatcaatccagcatgggttgcgctagcgaaagaacaattacaaggtgagccagtagccgtatgtacagtaatcgggtttcctctaggagcaaacacacccgagacaaaagcatttgaaacaacagatgccatcaataacggtgcagatgaagtcgatatggtcatcaatatcggtgctttgaaatcaaaggatgatcaacaagtccaaaaagatatcgaagcagttgttgaagcagcaaaagatcgtgcgcttgtcaaagttattattgaaacatcgttattagatagagaagaaatcatccgagcttgcgaaatagcaaaagctgcaggcgctgattttgtcaaaacatcaactggtttctcaacaggcggagcaaaggtagaggatgtccgtttgatgcgtgaaactgtaggaccagaaatgggtgtcaaagcttccggcggtatccataacgaagaagaagcaatggcaatgatcgaagctggtgctacaagaatcggaacaagcgcaggagtagcaatcgtatctggttcaactggtgaaggctattaattttttcaaaggagaagctcatggcagaactcaaacaagaatggatcaacacagctattgaagcgttagataaagcctatgttccttattcccattttccggtaggcgcttgtctcgtaacggaatcaggcaagatttatcaaggcatcaacattgagaatgcatcatttggattaacgaattgtgccgagcgcacagcttttttcaaagcagtatctgaaggagaaaaaacatttacgcatctagtcgtagcggggcacacccccgatcctatctctccttgtggtgcatgtcgacaagtaatggcagaattctgttcccctgatatgccggttacgctagtaggagacaatggtgtgacgaaggcaacgaccgttcgtgcactgctgccttatgcatttactgaaaaagatctataactcatgttcattcagtcagctgactgttgaaaaataaaacaattattttaggaggctttacagaaatgaaaaaagcaaaattatttggtttaggtgctgtcgcactagcagcagggttatttttaggtgcatgcggcaacaacggctctactgattcatccggtggcaaaagctcatcagacacaacaactgcagcattgatcacagacacaggtggtgtagacgaccgttcattcaaccagtcagcttgggaaggactagaaaaatgggggaaagatcaaggactttcacgaggaaatgatggcttccaatatttccaatcttcaaatgaatcagattacatcccaaatattgaccaagcattgaatgctggattcaaaacgatttttggtattggttataaactaaaaccagcgatccaagaacaagcaacaaacaatacaggtacgaactttgttattatcgatgatgtcatcgatggattagataacgttgtatctgcaactttcaaagacaacgaagcttcttatcttgcaggtgttgcagcagcttatacgactgaaacaaacgtagtcggctttatcggcggtgtaaaaggtgaagtaatcgatcgttttgatgctggattcaaagccggtgttgatgcaggtgcgaaagaattaggaaaagaaatcaaagtattgaatcaatatgctggtgacttctctgctccagataaaggacgttcaattgctcaaggtatgtatgcacaaaacgcagatatcatcttccatgcttcaggcggtacaggtaacggtgtattccaagaagcaaaatcattgaacgaatcaggcgacaaaaaagtttgggttatcggtgttgaccgcgaccaatcagacgaaggcgaatacacattaaacggcgaaaagaaaaacttcacattgacatctacactgaaagcagttggaacagtagtagaagatttggcacaaaaatcagcggacggtaaattccctggcggcgaacacactgtttatggattgaaagaagacggtgttggtctaacagaaggacaactttctgacgaagcgaaaaaagcagttgatgaagcaaaagaaaaaatcatttcaggtgacgtaaaagttccagaaactcctgaagaaaactaaaaccatttctatagccttgttagacacatgtttgacaaggctatggtttgattagaacaagaattgttcatttatccaagctgccttgtgacagtttggataagggaacaactccctgaagtaatgtttgtttcaaaagaagaacgctcactaagcgtgaatcttagtcaatcgttgccctagatagaaatcgttaggatgtgaaaaaaaggtggttcaagaaaatattgtcatagaaatgcagaatattaccaaagaatttggaacattcaaggcaaatgacaacatcaatttacaagtaaaggcaggagaaattcatgcgttgcttggagaaaacggtgctggcaaatctacattgatgaacgtgctttccggattattagagccgacatcagggaaaattttgatgcgtgggaaagaagtaaagatcacaagtccgaccaaagccaaccaattagggattgggatggtccatcagcactttatgcttgttgatgcctttactgtaacagaaaacatcgtgttgggaagcgagcctagtcgcgcagggatgcttgaccataaaaaagcacgaaaagagatccaaaaagtttctgaacagtatggattgtcagtcaacccagatgcttacgttcgtgatatttcagttggaatggaacaacgggtagaaattttaaaaacactttaccgaggagcagatgtactgatttttgatgagccgacagctgtattgacccctcaagaaattgatgaattaatcgtgatcatgaaggaattagtcaaagaaggcaagtcgatcattttgattacgcataagttagatgaaatcaaagcagtagctgaccgctgtacagttatccgccgtggaaaaggaatcggtacagtcaacgttaaagacgtaacctcacaacaattagccgatatgatggttggaagaacggtttcattcaaaacgatgaaaaaagaagcgaagcctcaagaagtcgttttgtctattgaaaatctagtggtgaaagaaaatcgtggattagaagccgtgaaaaacttgaacttagaggttcgtgctggcgaagtacttggtatcgctggaatcgatggaaacgggcagtcggagttgatccaagctttgactggtttgcgaaaggcagaaagcggacatatcaagctaaaaggggaagacatcactaataaaaaaccccgaaaaatcactgaacatggtgtaggacacgtgccagaagaccgtcataaatacgggttagtcctagatatgacattatctgaaaatatcgcactacaaacctatcatcaaaaaccttacagtaaaaacggcatgctgaattattcagtaatgaatgaacatgccagagaattgatcgaagaatatgatgttcgaacaacgaatgaacttgttcccgcaaaagctttatcaggcggaaatcagcaaaaagcaattatcgctcgtgaagtcgaccgagatcctgatctgttgattgttgcaaatccaactcgtggactggatgtaggtgcgatcgaatttattcataaacgtctgatcgaacaaagggacaaatacaaagcagtgttactgatcagtttcgaattagaagaaattttaaatgtttcggatcgtattgctgttatccatgaaggagaaattgtcggtatcgttgatccgaaagaaacatctgaaaatgaattaggtctattgatggcgggctataccttagaagaagcacgaaaagagttagaaaagggggctggcgcacatgaatgatcgcagcgaaaaattccgtaatttattagtgcctgtactttcagttgttttaggattgatcttaggcgcgatattgatggctgcttttggttttcagcccatccaaggttattcttctatgctagatgcagcccttggttcgcaaagagggataggtgaaacgttaaggcaagcaacgccgttgatttttacagcattaggtttttctgtagctaactcagctgggtttttcaatattgggctttctggacaagcactttgcgggtggatcgtcagtgtctgggtggcacttgcgtttccagatctgccaaaagttgttttgcttccgttatgcgtgatcttaggtgccttagctggtgcgatggcagcggctgttccaggtttacttcgagcattttttggaacaagtgaagtgatcgtaacaatcatgatgaactatatcttattatacgtaagcacatttgctttacatgaagtgatgcctgaaagctatcgctcaagtttggactcttccaatatgatcagtcaaaatgcctcactgcggttaccatggttaacacaagcttttggcggctctcgcgtaaactcaggattatttttagcaatcatcgcgcttattttcgtttggctgctgatgaagaaaacgactttaggatttgaaatccgttctgttggattgaatccttttgcttctgagtatgcaggaatgagtagtaaacgtacgatcgttttgtcgatggtcatttctggcgctttggcagggcttggcggtgtggttgaaggattaggaacgtatcaaaacttctttgttcaaacgacttcgctatctattggatttgacggaatggctgtttccttgcttggttctggatcagcaatcggtattcttttatcagcgatcttgttcagtattttgaagatcggtggacttggcatgcagacaggagcaggtgttccgtttgagatcgtcaatgtatcgattgctttgattatcttctttgtcgggatcaacttcctgattcgtttcgtcatggctaaagtcttccaagggaaaaaacaagaagagatcgttgcgacaatagaatcgaaaccaacgaatcaaaaccatgaagggggcgaactataatgtcgactatcgaattaattgccttgatccttacttctacactggtttattcaacaccgctaattctaacgtcactaggcggaactttttctgaacgaagcgggatcgtaaacgtagggctagagggaatcatggtcatgggtgcttttagttccatcgttttcaacttgacgatgagtccatcacttggttctatgacaccatggatcgctattttagtgggtggcgtcgtaggtatcctattttctctgattcacgcagtagcaacagtcagtttgcgtgctgaccatattatcagcgggacagtaattaatctgatggcacctgctttaggtgttttcttgatcaaagcatggtatggtaaaggtcaaactgataacatcacgcagaatctggggtatttttctttcccaggattagcagatattccggtcattggaccaattttctttaaaaatacattcttacctgcttattgtgctattttgattgctgtcctagcttgggtgatcatcttcaagacgaaattcggcttgcgcctccgttcagttggtgaaaatcctcaagctgccgacacattaggtatcaatgtatatgctatgcgttattcaggcgtactgatttctggcttgttaggcggtatgggcggtgctgtttttgctcagtcgatttccggtaacttttcagctggtacgatcgttggacaagggttcatctccatggctgctatgatctttggtaagtggaatcctttaggggcaatgggtgcctcattgttctttggttttgctcaaagcttgagtatcattggcgcacaattaccagttatttcttcgattccgccagtattgctgcaaattgctccatatttgctgacaatcattgtgctggttgttttcttagggaaagcttctggtccaaaagcaaacgggaagaactatatcaaatcaaaataatcttttagcgaataaaaagggtgggttacgggaagtgtttttcgtctcgccctttttgttttaaaggcaataaaaataaaaagaaagaaggaataatcatgtttaaacgcgtacatctgatcgtcatggattcagtaggaattggagaagcaccagatgccgataagttcggtgatgttggttctgatacattaggacacattgcgaaagaagcaggattgaacgttccacatttagagcagcttggtttaggaacgatccgtcctcttgaaggtgtggaatcagtgaaagatcatcaaggctatgcgacgaaattagaagaagtttctgtagggaaagatacgatgacaggccactgggaaatcatgggattgaatatcaaaactccatttcgtgtgtttcctaatggattccctgatgatctgatcaaacaaatcgaagaattttctggccgtaaagtcgtatgtaacaaaccttatagcggaacagctgttattgacgattacggtgaacaccaaatgaaaacaggcgatttaattgtatatacttctgccgatcctgtccttcagatcgcggcacatgaagaaatcattcctttagaagaattatatcggatttgccaattcgttcgtgatataacaaaagatgatccgtatatgattggccgaatcattgcacgtccgtacgtgggtgaaccaggagacttcacacgaacaagcaatcgccatgattatgcgttgaatccattcggacacacagtccttgattctttgaaagaagcaggaaaggacgtgattgctgttggaaagatcaacgatattttcaacggacaaggaatcactgaatctgtccgcacgaaaagcaatatggatggcgttgaccagctgctgaaagttatgaaaaacgatttttcaggaatcagctttaccaatttagtagattttgatgcattatacggtcatcgtcgggatgtagtcggctatgcgcatgcgattgaagaatttgacttacgaattccagaattgcttgaagcgatggaagaagacgacttgctaatgattacagccgatcacggaaacgatccgacgtttactggtaccgatcatacgcgagaatatgtaccgttattggtttacagtaaaaaaatgaaagaacaaggggcattgcctcaaggatattattcagatatttcagcaacgattgctgagaactttagtgtttcttcgactgaaaatggcgaaagcttcttgaaattattaaaataatctttttaaataggagaaagcaaatgaccaagttaagcgagatgttacaagaaacgacccagtttatccttgataaaggagtaaaagaaattgattttggtttgattctaggttcaggattaggtgaattagcagatgaaatcgaagatgctgtaatgatttcttatgatgagatcccgttctttcctgtttcgacagtagttgggcatgcaggaaagctagtttatgggtctctggcaggcaagaaagtgttagccatgcaagggagattccactactatgaaggtcattccatgcaaacagtgacctatccagtacgtgtgatggccggactaggggcccattcagtcattgtgactaatgcatgtggtggtgtcaacgaatcatttgtaccaggagatttgatgctgattaccgatcatatcaattttactggtgaaaatcctttgatcggtccgaatgaagatgcaatgggccctagatttccagatatgagtcaagcttatacgcctgactatcaagcaacagcaaaagcagcagcagaaaaactaggtttggatcttaaagaaggcgtatatatgggctattctggaccaacttatgaaacgcctgcggagatccgaatgtctcggacaataggagccgatgcagtagggatgtcgactgttccagaagtcatcgtagcagctcacagcggattaaaagtgttaggaatctcttgtattaccaacttagcagcaggtatgcaagcgaatctgagccatgaagaagttgtagaaacaactcagagagtcaaacaatcttttaaagcattggttaaagaaacattgacattattgtaataggaggaacaataaaatgagtgtgcatattgaagcgaaagaaggcgagatcgccgataagattttacttccgggagatcctttgcgagctaaatatattgcggagacttttttggaagatccagtttgttacaatcaggtacgcggtatgttaggctttaccggcaaatataaaggagaacgtatttctgttcaaggaacaggaatgggaatgccatcagccaccatctatgcccatgaattgatccagtcgtatggtgtaaagaaattgattcgagtaggtacatgcggtgcattgtcaaaagacgtccatgttcgtgatttagtactagcacaaggtgcagcgaccagttcttcgatgatcgaaaaaaatttccaagcctttcattttcctccaatcagtgatttcaatctattactgaaagcatatgagatagctaaagaaaagggctatacggttcatgtaggaaatgttctttcggaagattctttctacaaagatgatttgacagagacgttccaattagctgaacttggcgttttaggagtggaaatggaagcagcggctctttattacttaggcgcgaaataccatgtgcagacattaagtttgatgaccgttagcgaccatttgatcaccggtgaagaaacaacagctgcagaacgtcaatctacgttcaatgaaatgatcgaagtaggattggaaacagcgatagcagaataagaaggaaatgaaaaagctgccctgcattaagtaataagaacatccaagcaaaaatagctcctcatgtttttgacttggctggacttattattgcaaatgtaagcttttgaacaccgtttaccaagaggttgtgaatctgccgtttaactctgagtcacaaggaacaatttcaaaaaacagcttttcatgtttgatgaatattgtgacttgtgaccgagaagttggcaggagaaaaccgtttatacgaaaaaagggactgtgacaaatcgtgtcacagtcccttttttatagtgttttttataggtagtattttttagcaactgttaagtcatcatttaattcataaacaagtggttgacctgttggaatttcaagatccatgatgtcttcgtcagagataccttcgatatgtttagctagggcgcgtaatgagttaccatgtgcagctactaaaacagttttgttgtctagtaatgctggagcaatttcatcttgccagaatggcaaagcgcgttctaatgtcactttcaagttttctccaccaggaatatcgcgtttgtctaacattgcgtaacgacggtcatttgctgcagaaccttcgtcagtttcttccattaatggaggaagagtatcgtaagaacgacgccagatgtgcacttgttcgtcgccgtatttttcagctgtttcttttttgttcaaaccttgtaatttaccatagtgacgttcgtttaagcgccatgatttgatttgtggtacccaaagttgatctgaatattctaagatcaagttacatgttttgattgcacgagttaaaacagaagtgtaagcaacatcaaattcgattccagcttctttgattttgcgtccgcccttcttttgcttcttcgattccttctggtgctagatttacatcagcccaaccagtaaattggttcaatgcattccattcactaagaccgtgacgagaaaaaactaattttggcatgtttagctctccttttaagataggtttatatttctgaaattttcagttctgttttattgtacaattttttggaagagatttccatcgaaaaattagataagattctatgagaaaacaagtagagaatataaaaaaacgaacagtgcccacgcaactgttcgtttttaggtattagatgcataattgctcgatttctttttcaggtaaattgatatatttataacatgttccaactgaaacaccgcattttgaagaaataaattggatcgtttcttttttttcataatagagacgtcggatttttttgatcgtttttgcatcgatttttggtcttccgccgatttttccttttttacgagcttcatctaatccaactaatgtacgttctttgatcaatgcgcactccatgtttgctaggttttccattaattggaaatagatttttcccatttcgcgcgtatcgattccttcatcaagactaatcaagtgcagcccgcgatctttgaataattgcgtgagttctgttaattgccgcgtagatttgcctaatcgatgaagttggcaaatgactagtgcatcgccttgttgcatgtcagcgatcactgactccaaatgaacagcagtagaatcattttgttccacttcatatgtctcatggaaaatttcttgacaaccaaagtcagataattgatcaacctgagttgttaaatcaacgtcatttatggttgtgcgtgcataaccaataattttcatggtgattcctttctagcagtgattttctaactggatataacagtaaaaatgtagcataaagtacgtcaaaaagatagttttttcgcaaattttccgctgtctttttttattggatgatcaagcagtttttctttatttacgacggattgcgtcaagaatctcaacgcctttttctgagccgacaactactttagaaaccatgtttaggaaaagcccatgttctactaccccaacaagttcatctaaataggtagctaagctttctggctgttcgatgacttctagatgcagatcaatgatgtaatgaccaccatctgtggttaagacttctccgttttcgtctgtacgcaagacgggttggaatcttttttcttcaaaaatatgaagtagctgttgggagccataagggatcacttcaactgggagtgggaacttcccaagtttatcgactaatttagaagaatcaacgatccaaatcgtttcttttgagtacgtagcgactattttctcgaaaagcaaagcagcgccgccgcctttgatcccttgaaaatcagcactgatttcatcagcaccgtctattgtcaaatcgactacggggacttcatcaatactctttaacggtattcctaatttttccgcttgttcttttgtcgcatttgaagtagtaactcctgtgatacgtaaaccttcttcacgcatacggcgaccaatctcttctaccatataataggcggttgaaccggtcccgagacctacgatcatcccgtcctttacgaatttcgcggcttcaatgccagctaattgttttaaattcatctttgcgtccacctttttttagtttgagcatcgtgctttcctcactattttagcgtgatttacggtaaaaagataccattcttttttattccaataaagctttttcaaaaaaaattgcatctcttgttgacatgttttttcattcgtgatattctaacaaaggtgctttatctacaggtttctgtgaagaaacgtgctgactgtttatcaaagcatatttgataaggatgcagacattgcatttattttttatcacaaaaaaagaaccacctggatgtgtggaactagacgcaaatcgtgggaaggaggaaacaaggaatgcctacaattaaccaattagtacgtaaacctcgtaaatcaaaggtggaaaaatctaattcacctgctttgaacaaaggatataacagctttaagaaaactcaaactaacgtaaactcacctcaaaaacgtggggtagcaactcgtgtgggtacaatgacacctaaaaaaccgaactcagctttacgtaaatatgcacgtgttcgtttgtcaaacttaattgaagttactgcttatatcccagggattggtcataacttacaagaacacagtgttgtattattacgcggtggtcgtgtaaaagacttaccaggggtacgttaccatatcgttcgcggtgctttagatactgctggtgttaacgaccgtaaacaaagccgttctaaatacggaactaaaaaacctaaagcttaattttaattattaaacaaatgaaacttgcttctactatatagaagtaattactatgaacaatatttcggaaggaggagttacggatgccacgtaaaggtcctgttgcaaaacgtgatgttttaccagatcctatttataactcaaaattagtaactcgcttgatcaaccgtgtaatggttgacggaaaacgcgggattgcagctaacattatctataatgcctttgacttgatcaaagaatctacaggtaacgatccattagaagtgtttgaacaagcaatgaaaaacgttcaacctgttcttgaagttaaagcacgtcgtgttgggggttcaaactaccaagtaccagttgaagttcgccctgaacgccgcgttactctaggtcttcgttgggtagtaaactacgctcgcttgcgcggtgaacacacaatggaagaacgcttagcaaaagaaatcatggatgctgcaaacaacacaggtgcttctgttaaaaaacgtgaagacactcataaaatggctgatgccaaccgtgcgtttgctcactatcgctggtaagattctctctgtttggtcggcttttataagtcgacctcagatagtgtccttatttttagcaactagatagtaaagagaggagaaacaaggagaatgaccagagaattttctttacaaaacactcgtaatatcggtatcatggcccacatcgatgctggtaaaacgactgctactgaacgtatcttgtactatactggtaaaatccataaaattggtgaaactcatgaaggagcttcacaaatggactggatggaacaagaacaagaacgtggtattacgatcacttctgctgctactacagcacaatggaagggtcaccgaatcaacatcatcgacacaccaggacacgtagacttcacagttgaagttgaacgttcattgcgtgtacttgatggtgctgtaactgttcttgatgcacaatcaggtgttgaacctcaaactgaaacagtttggcgtcaagcaacaacttatggtgtacctcgtatcgtatttgcaaacaaaatggacaagatcggtgctgacttcttatattcagtatcaactttacatgaccgtttgcaagcaaacgctcacccaatccaattaccaattggtgcggaagacgacttcacaggaattatcgaccttgtaacaatgaaggctgaaatgtatacaaacgatcttggaacagagatcgaagaaacagaaattcctgaagaataccgcgaattagctgaagaatggcgcgaaaaattggttgaagctgtagctgaaactgatgaagaacttactttgaaatacttagaaggtgaagaaatcactgaagctgagttaaaagaaggtatccgccgcgcaacagttaacgtagaattctacccagtactatgtggttcagcatttaagaacaaaggggttcaattactattggacgctgttcttgattacttgccatcaccgttagatatcccagctatcaaagggattgaccctaaaactgatgaagaagtagaacgtcctgcagacgacagcgctcctttctcagctttagcatttaaagttatgactgacccattcgtaggtcgtttaactttcttccgtgtgtactctggtgttttacaatcaggttcatacgtacaaaacgcaacaaaaggcaaacgtgaacgtgttggtcgtatcctacagatgcatgccaactctcgttcagaaatctctgaagtttacgctggagatatcgctgctgctgttggtttgaaagacacaactactggggacacactatgtgatgaaaagagtctagttattcttgaatccatggaattcccagaaccagttatccaagtcgctattgaacctaaatcaaaagctgaccaagataaaatgggtgtggctttacaaaaactatctgaagaagatcctactttccgtgctgaaacaaacgtggaaacaggcgaaacaatcatcgctggtatgggtgaacttcacttagatatcatcgttgaccgtatgcgtcgtgaattcaaagttgaagctaacgtaggtgcgcctcaagtatcttaccgtgaaactttccgtgctggcactcaagccgaaggtaagtttgtacgtcagtctggtggtaaaggtcaatacggtcacgtatggattgaatttacaccaaatgaagaaggtgctggtttcgaatttgaaaatgcgatcgtcggtggggttgttcctcgtgaatacattccagctgttgaaactggtttgaaagatgctatggaaaatggtgtcttagctggctatccattagtagatatcaaagctaaactttacgatggttcataccatgatgtcgattcaaatgaaactgccttccgtgttgctgcttctatggcattacgtgcagcagctaagaaagctaatccagtaatccttgaaccaatcatggctgtagaagttgttatccctgaagattatttaggtgatgttatgggtcacgtaactgctcgtcgtggacgtgttgaaggtatggaagctcgcgctggcggccaacaagttgttcgtgcgatggttccacttgctgaaatgtttggttatgctacaactcttcgttctgctactcaaggtcgtggtacatttacaatgacatttgaccactacgaagatgtaccaaaatcagtacaagaagaaatcattaagaaaaacggcggaaaagctgaataatttcttgaaaccggatagtcctgcaaagagattatccaaagagactatatttttaatatagtttcgtgtaaaataattatcgatgatatgggcatgtggtgtaccttgtgtacatcatatacctatcagacaaataaaaaatatattgtatttttaggaggacattttaaaatggcaaaagaaaaatttgaccgttctaaaccacacgttaacattggtactatcggacacgttgaccatggtaaaactacattaacagctgcaatcacaactgtactatctaagaaaaacggcggccaagctatggcttacgatcaaatcgatggtgctccagaagaacgcgaacgcggaatcacaatctcaacagctcacgttgagtatgaaacagatacacgccactacgctcacgttgactgcccaggacacgcggattacgttaaaaacatgatcactggtgctgctcaaatggacggagctatcttggtagtttctgctgctgacggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggatcagctttgaaagctctagaaggcgacgcttcatacgaagaaaaaattcttgaattaatggctgcagttgacgaatacatcccaactccagaacgtgacaacgacaaaccattcatgatgccagttgaagacgtgttctcaattactggacgtggtactgttgctacaggtcgtgttgaacgtggacaagttcgcgttggtgacgaagttgaagttgttggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcatactccattcttcactaactaccgtccacaattctacttccgtacaactgacgtaacaggtgttgttgaattaccagaaggaactgaaatggttatgcctggcgacaacgtaacaatggaagttgaattaatccacccaatcgctatcgaaaacggtactaaattctcaatccgtgaaggcggacgtacagttggtgccggtgtcgttacagaaatcaaagcttaattcacttaagttttaaagtaaagcaacatttattcggacgtaatcgctcggaacgaaggtcttaggatctttgttccgagcttttttatttattgcaggatcaggaaaaaagacaggagtattataaatagaagaaacacgaaataaaagagtcagtattttctaaatgaaactttatgaaaacaaaatgttttttacaagaaaaagccttgctttgtgagtttatatatattataatgacaaaggtgcgtttactttagtgaattgcacagacgtaatcagaatgatttcgtcggctaagaaacgagaggttgcgacacgcccggacgctttgccacgaacgagcgtgacggaaattttcgtggagctatgtctacttttcaaaataggcgaaggagggaacaagatggcaaaacaaaaaattcgtatccgtttaaaagcgtatgaacaccgtattttagatcaatcagcggataaaatcgtggaaactgcaaaaagaactggagctagcgtgtctggtccaattccattaccaactgaacgcagtctttacacaatcatccgtgcgactcataaatacaaagattcacgcgaacaattcgaaatgcgtacacacaaacgtcttatcgacattgtgaacccaacaccaaaaactgttgatgctttgatgaagctagacttaccatctggtgtaaacatcgaaatcaaattataaaactaaaacaaaaataatggaggtgtactcatgaccaaaggaatcttagggaaaaaagtgggaatgacacaaatcttcactgaatctggtgaattaattccagtaactgttgtagaagctactccaaacgtagtactacaagtgaaaacaatggaaacggatggctacgaagctattcaagttggttaccaagatatgcgtgaagttttatcaaacaaacctgcgaaaggtcatgttgcaaaagcaaacacggctcctaagcgcttcattcgtgaattcaaaaatgttgagctaggagaatatgaagtaggaaaagaaattacagtagatgttttccaagcaggagacattattgatgtaacaggtactacgaaaggtaaaggattccaaggggttatcaaacgccacggacaaagccgcggaccaatggctcacggttctcgttaccatcgtcgtcctgggtcaatgggtccagttgcacctaaccgtgtatttaaaaacaaacgtcttgctggccgtatgggtggcaaccgcgtaactatccaaaacttggaagttgtacgtgtcgatgcagaaagaaatgttatcttgatcaaaggtaatgttcctggagctaaaaaatctttaattactatcaaatcagctgtgaaagctaaataattgtaggaagaaaggaggaactaaggaatgccgaatgtagcattattcaaacaagatggaagccaaaacggtgaaatcacacttaacgaagaaatcttcggaattgaacctaatgaaagtgttgtttacgatgcaatcgtaatgcaacgtgcgtcattaagacaaggaacacacgcggttaaaaaccgtagcgctgttcgcggcggcggacgtaaaccatggcgtcaaaaaggaacaggtcgtgcacgtcaaggatctatccgctcaccacaatggcgtggaggtggcgtagtctttggaccaacaccacgttcttacagctacaaacttcctaaaaaagttcgtcgtttagcaatgaaatctgtattgtcagaaaaagttgctgaaaacaacttggtagcaatcgaaggcttgaacttcgacgcaccaaaaacaaaagaattcaaacaagttcttgctaacttatctatcgactctaaagtattggttgttctagaaaaaggtaacgactttgctgctttatcagcacgtaacttaccaaacgtttctgtagtaacttctgataatgtgagtgtgctagacgttgtatcaaatacaaaagtgttagcaacacaaactgctcttactcaaattgaggaggtgcttgcataatgaacttactagacgtaatcaaacgcccagtgatcactgaaaaatcaatgcttgccatggatgacaagaaatacacttttgaagtggacactcgcgcaaacaaaactttagtaaaacaagcggtagaagctgcttttgacgttaaagtcaaaaacgtgaacatcgtgaacgtacgtgcgaaattcaaacgtatgggcaaatatgcaggatatacaaaaaaacgtcgcaaagcgatcgttacattgactgaagattcaaaagaaatccaattattcgaagctgctgaataagcactaatagataactcattaaattaggagggaaaaacgtggcgattaaaaagtacaaacctacctcaaatggtcgtcgtaacatgacaggttctgattttgctgaaatcacaacatcaacacctgaaaaatcattgttacaaccattgaaaaaccatgctggacgtaacaacaacggccgcatcactgtacgtcatcaaggtggcggacacaaacgccaatatcgcgtgatcgacttcaaacgtaacaaagataacgttgttgcaactgttcaaacgatcgaatatgatccaaaccgttcagctaacatcgcgttagtacactatgaagatggatgtgaaagcttacatcttagcacctaaaggactagaagtgggtatgaaacttgtttcaggtccagaagcagatatcaaagtcggaaatgctcttccattagaaaacattccagttggtactgttatccacaacattgaaatgaaacctggtaaaggtggacaattgatccgttctgctggtacaagtgctcaagtacttggtaaagaaggcaaatacgtattgatccgcttgaactctggtgaagttcgtatgatcttagctgcatgccgtgctacaatcggttctgtaggtaacgaacaacacgaattaatcaacatcggtaaagctggacgctctcgttggatgcgtaaacgcccaactgtacgtggtagcgtaatgaaccctaatgatcacccacacggtggtggtgaaggtaaagctcctatcggacgtaaagcaccagtttctccttggggtcaaccagctcttggttacaaaactcgtaacaaaaaagctaaatcagacaaacttattgttcgtcgtcgcaaaaataaataattactttgaccatgtgtcgcacattttgagaggaggttcaccatgggtcgtagtttaaagaaaggaccttttgtcgatgagcatttaatgaaaaaagttgaagctcaagcaggggttgaaaagaaaaaagttatcaaaacttggtcacgccgttcaacagttttcccaagttttgttggatataccatcgcagtttatgatggacgtaaacatgtaccagtttacatccaagaagacatggtaggacacaaattaggtgaatttgcacctacaagaacttatcgtggacatgctgctgacgataagaaaacgaaacgctaatttgaggggaggataaatccaaatggcagaacaaatcacatcagctaaagcaactgcaaaaacagttcgcacttcacctcgaaaagcccgtttagtaattgaccttatcagaggtaaaagtgtcgcagatgcaatttcaatcttgaaattcacaccaaacaaatctgctggaatcattgaaaaagtattgatgtcagcagttgcgaatgcagaaaataactttgacttagatgttgaaaacttggtagtaagcgaagcttttgttaacgaaggacctacaatgaaacgtttccgtcctcgtgcaaaaggatcagcttctccaatcaacaaacgtacaagtcatatcacggtagtcgtatcagaaaaataaggagggataatcagtgggtcaaaaagtacatccaattggaatgcgtgtaggcatcatccgcgactgggatgctaaatggtatgctgaaaaagagtatgctgagttcttacacgaagatttaagaatccgtaaatttatttcaactaaacttgctgatgctgctgtatcaacagttgaaatcgaacgcgcaacaggtcgcgtaaacatttcaattcacacagctaaaccaggtatggttattggtaaaggcggttctgaagtcgaaagcctaagaaaagaattaaacaaattaactggtaaaagaatccatatcaatatcgtggaaatcaaaaaaccagatctagatgcaaaattagtaggtgaaggaatcgcacgtcaattagaaaaccgtgttgctttccgtcgcgctcaaaaacaagccatccaacgctcaatgcgtgctggcgctcaagggatcaaaactcaagtatctggtcgtctaaacggagcagatatcgctcgttcagaaggatactcagaaggaactgttcctcttcatactttacgtgcggacattgattacgcatgggaagaagcagatacaacatacggaaaactaggagttaaagtgtggatctatcgtggagaaattcttccaactaaaaaaaacactgagaaaggagggaaataatcatgttagtacctaaacgtgtaaaacaccgtcgtgaattccgcggaaaaatgcgcggggaagctaaaggcggaaaagaagtagcattcggtgaatacggtttgcaagctgttgattcacattggatcacaaaccgccaaatcgaagctgctcgtatcgcaatgactcgttacatgaaacgtggtgggaaagtatggattaaaattttccctcacaaatcttatactgccaaagcaattggggtacgtatgggttctggtaaaggggcacctgaaggatgggttgcaccagtaaaacgtggtaaaatcatgtttgaaatcgcaggcgttcctgaagaagtagctcgtgaagcgttacgtctagcttctcacaaattaccaatgaaaactaagatcgtaaaacgtgaggaaatgggtggtgaatcgaatgaaggttaaagaaatcagagaattaaccactgccgaaatgcttgatcaagaaaaacaattaaaagaagaattgtttaatcttagattccaattagcaacaggtcaattagaaaacactgcacgtattaaagaagtacgtaaatcgattgcacgcatcaaaactgtgttgcgtgaacaagctaagtaattatggaaggaggccattaagcgtatgactgaaggaagaaatcaacgcaaagtttatcaaggtcgcgtggtttcagacaaaatggataaaacaattaccgttgctgtcgaaacaaagaaaaaccaccctatctatggcaaacgcatgaactattctaagaaatacaaagtgcatgatgaaaacaacacagcaaaagttggcgacatcgtgagaattatggaaactcgtccattatcagctacaaaacgtttccgtttgttggaagtagtcgaagaagcagttattatctaataacacgagattttcctatatagattgaatgcaaaatctgaaaggaggatacacaacgtgatccaagcagaaagtcgtttaaaagtcgctgataactcaggcgcacgtgaaattttgacgatcaaagtccttggtggatctggtcgtaaaactgctaacatcggtgatgtgatcgttgctacggttaaacaagcaacgccaggtggggttgtcaaaaaaggtgacgtcgttaaagccgttatcgttcgaacaaaatcaggagctcgtcgtacagacggttcatatattaaatttgatgaaaatgctgcagtgattattcgtgatgataaaagccctcgtggaacacgtatctttgggccagttgcacgtgaactacgtgaaaacaacttcatgaagatcgtttcactagcaccagaagttttataatcttgagacacttatcaaaggaggtgcgaaacagttatgtttgttaaaaaaggcgataaagttaaagttatcactggaaaagacaaaaacaaagaaggcgttgtactagcagcgttcccgaaaaaagataaagttattgtcgaaggtgtaaatgtcgttaaaaaacaccaaaaaccttctcaagctgctcctcaaggtggaattgttgagatggaagcgccaattcatgtttctaacgtgatggtggttgactctactggtgtagctggccgagttggctacaaagaagtagacggcaaaaaagtccgtgtttctaaaaaaaccggtgaagttttagataaataaaagtttaaggaaggagggtcttactgaatgaaccgcctaaaagaaaaatatcttaaagaagtaactccatcattgatggaaaaatttaactatagctctgttatgcaaacacctaaagttgaaaaaatcgtcatcaacatgggtgttggtgatgcggtatcaaacgctaaaaacttagataaagcagttgaagaattaactttgatcactggtcaaaaaccaatgattacaaaagctaaaaaatcaatcgctggattccgtttacgtgaaggaatgccaattggtgcaaaagttacattgcgcggagaaagaatgtacgaattcttagacaaattggtttctgtttcactaccacgtgtacgtgacttccatggtgtaagtaaaaaagcctttgacggtcgtggaaactatactttaggtattaaagaacaattgatcttcccagaagtagattatgatttagtagataaagtacgtggtatggacatcgttattgtaacaacagcaaactctgatgaagaatctcgtgagttgttgacacaattaggcatgccattccaaaaataattaaaggaggcgaactacgtggctaaaaaatcaatgattgctaaaaacaaacgtcctgcaaaattttcaacacaagcttatactcgttgcgaacgttgcggacgtccacattcagtttatcgtaagttccatctttgccgtatttgcttccgcgaacttgcctataaaggtcaaattcccggcgtgaagaaagctagctggtaaaaagtaaattcgcataagaaggaggtaaaagatcaatggtcatgacagatccaattgcagattttctaactcgtatccgtaacgcaaacatggttaaacatgagtctttagaagtacctgcatcaaaaattaaacgtgacatcgctgaaatcttgaaacgtgaaggtttcgttcgtgatgttgaatacatcgaagatgacaaacaaggcgtgatccgtgttttcctaaaatttggtaaaaacggcgaacgtgttatcacaaacttaaaacgtatctctaaaccaggtttgcgtgcttatgtcaaagctgacgaagtaccaaaagtattgaacggtttaggtatcgcaatcatttcgacttctgaaggtgttgtcactgataaagaagctcgtgaaaaaaatatcggcggcgaagttatcgcttacgtatggtaatcaagtagaatctacaaggaggtgtctttaagtgagccgtatcggaaataaagtcgttgttatccctgaaggagtaacagttactcaagacggaaacaacgttacagttaaaggaccaaaaggtgaattgactcgtactttttcagcagatatcaaaatgaatatcgaaggaaacgaagtaactttcactcgtccaaacgacagtaaagaaatgaaaacaattcatggaacaactcgtgcgaacttcaacaacatggttgtaggtgtcagcgaaggtttccaaaaagcgttagaactaatcggggttgggtaccgtgcacaattacaaggatcaaaacttgtattgaacgttggttactcacatccagtagaaatcacaccaccagctggagtaactgttgaagtaccagctaacacacaagtaattgttaaaggtgcgaacaaagaagaagttggcgaattagctgcaaacattcgtggaactcgtcctccagaaccttataaaggtaaaggtattcgttatgttggcgaatatgtacgccgtaaagaaggtaaaactggtaaataatcgtttagaaaaattgcatagaagccagcagcaggaaaaaggcatttggctgaagtttaccttcaaaaaaatacatttttacttgtgccgcagcttctatttttcgaaacgtatttactgcttgaaatagtagtacaataaaaataaagaggtgacaattgtgattacaaaaccagataagaacaaaacacgtcaaaagagacatcgtcgtgtacgtaacaatatctctggtactgctgagcgcccacgcttgaacgtttttcgttctaacaaaaacatctacgctcaaattattgatgacgtagcgggtgtaacgctagcaagtgcctctaccttggataaagaaatttcaggtggaacaaaaacagaagcagcacaagctgtcggtaaactagttgctgaacgtgcagctgaaaaaggcattaaagtagtagtctttgaccgtggtggatacctttaccatggccgtgtgcaagctttagctgaagctgctcgcgaaaatggactagaattttagaagaaggaggaataccattcatggtttatatcgatccaaaacatttggaattagaagaccgcgttgttgcaattaaccgtgtaacaaaagttgttaaaggtggacgtcgtctacgttttgctgctttagttgttgtcggtgacaaaaacggacacgtaggatttggtacaggtaaagctcaagaagttcctgaagcaatccgtaaagcaattgaagatgcgaagaaaaacttagttgaagtacctatggttggttcaacaatcccacacgaagtaatcggtgcttttagtggtggtagaatcctaatgaaacctgctgtagaaggttctggggttgctgctggtggaccagttcgtgccgtattagaattagctggggtagcagatatcacttctaaatctttaggctcaaatacaccaatcaacgttgttcgcgcaacagttgaaggtttgaaacaattgaaacgtgcagaagaagttgcagaacttcgcggcaaatcagttgaagaattaatcggataaggaggacaacaataatggctgaattaaaagttactttaaaacgcagtattatcggacgtcctcaaaaccaacgcgatacagttaaagcgttaggtcttacaaagattaacagttcagtggttaagccttctaatgaagcaattaaaggcatgatcaatactgtttctcacctagtggacgttgaagaaatttaatttagaaaaatcataactagaacattaaggaggtgccaaacctatgaaacttcatgaattaaaacctgctgaaggttcacgccaagtacgtaaccgtgttggtcgtggtacttcatctggtaacggaaaaactgccggacgcggacaaaaaggacaaaaagctcgttcaggcggcggtgtgcgtttaggatttgaagggggacaaacaccattgttccgtcgtttaccaaaacgaggattcacaaacgtgaaccgtaaagactatgcagtcattaatcttgatgtattgaaccgctttgaagacggagctgaagtaactcctgttgctttagttgaagctggaatcgtgaaaaacgaaaaagctggaatcaaagtattagctaatggggaactaaacaagaaattaactgtgaaagcagcaaaattctctaaagcagctcaagaagcaattgaagcggctggtggatcaatcgaggtgatctaatgtttagactattaaaagatgcttttaaagtaaaagacattagatcgaaaatcctatttactgtatttgtgttgtttgtatttcgcctaggtgcacatattactgtaccaggcgtaaatgctgcttcattgcaaaacctttcttctttgccatttttcaacatgttgaacttggtaagtggtagtgcgatgcaaaacttttccattttctcaatgggggtttcaccatacattactgcttctatcgtcattcagcttcttcaaatggacatcgtgcctcgatttgttgaatggtcgaaacaaggggaagttggtcgtaaaaaactgaatcaagcgactcgatatctgacattagtattggcatttatccaatctgtcggtatcactgctggattcaatcaatacgctcaattaggtttcgtgaataatcctaacgtagcaacttacgtaacgatcggtttgattctaacagccggtacgatgtttgttacttggctaggagaacagatcacagaaaaaggtatcggaaatggcgtatcaatgatcatttttgcaggtatcatttctagattgcctgaaagtatcagagaaatttatgaagattactttataaatattgatccttcagacatatggaaatctgctatttttgtggccattttactagtagcggtcttgttgatcgtgacattcgtaacatttttccaacaagctgaacgcaagatcccgatccaatatacgaaacgcgtagctggcgcgcctacaagcagctatctgccgttgaaagtaaatgcagctggagttattccagttatctttgctagttcgtttattgctacgccaaatgctgttttacaagcattgagcggtagattcggttctgaaaactggtacaaagtgatgatggagatctttaactataatacagcacctggtgctacgatttatacgattctgatcgttgccttcactttcttctacgcctttgttcaagtaaaccctgagaaattagcggaaaacttgcaaaagcaaggaagttatataccaagcgtacgccctggtaaggggactgaagagtatgtctcaagattactgatgcgtttaagtacagttggtgcagtcttccttggtttagtggcattgcttccaatcattgctcaaatggtttgggatcttccacaatcaatcggattaggcggtacaagcttactgatcgttatcggtgtagctttagaaactgcgaaacagttagaaggcttaatgctgaaacgtaaatatgttggattcattgagtaagaaagcgtgttgaggtttcccctcaacacacgttctcacacatttattaggagggaaaacaatgaacctcattttaatggggctgccaggcgcaggtaaaggaacacaagctgaaaaaatcattgatgcttatggtattccgcacatctcaacaggagatatgttccgcgcagcgatgcaaaacgaaacagctcttggcctggaagcaaagtcttatatggataaaggtgcattagttcctgatgaagtaacaaatggaatcgtgaaagagcgactagctgaaccagatacagagaaaggcttcttattagatggctttccacgtacgctagatcaagcaaaagctctggacgcaatgctaaaagatttgaataaaaaaattgatgctgtcatcgatatccatgttggtgaagaaatcttggtcgaacgtctagccggccgatttatctgcagcaattgtggagcaacttaccataaaattttcaaccctacaaaagttgaagacacatgtgatcgttgcggtgggcatgaattctatcaaagagaagatgataaacctgagacggttaaaaatcgtctggctatcaacatcaaaaatagtgaaccaatcttggcttattataaagaacaaggtttgctaaacactattgatggtgctcgtgaaatcgatgctgtatttgcagatgtacaaaaaatcattgaaaaatagcacgattgcccgtagccgacttgcattatgcagttactcttgtcaagttcaataaattatgatagaatatgtcagtccgacttctagagaatcctctagatgatccattttgagaattttgaggtgggaactgcagtttccgccattttatcgtgtgaaaatgcgaaacaagtacaaggaggtactgtgcgtggcaaaagaagatatgattgaagtcgaaggtacagtcgtcgaaactttgccgaatgcaatgtttaaagttgaactagaaaacggacaccaagttcttgctactgtttcaggtaaaattcgtatgcattacatccgtatcttacctggtgacaaagtaacggttgaattgtctccatacgatcttaaccgtggccgtattacttatcgctttaaataattgtactccgtaaaactacaggaggtattatcatgaaagtaagaccatcagtaaaaccaatgtgcgaacattgtaaagtaattcgtcgtaaaggacgcgttatggtgatttgcccagcaaatccaaaacataaacaacgtcaaggataattggaggtgctataaatatggctcgtattgcaggagtagatattcctcgtgataaacgtgtagtagtttcacttacttatatctatggtattggtaacactactgctaaaaagatcttagctgatgctggtgtatctgaagatgttcgcgttcgtgaattaacgaatgaacaaacagatgctatccgtgcagaagtagataaattaaaagttgaaggggatcttcgtcgtgaagtgaacttgaacatcaaacgtttgatggaaatcggttcttaccgtggaatccgtcatcgccgtggattgcctgttcgtggacaaaacacgaaaaacaatgcacgtactcgtaaaggcccagctcgcgctatcgctggcaagaaaaaataattcttaagtgaaggaggttaaaacttcatggcagcaaaaaaagtgaatcgtaaacgccgtgtgaagaagaatatagaagcaggtattgcacatatccattctacattcaataacactatcatcatgatcactgatactcacggaaatgcattagcgtggtcatcagctggttcattaggtttcaaaggaagcaaaaaatcaactccttttgccgctcaaatggcagcagaaactgctacaaaagcagcaatggaacacggattaaagactgttgaagtaacagttaaaggacctggttctggacgtgaagcagcaattcgttcattacaagctacaggtttagaagtgactgcaattcgtgacgtgactccagttcctcataatggtgcccgccctccaaaacgccgtcgtgtttaatgagtgccgctcattttgagttttatcagtaacgtcattgaacaagacacttttcgttttgaaaggggtaaagataagaatgattgagttcgaaaaaccaagaatcgcaaaaattgatgaagaaaaagattatggcaagttcatcgttgaacctcttgaaagagggtatgggactactttagggaattccctacgtcgtattttattatcttctttgccaggtgctgccatcactaatattcaaatcgatggtgtactgcatgaattctctaccatcaaaggtgttagagaagacgtcactcaaatcatcttgaacattaaaggcttagcgctgaaaatgtatggccaagaagaaaaaacccttgaaatcgatattaccggacctgctacagtaactgctggcgatattatcgttgatagtgatgtagaaattcttaacaaagatatgtacatctgtagtgtctctgaaggagctacgttccatgctcgcttaacagtgaaacctggacgtggttatgttcaagcagatgaaaataaaaaagaagatatgccaattggcgttcttccagtcgattcaatctacacacctgttcgtcgtgtgaactatcaagttgagaacacacgtgttggacaccgtgaagattttgataaattgacgatggagatttggacagatggttcaattgaaccgttggaagcaatgagtttgtctgcgaaaatcatgactgaacatttggatatttttgtgaacttaactgatgaagcaaaaaatgctgaaatcatggtcgaaaaagaagaaacacaaaaagaaaaaatgttggaaatgacgatcgaagagttagacttgtctgttcgctcttacaattgtttgaaacgtgcaggaatcaatactgtacaagaacttacaaataaatctgagcctgaaatgatcaaagtccgtaacttaggacgtaaatcattagaagaagttaaagcaaaattgcacgacttaggtttaggtttacgtaaagaagattaaaaccttttacgaaggagggaaaccaacgtgagttatcgtaaactaggacgcacatctagccaacgtaaagcgatgttgcgtgatttaacaactgatttattaatcaacgaacgtattgtgactactgaagctcgtgcgaaagaagttcgctcaactgcagaaaaaatgatcactttaggtaaacgcggagatttgcatgcacgtcgtcaagctgcggctttcgtacgtaatgaagttgccagcgtgcgtgaagaaaatgaggacatcgtcattgaatcagctttacaaaaactgttcaacgatattgcacctcgttacgcagaacgtcaaggcggatacacacgcattttgaagacagaaccaagacgcggtgatggtgcaccaatggttgtcttagaacttgtctaaaatcacactaataacatcactttatagatgattcttttagagtgttatgatgttggaagatatttttccgagtctagctcagcgctgctcctcaagcgaatatcgcttggggagtaagcactcatcataaagtgtttttttataccttcaattacctgtcatgacagatatgtttgaaggcataaaaaaacattttaagcgagaaataattgaaaattttgtctttttttgatagtgttagtaggaactttaggatgaagaaggagtaatcatggagccaattattgaattagaaaagataaattataaataccagccagatgatcttcgccccgcattgaaagatgtctcctttacaattgataaaggtgagtggatcgctattattggacacaatggttcaggaaaatcgacacttgccaaaacgatcaatggattgcttctgccagaatcagggatcgtgaaagtgggaaatcaaatattggatgaagaaaatatttggacgatccgacagatggttggaatggtttttcaaaatccagacaatcagtttgttggttcgacagtagaagatgacgttgcttttggtcttgaaaatcaagggattcccagagaagaaatgctagtgcgtgtgaaagatgcacttgagaaagttagaatggctgagtttgcttcacgcgagcctgctcgtttatcaggagggcaaaaacaacgtgttgccattgccggcgtggttgccttacgacctgatatcattattttagatgaagcaaccagtatgctagatccagaaggtcgtgaagaagtgatctctacgatcaagaagatcaaagaagaaagtcaattgaccgttatatctatcactcatgatattgatgaagcagctaatgccaatcggatactagtgatgagacaaggcgaacttgtccgtgaaggtacaccaaaagaaattttttctgctggtcctgaactgatcgacttaggtctagatctaccatttcctgaaaaactgaagagcgcactgaaagaacgtggggttgatgtgcccagtgaatatatgacagaagaaaggatggtggattggttatggacatccgttttgaacaagtagacttcacttatcagccgaatacaccatttgaacaaagagccttatttgacatcaatatgacgatcaaagaaaacagttatactgcattagtagggcataccggaagcgggaaatcaaccttacttcagcatttgaatgcgcttgttaagccaacaagcggtacagtccatattggagaacgagatattcagccggatacggataataagaatttaaagcccatccgaaaaaaagttggcatcgtctttcagtttccagaagcacagctattcgaagaaacggtagcaaaagacattgctttcggtcctaaaaactttggtgtcagcgaagaagaagcactagtcctagcaaaagaaacattagaacaagttgggctggatgaaagctatttggaacgttcgccatttgaactttcaggagggcaaatgcgtagagtagcaatcgctggtgtgcttgccatgaggccggaagtacttgtattggatgaaccaacggcaggacttgatccccagggcagaaaagaaatgatggagatgttttggcgtcttcataaggaacagcagatcactattgtattagttacgcatttaatggatgatgtagccaattttgcagattatgtctatgtgttggaaaagggacgaatcgttaatagcggggagccgcaagaggtctttcaaaacattgaatggctaaaagaaaaacaactaggcgtacctactgccaccgagtttgcagaagaattaatggctaaagggatgaactttgctaccttgcctttgacagctgaagaattagcagacgctatcgtccattatgctggaggaaatgcccatgatgaataaattgatatttggtcgttatatgcctggagattccttgatccatcgattggatccccgagctaaattattagccagtttttattttatcggaatcatttttttagcaaataattgggaaacgtaccttttgttggcatttttcacattactttctgtcttcttgtcaaaagtagatttgaaattttttatccgaggcattcgcccattgatctggctaatcctcttcactgtagctttgcaggtcttgtttacaagtggcggagaaacttattggagttggggtgttttccatatcactgaatttggtgtgatgaacggcctctttattttctgtcgattcgtgttgatcatttttatgtcgactctactcacgcttactacaccgcctttggaattatcggatgcgattgagtacttgcttcgtccattgaaagccgtacggttcccagtccacgaaatttcattgatgctgtcgattgctcttcgttttgtgcctacattgatggacgaaacagaaaagatcatgaacgctcagcgcgctcgcggtgttgattttggtgaaggaaacctagttcagaaaatgaaagcagtcattcctttgctgattcctttatttgtcagcagcttcaaccgtgcggaagatcttgcgactgctatggaagcaagaggctacaaaggtggggaaggaagaacgaaatatcgtgtattgcattggcataatagagacacgatggttatcattgcttttgtattattaactgtgctactgatctttttaagaggataaacgttcagtgggccgctatctattcttttcttgctgatctgtttgcaagaaaggatgcaagcagtgtatgacaagaaatattagggtctgtggcagactaaggtcacaggcctctttcttttatctgaaaagaaagaacgaaaaaattttatagaaaaatcattattccagataaccttttaggaacaaaggagagaaaaacatggtacgttacaaagcaatcattgcgtacgacggaacaaattttaatggattccaaaaacagccaaatgggcgtactgttcaagaagaagtagaaaaaacattacaaaaaatggcaaatggaaaagaaatcacggtctttggttcgggaaggacagatgccggagtacatgcgatcgggcaagtaatccattttgattatccagaggagcgtccgttagaacgaatgcgtttcgcgctagatacccagtcaccagaggatattgctgtaagacaagtagaaattgtttcagaagacttccacgcaagatatttggtcaaagaaaagacgtatcaatttcgagtggatatagggaaaccacgcagtccttttcgacgccattatgcaagttattttccttacccacttgatttggaaaaaattcagcgggcgcttcctgatttattagggactcacgatttcacctctttttgtgcatcaggaagctcgatagaggataaaatacgtacgatctacgaggctaagatggaggtaaatgaaacaaaagacgaattgttgtttacatttaggggaaatggcttcttgtataagatgatacggatcttagtaggaacgcttttgaaaattggcaatggccgattgcctgaagatagtatcccagatattattgcgaaaaaagatcgtaatgcagcaggacctacagcacaccctgaaggactttatttgtatgaagtgaaatatgaataagaggttatgatagaagtggtcagcttcaagaaataagaaggtatttacgaaaattacttctcaaaattttgcaaaatttcggcttattttcgaagaagctacttctggaacaccgtttaaggaagaggtcgtgaaatcagcgttttgacctgagtattagagaaacaaacgggaaaatagctcctcatattttgccgtttgttgagctaataccgaaggtcagctgattgaacaccgtttaagaaagaggtcgtgagcctgtcatttaactctgagtcacaaagagcaatttcaaaaaacagcttctcatctttgatgaatatcgtgacttgtggacgaggcgttgataagtgaatcatctttttgttacctattttttctgtaaccaaaaaacgatggaacgttgttttgattgcccttggtgcggacagtctgaacaggttccatcgtttctttattttctacgtcttcttctgtgtgtgtttcgtggttgttcttctattgctggatcaatcgtgccataaaaggggcgattgcggtcaaggtaccagacataaagaataaacaatgcaatacataggacaaaaaggattgcacctatcgtaaatccttcaggcaagtaactgaaagtgacagtatgtttacctgctggaacttttatcatcaagaatgcgtctttgaaattgctgaccttgactggtttcccatcaattttagctttccatcctttgtcataaggaatagttgtcaccaacatggaatcttcagcggtatttacagtcccagaagcttttctgccagtggcttccatttcgacacctttttctttgatctgattcattgcggcttgataggctacaacatctagaccaacgactttaggctccatgaaacttatttctttcgtcccataaaaacttgcagtaaatgtcactgttgtctcttgaggataatagccaagatcatagtattgaccagaaatgttgatttgcgtttttcgcgatgtaccattgacagtgatcgtcgcactagaactttctaattgcgcaaaattggttgggaacaaacttaagtaagcttgtgtatttgcaggcacatggacttcccaagtgagctcttttggctggttatctgctgtttctgagtaagtgacgccagtcgttgtctttgtgatcgtcgtattcaactgattcttcaaagtaggtgtatagaatgtaaaatactgttcatttagaccagacaatgtattgatcaagtttgtctgactggtcaaattatctgtcactggctgctcaacatcattaacggacaacggtgcagtaaatgctagtggcaatgcattgacattctgatacagtgtatagtcgccgctttgaccagcttggcggaagccatatttactgaacgtgctttcgtttttagaaatgttatatttgattcctgtaaacccatccatcagcaaagtattattgttataacggatattcaaatttgtccctcttgaacggaaacctaatttatccaggtaagaggaagaattacgatttcttatagaagaaaacaaactgataccactgtaaccatagttgatcgaatcgtttgcagatactggatccagattttccaagcggtaaaacgagtcggaatctttttttgtttcatttacaagagctttcaagtcaggataaggatcagtatataaactgcgggaagcataattccaatcatcaagaatgccatggatcatactgttcgtattgaccagtgcttcagcagacatgatcaataataacaatatactcagatgattgaatgaaagttttttatgctgataaaatcccacagcaaaagcataaatccctaagaaaaccactgtcaatacaaaggaagtcatcgtcacataggtgtagcttccttcaggtttgatgccccatgccaccgcaaagagagcagctacgaccaaaatgattcctaacaacagcccacgatcgtcttgttctatcttttcccatccttttcctgcaagcaggagcactaagaaagagaacagataggcataacggaataaaaacatattcggtgcatgcataccatgccagaacaaattcaatggaacaagataaaaacttgcgataagtatggcgaaaagactgccgtacaaaaatttatttttcaacggtactttccgactggcaaaataaaacagacagaggactaatggtagcagacctgcgtaaacgaacggaatcgatccgtattttgtcgtgtcataaacaccaatcatatttttcatgattagatccagataagaagtcgcttctgttttcaacgtagtgatctgactcagtgcctcgccatttgaccgaagatccagcactgctggcaatacaatgatcattgaagcgccgcctgccagtaaagaagtgataccataaggaacaatcgtttttttatattctgaccagtttgtcaatagacgggcgataaaatataagaaagaaaatacgccaatcataaaacccatataaaaactggataaaaacaagagtaaataactgataaataaaagtttcggccgtttaagatccataacacgatgaatccccaaaatcactaatggaagataaaaaaatgcatccagccacatgatgatctccgaatgtgcagtgataaatgagatcaatgcgtaactgacgctaagtgcaacatgcccccagcgaggaatcttgaacgtacgtgcaagaaaccaaaaagccaatccggcacagccgaccttaagcaaagtcagaacatacagtgcatctggcatcatctggtttggaaaaaagaacaccagtggcgtgaagatcccgcctagatagtaagaaattaaagataaataattcaatcctagagaagcattccatgtataaaaaatactttgctttccaagaagaacatttcggaagctggcatgaaaattagaaaactgtgaaaaggcatcacttgccaaaatacttctgctgcttccaggatagattccgatacttagataaacaagtgctaaaatcaaaaacggaatcaggaaactagctgctgcgtagcgtccgttttctctaaagaatgactttaaattttttttcatatttattttccaccaaatttctatgaagttgtattcagtttatcatatccttgtttttctctgcttaaaaagagtctagttttcacaaaaaaataaaatttagaataaataacttcataatttgttcgtataacaaaaataaacgcaaaaaaagggtaggaatcaaaagtcccacccttaaaaatttttattaaataaaaaaccgttcactatctgaacggtccaagtatcattcaattaaacgcgttcaacttttcctgatttcaaagcacgagttgacacccaaacttttttaggttttccgtcgaccataacgcgaactttttgtaagttaggtttaacagtacgttttgttgagttcatagcgtgtgaacggttgtttccactttttgtcttgcgacctgtaaagtaacaaacttttgccatggtaatttcctcctttgccttgatttggagcaatagaataattcagctcataccagactaacatatcatatagaatgggaatttgcaagtacattttcatagatacaattgacaattgagaagaataattgtaaattaaacaaggttatacctgaaattttgcaaggtttttgagtactttgggtaactgccttttatttcaagttgcgctatgataaaatatgatagaagaaaaatgggagttttttacccgttaaggaggctcattcatggctgtaaaaattcaaacgtcagctggaaccattgaaattaccaatgatgtaattgcaacagttgttggtggcgccgcgacagatgtgttcggtgttgtaggaatggccagcaaaaatcaaattaaagataatattactgagattttgcgtaaagaaaattactcaagaggagtagttgtccgccaagaagataatggtattgctgtagatgtttatacgattatcagctatggtacgaaaatctctgaagtttcccgcaacgtccaagaaaaagtgaaatacaatctagaggcattattaggcgtaactgccaattcagttaatgtctttgtacaaggtgttcgtgtactgccagactaggcaggagactggctggtaactcagcagtcgatctgaaggaggattatctaggtgagtgtaacagaaataagtgcaagccagttccaggaaatggtccaggcaggtgcgaatcgtctgcaagtaaatgcagaatacgtcaattcattaaatgtattccctgtgccagatggcgatacgggaacaaatatgaatctatctatgactagtggagctaaggcagtagtagattcaacctcagaaaaagtaggagaattagcagcaatgctttcaaaaggattgctgatgggtgcgcgcggaaattccggcgttattttgtctcaattgtttcgtggattttctaagcaaattccagatgttgtctcattaaatgcttctgatcttgctgcagccttcactcatggagttgaaactgcgtataaagcagtaatgaaaccagtagaaggaacgattttgacagtagctagagaagcagcgaaagctggagaaaagaaagcaaaaagtactgatgatgtcgttgaagtaatgacagctgttgtaaaaggagcaaagcgtgctttagctaaaactccagacttgcttccagtcctaaaagaagtcggtgtcgtagacagtggagggcaaggactgctgtttgtttatgagggctttttaagtgcattgaatggagaattccaagcggatgaaacatatgaaccttctccagcagaaatggatgatatggtcaatgcagaacatcatcgcagtgtccaaggtcaaatggcgacagaagatatccattttggttactgtacagaaatcatggtaaaaatcggagaaggacctacagtcgatagtacattcgattacgaagaattccgtaactatttagatggtataggagattctttacttgtggtcaatgatgacgagatcatcaaagtccacgtgcatacagaaaacccaggagaagtcttgaattatggacaaaaattcggttcattagtcaaaatcaaagtcgacaacatgcgcttgcagcatgagacgattttggaacacgatgaagaagtgaacgagtttgcgaaaaaagaaataccacgtatcccgtatggtatcgtagcgatcgctgctggtaaaggcgtccaagagctgtttgaaagtttaggcgctaattatgttatcagtggtggacaaacaatgaatccaagtacggaagacattgttaaagcgattcaagaagtaaacgcagataaagtgattgtcttgccaaacaataagaacatcttcatggcagctgatcaagcagcagaagtagcagatatcccagtagcagttgttccttcaagaacgatttcccaaggattgacagctatgctttcattcaatgatcaagcttctttagaagaaaacaaagaaacgatgacagaaatgttgtctagcgttgtgagcggtcaagtcactcacgcgatcagagatacctcaattgacggtgtagagatcaaagaaggagactttttgggcatgatcgatggaaaaatcctgatctctaacccagatatcacagcaacagcgttaagtacactagaacaaatgatcaatgaggacacagagatcgtaacgatcttggcaggtgatgaaggaacagttgaacaagcaaatgaatttgctgagaaactaacagaaaaacatcctgatttggaaatcgagatccaccaaggagatcagcctgtctatccttatctattttctgctgaataatttctgtgtcagaatatctttctaacacagtattcattcataaaaggccttcggttagtgatcaggtatgatcgctgaccaagtcctttttttgttaaaggagggaggaaaaatttatgcgttctttagatgatccaatcactatgctggcaggagtcggagaaaaaagagcagctagtcttgccagcttgggcatccaaacgattgaagacttactgacttattatccttttcgctacgaagatattcaggaaagaaatctaaacgagatccaggatcaagaaaaggttactttgaaaggaatcgtagtctcgcctcctgtgatgaatcgatttggttataaaaaaagccgattgcaatttcgtatgatgcaagaacatgatgtgttcaacgtttctttttttaatcaaccttatctaaaagaaaaagtcattttatcggaggaaatcgccgtatacggtaaatgggatgcaaagcgtaaagccttgaacgggatgaagattttaggttctcaaacaatggatgacttttcgccgatatatcacgtcaacaaatcaattcgtcaaacgacattagttgatctaatcaaaaaagggtttcaagaatacggcacattgattgaagaaaatctgccaaacaaccttgtggagaaatatcgactgcttgaccgagcttctgctgtaagaagtatgcattttccaaaagaccacgaagaaaaccatcaagccaaacgacgtgtcgtttttgaagagttctttttatttcaaatgcgtcttcaaggattgaaaaaagcagaaaaagcagaaacgaatggtttggagatcctttatgatgtccaaaaattgaaacaatttactcaaaagctaccttttgaactgacaaatgcacaaaaacgtgtaacgaatgaaatctgtcgggatcttcgcagtccgcagcatatgcagcgacttttgcagggagatgtaggtagcggaaaaacagtggttgccgcgattgcgttatacgctaccgttacagcaggtttccaaggtgcgttgatggtgcctacagaaatcttggcacaacaacatatggaaagcttgcaacagctgtttgatcccaatgaagtaaccatcgcattgattacggggtcaacgaaagcaaaagaacgacgtgagctccttgaaaaactagagcaaggggaaattaacgtcgtgatcggcacacatgcattgatccaagatggagtcgaatttcagaatttaggtctagttattacggatgagcagcaccgttttggcgtgaaccagcggaaagtacttcgtgaaaaaggctggcgaccagatgtcttatttatgacagcgactccgattcctagaacattagctattacagcatatggtgagatggatgtatctatcattgatgaacttccagctggacgtatcccgatcgaaacacgctgggtaagaacacctcaattggacagtgtactggattggacgaaaaaagaactggcaagaggacatcaaatgtatgtcatctgtccgctgattgaagaatcagaagcattagatgtaaaaaatgcagtggaaatctatgaaaaacttcgtgaactatttgcaccaaaatatgaagttggcttgttacatggtaaaatgaagaatcaggaaaaagaagtaatcatggaagccttcaaagacaaccagatgcagatattagtttcgactactgtaattgaagtaggggtaaacgtgccgaacgcgaccgtcatgctgatcatggatgcggatcgatttggattggcacagctgcaccaacttcgtggacgtgttggacgcggaagtgatgcttcctactgtatcttagttgctaatcctaaaaatgaactaggtgtggaacggatgaaaatcatgacagagaccaccaatggttttgtactaagcgaaaaagatctggaattacgtggtcctggtgaagtatttggcttccgtcaatctggtctgcctcaatttgcgattgctgacttggtgacggatggaaatgttttggaggtagccagagaagaggctgcagccctttggcaaataaaggattggcagatgcttcctgagtatcagcctttagcgcaaagcctccaaatagaaaatcaggataatcgttatttcgattagcagactgtgctatactttatactgatgacggaaaaaggagtggaaacaatgaaaattgccgtagatgcaatgggcggagatcacgcacctcaagcaattgtagaaggcgtggctttagcgcagcaagattttccagaagtagaattcttactttacggaaaagaagcagaaatcaagaaatacttaacaaatgaaaaaaacatcacgattatccatacagacgaaaaaatcaatagtgatgatgagccagtaaaagcaattcgacgaaaaaagactgcatcaatggtccttgctgcacaagcagtgaaaaacggtgaagcagatgctgtattttcagcagggaatacaggcgcgctactagcagcagggttgttcatcgtaggacgtatcaaaaatatcgaacgccctggcttgatgtctaccttgccagtagtagggaaagaaggtgccggtttcgatatgctggatcttggcgctaacgcagaaaacaaaccagaacatttgttgcaatacggtattttaggttctttttatgcacgtaaagtccgaggtatcggacgtcctcgtgtcgcactcttaaacaacggaacagaagcaacaaaaggtagtgaagtgacgaaaaaagcctatgaactccttcagaatgaaacaagcttgaattttattggaaacgtagaagctcgtgagctactcaatggtgtggctgatgtagtggtcacagatggatttacaggcaacgctgttttgaaatctattgaaggaacagcaatgaatatgatgaatctattaaaatctgctattctaaatgaagggatcaaaggaaaaatgggcgctatgcttttaaaagacggcttacgttctttgaaagcagaaatggattattccaaacatggcggtgccgttttgtttggcttgaaagcaccagtcattaaaactcatggagcaacaggccccgatgctgttcgctatacgatccgccaaatccacacaatgcttgagacagatgtagttggacaattagtcgaacaatttgaaaaaagcgaagaatagtatttggatatctgaagcgatccgttccattgaaaaaaaggtggacattcctgaaaaatgccagtaaaattagccatggtgtaggtaattgacaagtgtatgattcttggaggtgaaaaagttgactcgcgaagaagtatttaacaaagtagcgaaaattatttcaaatcattttgagatagataccgataaagtgacggatgaattgaacatcaaagatgatttaaaagctgattcaattagtattatggaattcgttttagagcttgaagatgaattcggtacggaaatttcagatgaagacgctgaacaaattgaaacagtcggtggcgcagtagattatatcagcagccatcttaaataatttcaaataaaagcaaagaaggataaaaagctgcatgcagctttttatccttctttttttaatctttttgacacgtaaaagtcatttttctgataattctggcgataaacagaaattatgttgcaaagtaaagcggttttctatataattattaataattcattacacaaagataagaataacctttgttataaaacgatttattctgtgtaatgtccttttttattaagaaaaacttccatttaggaagcagagaggggtattcgattgtccgataaccaattattagaagttcagaacctacatacaggattccgactcaaagatgactattacgatgcagtagatgacgtttcatttactttagacaaaaacgagattttagcaatcgttggggaatctgggtgcgggaaaagtaccttggctactacgattatgggattacttgatcctaataacacaaaaattacaggtgagattttatataacgatctgaatttaatcgacctgaacgaaacgctctataataaaatccgcggaaatgatatcggaatgattttccaagatccgttgtctgcattaaatcctctcatgagaatcgaagaccagatcaaagaaggactttcctatcacacaaagatgaatgcagaacagcgtcaagctcgtgcactagaattgctagaacaagtagggattcctaatcctgcgagagttggacgccaatatccccatgaactatcaggcggtatgagacaacgtgtcatcatcgcaatcgcaatcgcctgcaaacctccaatcgtcattgcagatgaaccgacgacagccctagatgtaaccatccaagcacagattcttgatttactgaaagaccttcaggaagaaacaaaaacagggatcatcttgatcactcatgacttaggagtcgtagcagaaatggctgatcgagtggcagtgatgtatggcggacagttcgttgaagtagcaggtgtaaaagaactgtttgatcatcctaagcatccttatacacgctctttactgaactctataccacaagaaggaaatcatgatgcagaactccatgtgatcgaaggtgtcgttccttctctgaaaaacatgcctcgtaaaggttgtcggtttgcaccacgtattccatggataccagcaagcgatcatgaagaagagcctatccttcatgaagtcgcaccgaaccacttggtacgttgctcctgctataagcatttccactttagagacgaaaaaggagaggtgtagatgacagaattaatcacaatcaaagacctgaaagttcattaccctattcgcagtggattcttcaatcgagtaacggatcatgtatatgctgtagatggtgtggattttattatcgaaaaaggaaagacatatggtttagtgggagagtctggctctggaaaatctactacgggaaaagccgttgtgggattagaaaaggtaacagccggacaaatcatgtatgaaggaaaagatgtaacgaagcgaagcaaccgcaaaaaaatgggttataacaaggatgtgcagatgatcttccaagattcaatgtccagtttgaatcctaaaaagcgagtgttggatatcattgctgaacccatccgaaattttgaacggttaagcgatcaagaagaaaagaaaaaggtaaaaggactgctagatatcgttgggatgccggaagatgcgctatataaatatcctcatgaattttcaggcggacaacgtcaacgtctaggagtagcccgtgctgttgctaccaatccaaaactgatcgtagccgatgaacctgtatctgctctggatctatctgttcaagcgcaagtattgaatttcatgaaacgaatccagcaagaatacggcctcagctatttattcatttcacatgatttaggtgtagtaaaacacatgtgcgacaatatcgcaattatgtacaaaggtcgatttgtagaaatcggtacaagagaagacatttataatgacccgcgacatatctatacgaaacgtctgctttcagctattccgcaaatcgatgtagaaaatagggaaagccacaaagaaaatcgacgaagagtagaacaagagtatatccaaaaccaaaaagaatactatgatgcgactggtcgagtctacgatttgcgtacgatcacaactacacacaaagtggcgttgaaagatggaggtgcaagctaatgtggaaaacgattctgcgacgtgttttattgatgatcccgcaagttattattttaagtgttctgatcttcttattagcccaagcgatgccgggggatccatttaccggtttgatcaatccaaatcaggatccggcagtgatcgaacagatgcgacaagcagctggcttgaatgacccatggtatgtccagtacttccgttggatcggaaatgctttgcaaggcgattttggtcaaagtttcttatacaaacgctctgttgctgacttgatcggcgaacggatcatcaacactttatatctatcgatcttgacagttgtccttacttatttgattgctgtgcctctggggatgcttgctggccggtatcaaaattcaatcttggataagattgtcgtaatctacaacttctttagttttgctgttcctttatttatcttcggcttgatcatgctatttgtttttggttatcgtttaggctggttcccaacaagtggatcacaaacactaggtttgcaaggtggatttatcactcaatggatagaccgtttgaaatatattctgttaccatcaattacccaagcatttttggcgactgccgtcacaatccaatatctgcgaagtgaagtaatcgattcgaaatcgctcgattttgtcagaacagcccgttccaaaggggtaccgacgaataaagtattcagtcgacatattttccgaaatgcagcgttgccgatggcttctcaaatggggtatgaaatcacttcgttgattgctggttctgtagttatcgaaaagatttttggttatccgggagtcggaaaactatttattgattccatcggccaacgggactataccgtgatcacatccttagtattgattttaggaatcgcgacgctagtggggacattactttcagatatcatcatgagtatcgttgacccgcgtattcggattcaataaaaccaatcagaaaggagaatggatcgatgagtgaaaaaaacaatacagcagttcaagaaagtattcctcctatggggatacgaatgattgctcgagaatttaaaaaagataaaattgctattttttcattaggtttgctagtggttttattattagtgatctttatcggtgcgatgctgaccgatcaagacaaagtgatgtatgttagtatcttcgacaaatacgctgcaccaggaacagtttcgacacaaggacaaaagttcattctgggagcagatgaaggcggacgtgatgtattaggacaattgatcataggtgctagaaactctgttacgatcggatttgcgatcacgatccttacttcgatcatcggggttggattagggatcatctctggctactacggagggatcattgacaacatcttgatgcggatcgttgattttatcatgattctaccgatcatgctgatcattatcgtcttcgtatcgattatttccagatacaatgtctggtcctttatattcatcatgagtgcattttattgggtagctaaagcccgattattccgaagcaagacattatctgaagcaagaagagattatgtcagtgcctcaaaaacaatgggaaccaatgattttaaaatcatgttccgcgaaatcatgccgaatctaagttcattaatcattactaatttgacgatgaactttgcggcaaacatcggtatcgagacaactttgactttcttaggtttcggcttgccggcaaatgtacctagtttaggtacattgatcggttatgcaagtaacggagaagtcttagtgaatcggcaatggatctggttacccgcatcaatccttattttagttttgatgttgagtatcaattatgttggacaagcattcaagcgttctgcagatgcgcgccaacggttaggctagtatagaagcgaagggggaaataggaatgaagaaaacgatttttggatttgcagcgctgatgtctgctgtcgttcttgcagcatgcgggggcggaggtacagatacctctggaaacaactctggaggcaacggcaataacaaagaggaattaacttttccaattgcaacaaaaaataatgatgatgcaatcgaagacggcgaattagaagctgcggtcgcaacggacagtcagtttaaaggattgttccagtgggagttttaccaagattcatatgatgcagcttttatggctccttctcatgaaccgctatttgcaaacgatgacgatttcagaatcacagacgacggagctgcaacgcttgatctagatgaagatacgaaaaaagcgacaatcaaagtaaaagacaacgtcaaatggtcagatggtgaagatgtaacggcggacgatgtgattttcccttacgaaatcattgggaataaagattacactggtatccgttatgacgacactttccgtaacatcgtaggtatggaagaatatcatgatggaagtgccgacacaatctccggaatcaaaaaaatagacgacaaaacagttgaaatcgaatataaagaagtaaacccaagcatgcttcaatcgggtggtggtatctggtcatatgcagcaccaaaacatacgttagaaggtgtagcaatcaaagatatggaatcaagcgatcaagtacgtaaaaatccagtgacttttggcccttattacatgagtaatatcgttgcaggagaatcagtagaatacttgccaaacgagcactactggaatggtacgcctaaattgaaaaagatcacgatgaaatctgtaccgatggcaagtgcaactgaagcattgaactctaaattatatgatatgattttccaaatgccaacagatacttacgatacctataaagaaattgctggctatacaaacttaggccgtgaacaaacttcttatacttatctaggattcaagttaggtaaatggaatgcagatacaaagagtgtggaatacaatccagattcaaaaatggctgataaatcattacgtcaagcaatgggctatgcattagataataatgcagtaggtgaacgtttctatgcaggtttgagaagcaatgcgacttcattgattcctccagtattccagtcataccatgatgatgagatgaaaggattcacacaagatctagacaaagcgaaaaaactattagatgatgctggctacaaagatgtggatgacgatggtttaagagaagacaaagatggaaataaactaacaatcaactttgcttcgatgtccggtggggaaacagcgcaaccattggcagattactatatccaacaatggaaagaaattggtttggatgtccaatacacaacaggtcgtctgatcgaattcaattctttctatgataaattagaaaacgatgatcctgaaattgatgtttaccaagctgcttggaatacaggaactgatccaaatccaagtggactatggggaccaaatgctgcgttcaactacactcgttatgaatcagaagaaaatacaaaattgatcaacgatatcagttcaagcaaagcatttgatgaagagtaccaaaaagaagcatatcaaaaatggcaacaatatgcatttgaagaagcatttgcgattccaacgttgttccgtaatgaagtattgccagtcaacgaccgtgtcaaagactgggattggtcttatgatgtaccaaacccatgggcaaatgtttctgttacagcagattcacgttcataatcactaaaaatgaccgaaaaagggcgatgtcctttttcggttttttgatatttttctgtttatttctctaatattcaggtcaaggcgctgatttcatgacttctccaataaacggtgttcaaagtccagtttctcggtattaagtcaaatttatgcaaaaatatggaaagccattttcacaaaattttttcttcatactcgaaactaaacgaatttttcacaacttctcgtcaatcactaggattattaaagctttacttaccttttgaccgaaccatttcaaatttgacaaaaaaccagtataataaggaagtatcgaaaaaatatccataaaaggaatgtggaaaatggacaaccagctgacaaaagaactaaaagaaaactataacatcgtttttcacgatctaaatttgcttgaacaagcttttacccattcatcctatgtgaatgagcatcgcaatctgcaattatcggataatgagcgacttgaatttttaggagatgccgttttagaactgatggtttctcagtatttattccgtttatatcctcatttgccagaaggaaaattgacaaaaacacgagctgcgatcgttcgcgaagacagcttgtcgaaatttgccaaagaatgtcactttgatcaatatgttttgttgggcaagggagaagagaattcaggaggacgtacgcgaccagcattgctttgcgacctattcgaagcttttttaggcgcgttatatcttgaccagggattcgacacgacccatgcattcatcgaaaaagtgatttttcctaaagtcaaagcaggtgctttttcacatgagatggatcataaaacaaaactacaagaagtcttgcaaaaatcaggtgatgtatcaatcgaataccgattgatcaatgaagaaggtccagctcatgaacgagtattttggatcgaagtttatgtagatgatcaattgattggcactggacaagggaaatcgaaaaaattagcagaacaagctgcggcggaaaatgcattggcagcactgtaaaagtaagtgagggaaagctttgtatttgaaacgaattgaaatagccggttttaaatcatttgcagacaagacagtcattgattttgaaaatagcgtcacagcagtggttggaccaaatggcagcggaaaaagcaatattacagaggctatccgctgggtattaggagaacaatctgctaaaagtctgcgaggcggaaaaatgccggatatcatctttgccggttccgatacccgtaagcagctgaatattgcagaagtcacagtgattttagacaatagtgatcattatctgccattggagtacaatgagatcagtgtaacccgccgttatcgacggactggggaaagcgagtttttcatcaataaacaaagctgcagattaaaagatatccaagaattgttcttagattctggattaggaaaagaatcgttctcaatcatttctcaaggaaaagtagaagcgattttcagtagtaaaccggaagaccgtcgtgggatctttgaagaagcagctggtgtcttgaaatacaagcagcggaaaaagaaagcagaacagaagctttttgaaacagaagacaacctcagccgcgtccaagacatcatccacgaattggaagaacagttaactcctttggccgcccagagtgaggcagcaaaggagtttttacggctaaaagaaacactgactcaaaccgatgtctctttgatggttgctgaaatcaagacagcaaaaaaagattgggacaacaaacaagcacagcttgcgaaattcaatctagaattaggcaaactatctgagtcgatccaagaacaagaatccattttggcgaagcagcgtaaagaaaatgcgcaagccgatcgtctgatcgaaaaaaatcagcaagtattattagatctttcggaaaaactgaagcagacagaaggacaaaaagatgttttgcaggagcggacaaagcatacacaaaaaagctcgcaagaatatcaaacttcattagcagaagcacaaaaaaaggttaaacattttgaaaagcttcaagaaagcttgatgaaagcagcagcagaaaaagaaacagagatccaaaaagctgaagcaaatctcataaaaacacagcaagaattagaaaaataccaaaaatcaacgaaagaattattggcagaattaagagatcaatatgttgatttgatgcaagaacaagcagctgtaggaaacgaactgaagtatctagaacgtcaatatatacaagaaacagcaaaaagcaagcagacgttagccaagcaatcggaagtagaagcatcagtagaccgattgatcttacaaaaagaagaattgacacaaaagcaggcgcagctaaaatcatctttaactgaaacaaaagagaagttagaaatgatccaacaaaacgggaaaaagttccaagaagcattagcaaaagaacagcctaaaatgtatcaattaatgaatcaagtccagcagctacgtgctcgtaagaaaagccttcaagaaatccaagaaaactattttggtttttaccaaggggttcgattggtcttgcagcataaacagcagctttcgggtattgtcggagcagtggctgaactgatcgatgttcctgcagatttcacgttagctatcgaagcagctttaggtggggcagcccagcatgtcatcgttgaaaatgaaaaagatgctcggcaagccatcacgtatttgaaacagcaaagaggaggaagagcaacattccttccactgacgacaatcaaaccaagacaattaccggctcatatattgacacaagcagcagctgtagaagggtttatagggattgccagtgaacaagtcagttatcccgatcaaatccaaactgtggttcaaaacctgctaggaacgatccttttagccaaagacttaactagtgccaatgcaatcgcgcaaacgatccgctatcaatatcgagtggtttccttagaaggtgatgtgatgaatgccggaggatccatgacaggtggagcgaataaacgaggaaaccaaggcagtttgtttgtacaaaatcaagaattgaaacggttgactagtgaatttgaagaagcagataaacaactccaagcacaagaaaaaaaagttcaggagctgcaacaagaaacagctcgtttagccgaagaacaagaagttttgcgtacacgaggcgaacaattacgttttgaagaacaagaagcgacaaatcagctacaaaacatcataaatgaacttgaacgttttgaaaaagaaaagcaaatctcaacttttgagacacgtgaactgcagcagtttatcgaagattacgaaaagcaaacgaacgaattgaaagacaaacaaacagatcttgaatcgcaacgacaaaaaatcgacgaagaaatcaaatcgttaagtcaagaaagcgaccagatggaagccagaagagcacaagtacaaagtcaaaaagcacaagaacaagcagatcttgctgtcttgaaagagcagtttaatcatctgcagatccagctccgcggtgcccgagtccaaaaagcagaggcaaccgaacgtcaagaagcgatagaaaagcagttggcgacattgacagcagacttttctgatcatgaagtcacagaagaaagtttggaaaaacaaattaacgaattatctgctcagcgagaaacattaaaagccgagttggcaaaagccaaagagcagcgagatagaaggcaaaaggagatcgataagcttgaagcagtcttggcagagcgtaatcgtgagcaaaaagcacgactgtcggaacaatccaaattagaagtccaaaaagaccgagctgaaatgattttagataatcatttgacctatctgcagtcagaatatcagctgacatttgagaaagcttcccaagactatcaagaaacaaccgatatcgaagacagtagaacaaaggtttcatccttaaaagaacagattgaaaaactgggaccagtaaacttaaattcaatcgaacaatacgaacaagtcagtgaaagacatacattcttagcaacacagcgagatgatctgttagcagcgaaaaaccaattgtttgaaacgatggatgagatggatgatgaagtgcggacaagattcaaagaagtatttgaagctatccgtcaagaattcaaaattgtctttccaaatatgtttggcggcggtaaagctgaattagtactgacggaaccaactgatttgctgaaaacaggtattgagattgaagtacaacctcctggcaaaaaactgcaaagtctaagtttgctttctggaggagaacgagcacttacagccatcgcgttgctcttttccattatccgtgtctgtcctgttccgttttgtatcttagatgaggtagaagcagcgttagatgaagccaacgtgaaacgttttggtcgttacttgagcgatttccaagatgacacacaatttatcgtagtcacacaccgcaaaggaacgatggtcgcagcagatgtactgtacggagtgacgatgcaggaatccggtgtatcaaaaatcgtttctgtacggatggaagatatcaatgaagaggcgaaaatcaacgaaacgaaagtgtaggaacgaaaatgatcaaattagtagcaatcgatttggacggtacattattaaatgaacaaaagctgatttcagatgagaataaacaagcattagcacaagcaaaacagcaaggggtcaagatcgttctatgtacaggacgccccttagctgcgatggcgcattatctgcaagaattaggactggtagatgaaggtgactacagcatcactttcaacggcggtttggtacaaaaaaatgatactggtgaaatcatggaaaagaaagtgatggaagtatcagatatccaacgcttatacaaactggctcagcaattggatctgccactagatgttttgtctgacaatgtggttttacagctgcctagtgccccaaggaagcaatccttgtacaatgtgttgaataagctgctgcaattccaaccagcggatataagcgatattacagatgaatttgtgcttaataaggcagtaatcgcttatgaccaagaagaattagatcctaaaatcaaagaaataccagcagaattccatgaaatgtatgagatcatcaaaacaagaagtatgcttttggaatttatgccaaaaggtgttacaaaagcttatggtatttctttattggcaaaagatcttggtttgaaacaagaagaaatcatggcgatcggtgatgaggaaaatgatttaccgatgatccaatatgctggactaggcgtagcgatggagaatgctgtgcctttcgtcaaagaagcagcagatttcgtgacagccagcaatgaagaaaatggcgtagccaaagtgatccaaaaatttgtattagagtagggggagtcaaatgggattttttgataaaatcaagcgtgcttttactggcgaagagaaaacagaagaagttgaagtacaggagaagtacgacaagggtttagaaaagacgcgtaaaacatttggtgaacggatgaatgagttgtttgccaattttcgaacagtcgatgaagacttttttgaagaattagaagaaacacttatcggtgcagatgtaggttttgaaacagcgatacgaatcaccgaagcattacgtcaagaagtgaaactcagaaatgcgaaaaaatcggcagaagtccaaaatgcgatcatcgagaaacttgtggatctctatgaagcggaaggaatcaatgaagtaaatgaactaaatatccaagaagacggactaacagttattttgtttgtcggtgttaatggtgtagggaaaacaacaagtattggtaaacttgcccatcagttcaaaaacgaaggtaaaaaagtattgatggcagcagcagataccttccgcgctggagcaatcgaccagttagttgtctggggcgaacgcgctggtgttgaagttgttcgtggcaatgcaggaggcgatccagcagctgtcgtattcgatgctttggaaagagcaaagacagagcaggcagatgttttactagttgatactgcaggccgactgcaaaataaagtgaacttgatgaacgaattagaaaaaataaaacgagtaatccagcgggaattaccagaagcaccccaagaaacacttcttgtattagatgcaaccactggtcaaaacgcgatggttcaagcaaaacaattcaaagaaacaacagatgtgaccggtcttgttttgacaaaattagatggtacagcaaagggcggtatcgtacttgctatccgtaatgaattgcatttaccagtgaaattggtcggtcttggtgaaggaatcgatgacttggagccgtttgatccaaatgattttgtcgttggattgttcaaaggattactaaaagaagaataacccatgtctaaaaagcaggagctgtgacaaaagttgcagctccttgtttgaatgattgtttttaacatagctgtgtttttgatgccttcatttttatacttatttgtaagcggttctcaaacaatttcgttctttttcttagactttttgattataattagattcatatgaattggaggtcacttaatgatgaattttaagcaattattattgcatgtcaatgcgcgcccttttatcgaccaagctcgatttggtatagaacgggaaggacagcgggttgatcttgcaggaaatctagcaaaaaccgatcatccagcaatctttggcgatcgatcctatcacccctatatccaaacagattttagcgaaacacaaacagagatgatcacccctgttaccgattctattcccgaattatttcagtatctcgctgctgtttatgatgtgactgctcgttctataccgaaagaagagatgatctggccattaagtatgccacctgccttaccggaaaaagacgaagagatcattattgcaaaattaaaaaatttcgaagatgtcttgtatcgacgttatttagcaaaagaatacgggaagcgaaaacagatggtaagcggtattcatttcaattttgaatttggcgatgagttgctaagaacattgttcagccatcaggaagaatttcaagatttttccgaattcaaaacagaactttatttgaaaacagcgagaaactttatgcgctatcgctggatgatcacttatttattcggtgcttcaccaatgagtgagaagaactactttttagatgaatcacatccgcaagaacctgttcgcagtattcgcaacagtgcgctgggctatacgaatcatccaaatgtgaaagtttcctatgcttctatgaaacagtatttagcagatatcgagcgaatgatcgaagaagggaaactttcggaggagaaagaattttatacaccgcttcgtttccgaggcggaaagaaagtcgcagatttagcaacaacaggtgttcgttatattgaattgcggaatatcgatttgaatccttatgcaagattgggtatcaatccagagcaagttcggttcttacaattattcctgatgtacatgttatggacagaagaaaaagaagactgtgaccaatgggtagcagaaggtacgactcgaaataacaaagtagcactagaacaaccatcagatcaaacagaatttcatcaagaaggtagagaaattcttgaaggaatgaagcaaatgctggttgaattggattggttggattctctttatttagtagaggaagcattgactcaaatggatcatcctgaacaaacgttagcagcgaaactctatcaagaagcacagctatcgagtcagcaagaagttgctgtggcattgggacatcaatattataaagaaagccatgaacgtccctatcagttggccggttttcgcgaaatggaactttctactcagatatttatgttcgatgccatccaaaaaggtgtccaagtcaaagtattagatgagtcggatcaatttttgcgtctgcaattccaagaccatgtagaatatgtgaaaaatgcaaacatgacaagtaaggacagctatatcgtcccacttatcatggaaaacaaaacagtaacgaaaaaagtcttaaaagaagctgggttccgggtaccaggaggcgcagaattttcatccatggaagaagcggtaaaagcttatccgagatttgccgagcaggcatttgtgatcaaacctaaatcaaccaattacgggttaggtatcacgattttcaaggaaggagctagtctggaagattatcaagcaggtttagccattgcttttcgtgaagacagttcggttttagtagaagaatttatgccgggaacggaatatcgtttctttgtgatcgacggagaagtccaagccatcatgttgcgagtccctgctaatgttattggtgacagtatccgaacagtgaaagaacttgttgaagaaaaaaatagtgaccctttgcgtggaacgaatcatcgtgcacctttagaattgatccaattaggtgaattagaacaattgatgttgaaagaacaagggttgacgatcgaatcagttccccaagccaatcaaattgtttatctaagggagaactcaaatatcagtacaggtggtgattcgatcgatatgactgatgaattttctgaagcttacaaaaaaatcgccgtttctgcggtagaagcactaggagctaagattagtggtatcgatttgattataccagataaagaaatcgatcctacaactgataaaaaagcatatgggatcatcgaagcaaatttcaatccagccatgcatatgcatgtttatccttttgcaggaaaaggcagaagattgacgatgaatgtattgaaattgttatatcctgaagtattttaaaagaaaaagcttttgacagattgtcctatttgatgtcaatctgatcaaaagctttttttgcatgtaaaaatttatgtgttttttcgttttaaaataaacgatcccagaagctttttttcttttttggtttttctttttcagctggcgaagagttttcttctgggtattttttttcgatatcaatcacaggttcatttactgcttcttttgctgttaagagcaatccgaattcctcaggatttgcagtgacgtaatcgttgactacagtgaaacggctattgtttttcgttgctagctggatatattggttttggacagaaaggggtagagccccattcaagagtatggaagcatctggatgttttttgagttcttttaaaaagttttctttgttttttggttggatcatttcagcaacagtcatactaagatagcagcgttccctgaatgtccctaaatatttatgctgttcttcagggttcactaaaggtgtaccataaagtcccttatccaaatggctttttacatcatcttgtgccataaaaaataccctccttcttctctttgtctttcttacgattatagcatattcccaataatacctaaaacatatgaaaaagcggttgcttttgttcaacgattcacttaaaataagaatgaaaatcattctcaattagaaaggtggattggatgcgctacggacgactagtagcattattagttattttaagtagtatttcattgttcatcggagtatcgaatgtacaattgtcagaactgctccagttagatgggcaaagcttacaaatcttgctagtgactcgtttgccacgaacgatttgtttgatccttgtgggagcgaccagtagtatttgtgggttgatcatgcaacatttgacccaaaataaatttgtttcaccaacgactgcgggcacgatggatagtgcgcgtttaggtattttagtggctatgattttcctacctggtgcatccttgattgtccgatccttgacagcattttgctttgcttttgcaggaacattgctttttttatcccttacgcgattgttcctccagaaaaatcaattgatgcttccgttgattggagtcatgttagggaatatcattggttcagttgctactttttttgcttatcaattccagttggtacaaaatatgacttcatggcttcaagggaattttgcgactgtgatacgaggaaattatgagttattgtatgctgttgttccattgttgctcttggtttggctatttgcttaccgatttacgatcattggtctgggcgaatcgtttgcagtaaatctgggaatagattaccagaagatgcagtttttaggcattggcttagtatcattggctagtgcagtcatgttgatcatggtaggaagcattccttttatcggagtgatcattccgaatcttgtctctagaatatatggagatcaagtgcacaaaacaattggcgtaactgctttagcaggtagtttgttcttagtattttgcgatcttgtcgctcgcgtgttgatttttccttatgaaataccagtcagtgtgatcgttggaatcatcggtggggctatcttcctttatcttctgataaggggacgacgatatgcttaaaaaaaagccatctatttttattggtatgcttgttcttgttttatttgttacaggaatgtacttgacgatccatacatatggaaactggcattttgcatgtgcattgaggagtaagaaaatttttgcatttatccttgtctcgctagctgtcagcagtgccacaatcagctttcagacaattacgcataaccagtttttgactccttcagtattgggacttgagtcgttatatgtccttgtccaaacggtccttttcttctttatcggaggagtgacgatgcttcagcagacaggtacagtttttttcttattgaacgttgggctgatggtcgggctgagtctattgttatttttctttcttttgaaaaaaatgagagcgaatctttttttattactgatgtcagggatgattttaggtacgctttttggtagtgtcagtacctttttacaagtcatcatggatccgaatgaatatgatttgcttcaaggcagattatttgcaagctttggcaatatccagagtcagtatcttttgcctgcttctttgatcattatcggctgctggtacctgttatttcgatatcgacatgtgctagacgttttccatctcggaaatgaacaagcagtaaacctcgggatagacacagatcgttttgaatttttgattttatgttgtgtcagtcttttgacagggacatcaacggctcttgtgggtccagttacttttttagggtttattgtcgcaaatatcagttatcgtgtcttttctacttatcgtcatggtcagctatttatcggaagctttctggtagctatgctgtttctgacaggaggacagctcgcagtagagcagattttcggctggaatacaacagtgagtgtcgtcgttgaatttgtcggaggaatttattttgtcacaaaattgattcgcgaaaggaagagtatcctatgattgatttacaaaaggtcaataaactgtaccatggaaaatcagtggttaaagatgtacagttaacgattcctgaaaagaagttgactgcttttatcggtccaaatggtgctggaaagtcaacggtgttgtcgatgatcagtcgtttgataccaaaagatacaggtgaaatctatttagaccataacgaagtaaaggcttggaaatccaatgaattagccaaaaaattatcgatcctacgacaatcgaatgaaataaatgtccaaatcaccgtgaaagaattagtagaatttggacgatttccttatacgaaaggaaaattgacgacaaaagacgaggaaatcgttcaggaatcactggaacaccttgggttagaagaaatagcggatcaatcgattgacactctttcaggcggtcaactccaacgtgcgtatattgcaatggtgctagcgcaagacacggattatattttactggatgaacctttgaacaatctagatatgaattttgcggttcaaatcatgcagattttaaaaaatttagtacaagaaatcgggaaaacaattgttattgttcttcatgatatcaactttgctgcaagttatgcagacgaaattgttgcaatgaaagatggacagttatttacgcaaggaacgacccaagaaatgataaaaaaagatgtattggatgaattatacgaaatggacatacggatttgtgagattgaaggccgcagattctgtctttatttctaaaactaacattaggagagaagagatgaaaaaattagtagtaggtatcttgattctagcatcatttggtttagcagcatgtggaaatagcaacaacaccagtcaggcagacacaaaaaaaagcagcacacaaactgaaactacattgacgataacagatagtaatggagaccaaatcgaggtgccaaataatccagaaaaagtcgtcgtattcgacaatggttctttagatacgatggatgctcttggtgttggagataaggtagttggagcagctacaagcagccttcctgagtatctttcatcctataaaaaagtagaatcagcaggtggaataaaagaaccagacttagaaaaaattaatcagcttcagccagatctaatcatcatttctggccgacaaagagattttcaaaaagatctaagtcaaattgctccgaccattttcctttctttagatgcgaaaaatccatgggaatctttccagcaaaatgtcactgctttaggggagatctttggtaagcaagaagaagctaaaactcaattagaggaattatctagtgcaatcgatcagacgaaaaagaaagcagaagctactgacaaaaaagcactagtcacacttgtgaatgaagggcaattatcagcctacggatctggttctagattcggtttcatccatgatttatttggctttgaacaagcagatgatcaaatcgaagcatccactcacggtcaaagtgtttcttatgaatatgtgctggaaaaaaatccggatatcttatttgtagtagacagaacaaaagctattggtggagacgacagcaaagatgatatttctgccaatgaactggtagcacaaacgaatgctggtaaaaatcagcagatcatctcccttgaaccagatgtctggtatttaagcgggggcggtttagaatcaatgaaactgatgatcgaagatgtgaatcaagcatttaaatagcataaataacagaggattaaactctcatactatgtaacaataatgtttcttacattcttaaatagcaagagcctatcctcaaagaagttatcaaaaaccatccgtaaaatcgtattgatgattttacggatggtttttatttatttgagaaatcttttttcaacgtgaattcattatctacatcatacgggttgattctagaatggggagtggcaaaaaatagtgtgatccattttttcagcatcaagatcgcctcctttgatttgaatcaaaggtacaaagcgaaacttagataaaacttaaatttagatatttttattttgtaccgatctcttctttaaacgatgttccatctgctgcttctcggcaataagtccactagactagaaaatatgagaagctattttctgtccagcgttcttattactcaaaacaaatcgcagttgtcacaatctcttctaaacgatgttccatctgctgcttctcggcaataagcccactagactagaaaatatgagaagctattttctgtccagcgttcttattactcaaagcaaatcgcagttgtcacaatctcttctaaacaatgttcaatcagctgaccttcggtattagctcaaagcactgatttcacaacctctatttaggcatgtgtctcagcaagcggttgatagttgatgatctgcatttttcgataaaaatcggcgggaagcttactccaccgttttagtaattgatagaaataactctcttctgctttgattttatactcgcttaatatcaatccaaaactattcgttttttttgaagctaattttttataaatatccaatgctttggttttatcttcattgacaaagagtgtttttacttcaatataagaaccctcgatattttgtgtttcttcgataaaatagatgttttttatatattccttcatagtgattcctccaaagaagtcttttatttgataagtttactctaccgaagagttgttaataatccgtgaacaaaaagtaattctttttccaatagttgttaaaggttttttattttttatagtattttttgttatttaagaaaggaataaggttaaacaaataacaggttgctttttgggtctttttccgttcaagaaactgaacgaagaaaagggaaagttgtctcttttgtgataagagaaatcataataaacgaatgacttactttccaataaattgagaacagtcagaaccagacaaattagttgcatctgatgaataaagtgattattctatgacatgaggtgatacagatgaaattagaagtgacaaaagaagcacaagaagtattgaagaataaattagaagcagacgatcaacttttattagatatcgaaaacggtgacggtccatttgcagaaagccaagtcagttgccaattggatacggcatttcgattgatcattgtcaaaaaagatacacaaacagatctaagtctttattctgtagtggctgatacaccagttggaccaatcaaaatcaaagacagtgcaatactttacatggatgatccatccacacttgctttagaaccaacttataatagtttacaattaaaaggaccaagcggcttgagaaaaggcaacttgcaagttgttcgaaaagactagagggataaaatgggaaaattggcgatcatcagcgacctacatgtggacatcaataaattcggcgaatcagagctgatgcagctttggcaagttttgcaaaagcacaagatcactcggcttcatctagccggagatacggctaataaagtagaccgttgcctagctgttgtcgaatttttcgtcaataaaggattatctacgacatttcatttcggcaatcacgagttggcagatgtgcccaatgaacagatgatggaccattttccagacccacattttttaaatgaacggtatattgctttaaatgagcagaccgttcttttagggatgaatggctggtacgactatcagttttccgaattgaaagattacgaggcaatcgtacgaatgaagcgtttgtattggtatgatcggttcatccagcgtgggaaaacagatctcgaggtcaatgcagaaatgcttgcagctgcaaaaaatttgctagaccagctggaagcaaaaaaacttgaggtgattttatccactcatttcgttcctaaacgggcatttatcatgtatcaatctgctccttatgagcgttggaacaaattaaatgcatttttaggatcagaatcattcggagaattacttgaccgttattcaaatatcaaacaagtagtttttggccatacgcatcgtcgctttgaagataaatccatcggtcacacgatttacagctgcagaccttttggttattattatgaatggcagctgacccgagattttgtcttgaaagaacagttgctagacagctatgatcctatgaaattacgtgtcctcttgcgtgcccatcacccagcttttcaggcctatcaaacacaacatttgcaagaggaatttgaacaagcgatgacaatcgttccgtattgagacagcattagtaatgtgtaaaagaaaataccttgtaaaacataaggataagtaagagcagtagatccatttatcgtggatatgctgctttttttgcggaaaataatcagcgaatgtttatttgatcggatgatttgtaactcgcagagtactagatgcaagcgtgtattctttttttgaacgataatcacaaaaaaaaatataatatacattttttatttaattataattaatattgattgaagtctaggcagtcaagtcacattttgatagataggagggggacttacgaattattttaaaggctatgacagctgtatttctagattgtgtttgcatcaagttgcaataaaaactagaaatcaaatcgggctgataatcatttataactaatcgatacataggaccaaatataggtctatgttcttttatttcataagtatcgtaaaacagaattttgctatggattaatccaatcgactgatatgtttagtaaataaagaaagaggaatgtcaatgatgaaaaaagaaatcgtattaacagcagcaatgatgttattcagcatggtagcaagtacgacttttgtttctgcaactgaagtatacccaaaggaatataacacagaaggaacgattacatttgaagcaggagatgagggtgtaactcctcctgttgatccagagaatcctgatcccaataaacctgtcgatccatcagatcctccaagccctggaacaggaggggcattatcgattgattatggatcaaaattcaaatttgggactcaaaaaatttctactgcggataaaacgtattatgcagctgctgatgtgatgaacgatgggtctagaaaaccgacatatgtccaagtgacagataggagaagtaccttatctgggtggaaattaagtgtctctcaaccagaacagtttaaaactgccagtggggatgaactagttggagcacagctgaaatttacgaaagggcaggctgtttctttggttgatccaacatatacgccgcaaacggtgaattctgaattaacgttgacaccgggaggaaacaatacgttagcaattaatgctaaatcaggaacaggtgtggggacttgggtctatcgatttggtgcaaatgaaaatgaaaatcaagatgcggtacagctttcggtacccggtaaatctgtcaagttagcgcaacaatattccactaaattagtttggacattagaagatacacctaacaactagtttactgaaaagaactgttaaaaataaatacgtagtcatattgtcttgcgaggtaatcgagcaaaaattgtcaaaggctaggctaaatttgtttggatacgaatagttcatctaggaatttaacgatcaggaggaaaagatatattgaaaaagaggaggatcgtgctcattttaagcagtctcttagtgactaatatctttccgatcatagggtactctttggaattgaatcagttggagcatggaaatagaagagacgaagaaagcaaactcacttcgacattcgacagtttaatagaatccaaccagacacaagaaagcagtgaggatttaagtatttcgagtagtggagagaccactgacaacgtagaagctgagggttcggacaaacaaggactagaagatgcaccaatttctgcggttgagctgcctgacgatcccaatattatttctatcgataaaatttttcaaacacctatcggtactagcacgtccatattggaaaatgggaagttactgcagttgaacccagcagaaaggtctcaaagaggagctatttggtcaaataagaagattagtttactctcggattttacatttaaatcttatttatacttaggaaatcaacgagatagagcgggagatggcatgacctttacattgactggcgatcctagaatggctagtaatcccagtcaagttattggatcgccaggtatgggaattggctcatattctactcgttctggccaaccttacattgcgaatgcgctctcgattgagtttgatacgtataaaaatagtggttcttctgatcgaatggatcgagagataactgctgataatagagggcatggacatgtcgcttttgtcacgcctaaaccaaataataataattattctggagagcatactggcgtgacggtagctcctacatttctttctaatggcacatggcgcttgttaataattaaatgggacgcggagcaaagaagtcttacttatgatttggaaggtgtcggtcgctcttctcggattatacctgatctcattaggcagtttggttctacagaagtaaattgggggtttacttcttcaacaggtactttttttcaagaaaatgctgtcgctgtcacgcgacttccatcgaatgtcacatcaacagctgatgtaaaagtcaacgatagtgattatggggccatcgctgaagctggaggaaacgataagataactatcagaaatacattgaaggtcgagggggattttcttgaatataagaaaatgcagactagtatcgacctcccacaagaattaactattcccgagcatatcttgatcaatggaaatcaaattgatgccaaagatatcttgataaccggaaatcgagtcacgctaaatctgacagattattttattgctggagatacgttaataatcgaattggagacaactttgcaggaagtaattcctgaaaaagtactcactatgcattttgaataccttgaaaacgggaatttgattgagcaatcgaatgaaataaacctaaagatcgcaaagctgaaggagatagatatccatgtttattataaagataaagacagtcagattgatattgctgaaatgaaaacaatcactgggaaaataggagagaagtataaagaaactcctattgatattgaagggtatgtttttgactcggattcagcgaatacagaaggcatcttctccgaaaatacagaggatatctatttttattacagaaaaggcaaactttatctctcaactgctcctcaatatgtcaattttggaaaacataaaatatccagtagaccattaagtgaattcggacagttttcaggtgggttgaaaattatagatgaacgggcttttggaagttggaaattacaattgaaacaagagaaagttcttacaaatggagattttgagcttccagaagctctttcctttgttacctctgaaaatacaacggttatagggacatccgctgttacgattttcgaaagtgatcaaaagggtgaaagcgatttgtcctctcttttagattctacagctcatcgtggaatcagaataaatattcctgtagaaaaccaaagaatcggaacctttgaggggaaactatcttggatacttgcagatgtcccaggaaattaacaggaagagaagaatataacaaaattattgagtttcaagaagggcacaggtaccataggctcttgtgtcccacagagacaagattttgttatagtcttctcttacatatgattaaaggagcgattttcttgagaccaaaacaacaattatttataacactcctagttattttaggggcactttttaacaatatatcagtgtcagctagtgcatttaatttttcagtgacgccgataacttcagagaatcaaatcgacaagagaaaaacttacttcgatcttcaacttgatccggatcaggaagtagaagtaaaagcggaattgagaaatgatacagaaaaagaagtgaaaatcgatatttctgtgaatagcgcaaccaccaattcaaatgtgatggttgaatacggaaaaaacgagattgaaaaagacatgagcctgatctttgatctggtagattatgtgagctatccacagatagtgacgctaaaacctaaaagtgtccaaaccgttgcttttcatgtcaggatgccgaatgagcgatttgatggtgtattggctggtgggatcacattccaagaaatccagacggaaaaggaccaaacagaaactaaggatcaaagcttatcgattgagaatgaatacacctatattattgctttgttgatgcaacagacactgaacgaagttgctccgaaccttactcttcatgaagttaaaccagatcaaatcaatgcaagaaatgtcatcttagcaaacgttcaaaatgatcaaaaaacctatatcaatcaagtagttattgaaacaaaaattacaaaaaaaggacattctgaagttttatatcaagaggaaaaagaaggattgcagattgcgccgaatacaaatttttcttttccaactgctttaaatggtcaaccgctaaccccaggtgaatatcaccttacaatgactgttttaggaaatgaaaatgaaaatggaaaattttcgagaaaaaaaggaaatactacgatcaactataccaatcaatgggtatttgaaaaagattttacaatagacggaaaagtagccaaggaattgaacacgacggatgttacgattaaaaaagacaataattggatttatatcttagtagcttcacttttcttattgtttattttattatgcatacttttgtttgttttgagaaaaaaagaagagaaagaaaagtaaggttaagataacaaatagtaaatttttattattgtaggatggttgggctctttttataacaatataaaatataccattttattaataaaaatgcatactagtaaatgatataattctaataacaggtttgatcgcgagaaaggccaaataaaacgctctccaaaatgttaaaaaaaagacaggacgatgtatattatacaaacaagaatcgctgacaacagtgactcggatccaggaaatcagttttatccccagctagttggtgaatgcatggaaagtaatatacgtagaaagagctgatgactaatgaattatgagttttttttaagcaaagaagatcacagaagttattcattacttaaatatttagaagcaagctcaaatttatcagagtcaatatcgaatgttcaagaagagttgtcgctatcgacatttctcttgaaaaaaacgatcgataagctgaaacatgatttacaaaagttcgatctagagaaaaatttgcgagtaaccgtcagtgaattggatatatgtctggaaattaatggaaaatgttctagcaaagctctgttatctcgttatataacggattctttatctatgaaaatggtattggctttctttcaggaaaaatatatctcagtagaaaattttgctaaacagcatcacgtgagttattctgtggcttataaagtattacaaagactaaaaagaaatctaaaaaaatatcaaattttttttgaaaagagaaagttgacgagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctcccaagttgacagggaatcctaaaaacattcggctttttttatataatctttttaactcaacagagataagttttgtggaattgtatacgctacctataattataaaaacagaaaaaatgttaaaagatttaaaacagtattatcctctgtctgcttatgaaaaaaagaaattattccactttttagcaatcaacctgttggctgaacaagctgattctttagatattgctagcaatcagtcgctatttttttcggatataggattttaccacttaaaaggagtattaggagaaaaatccgttatttttatcaataagacactctcttggctttatcttcatgataaattggatcaaaaatacttgagaaaaaatgaagatgaaacaatcgaatggttgaatgaacgattcattgaaagttttgaaaatcagtttaatctgttgcgagaagagacgagccaattgatccgaagagagttaaccaaaatacattttaaacttttgcattacactattaataaagctgatgaatttccacttgatgtttctttttttagagaaaactatccagcattttattgctatttgatagagtatataaatgatctaacgtcaaaacgcaaagagttgcttcaagataaattttttctttttttcagttatttattattattgatcaatcacatacccattcaactgatttctgaaccagtaaagatcatcatcgatttttcttatggtgctgcctataatcaatttatcaagaaaaatttaagcttgtacattaatctgaacacggaagtgatagaggcaggaaagcctgagttcccggatgttataatcacgaataggaataatctatatgaagaaagtgcatctcaagtagtggtttggctcgatccgccaagagcagtagactgggggaatcttacaaagattttgttgactatccaagaagagaaatacaaagacagcaaaattgacaagcaaatagacgattttcctgaagaaatcatcgacaggatcgaatagtgaacttcttttagaaagtccgactgctttttctaaaaatattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaattccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatcttttttcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgaaataaaaaaacttggtacgcaatcgctgtaccaagtttttttatttagcttttgattaagccataaataataatttatataagaatactgctacgacaccagcacagataggtgctacaactggtacccatgcatatccccattgagaagaacctttatgtttcaatggaagaagtgcgtgtacaagacgtggagcaaagtcgcgggctgggtttagtccaggacctgtaggaccaccaagtgaagcaactaatgtccatacaaggaaaccaagtgctaagtgagctgtaccaagattatcttggaagaatggtgcttttgtaatacctagggcaccaaagaataaaacgaatgaaccaaagaattcattgacgaaaccattgaatttagaaccaacgctgttgattgttgagaatgtacctaacacatggtttacgtcttctgtttggtcgtagtaaggtttgtaacaagctactacgatcaattgtccaatcgctgcaccaatcaattgtgcaatgatataaggaacaacttcagcccaagggaatagaccattagatgctaaagcaattgtaaatgctgggttgatgtggttaccgctgattccaccaaaaatcattgctggcatcataaccccgaatccatacccgacagcaatcagcatccagtcactgccatatccttttgtaccttttaaatctacgtttgctacagcaccgttacctagaacgattagtaatgctgtaccaatcatttccgccgcaagacgggtcattagtgagtaatccataaatacctccaaaagttataaaaatgcaaaaaaaaaagaaacatcaacacgaaaagcatcggtgcagtgtttcgtgtcggaaggatttctgcagtcttaacaaatgtgaataaaaaaatgaattccattacttataagaaaccagaccaacagtaaaactccaactctttttaaaagttctccacaaatcaccaagcttaactataaatataccaaaaaaaaacgttttttttctcaaaaattgtatcttagaaacagcatgttttgaaactttcagaaaaggtttgttagtaaaatgaaagctatacgtaaggagtgttgtttgatgaaattttttcaagagtttttcattattattttcttttctgtattaggagaaggcatacggatttttgctcatttacctattcctggaagtatcttaggtattctttttttatttttagcatttgaaatgcatcttgttgatcctgaaaaaatcggagcaactggtgattttttattgaataatctagccattttatttgttcctgctggtgtaggtttattggaatattttgatgatattgcttcgatatggcctgttttactgggagcagtcgtcgtgtgttccatcgtcacgatggttgcagcgggaaaaacggcagaaggtgtagaagctttgctgggctatgtccgtaagaaaaaagcagaaagggtatctgtaaacgaaatggaggagaatcaaattgactgagttttttgtgaatccattatttggcttaagtttgactttaggagtgtacgtattatctgacaaatttttgcggaaatataaactgcctgttttgaatcctctcgtattatcgattgttgttattatcttatttttgcatttttctgggatcagctataaagactataatatcgggggcaattttttgactatgctgattactcctgcgacagtggcacttgccatccctctttataaaaacttccgtttactgaaagagaatttttatcctgtaatggctgcgattttagcaggaatagtcgcaaattgcttggttagtgtagggttcggttacttcttctctcttcataaagagatggtgatctcattactacctaaatctgtaacgacggctatttctgtcgatttatctcatacgatgggcggggtgaatgccgtgacacttgctattgttgtctctacaggtatttttggttcgctgatcgccactcatattttccgcctattcaagatcgaaagtccagttgctcgcggtgtggcgttaggaagtacttctcatgctattggtacagcaaaagcaatcgagattggtgaaatagaaggaatcatttccggacttgcgatatgcgtcaacggaatattgaccgttttattgctaccgttattctttcagccttttgctggcttgttttgatgcgaaaaccactattttatgctacaataaccaaaacgttcgagcataaaaaaggagggaaagacgtgtatttgtcttccgagtatcttaaacaatttgataaagatctatattataagattctcctcctagaaagttttgaggatcaagcttggcataccgctgcacaattagcgcaagttgttcagctggatgcccgcagcgtgtcgaaatacctgaacgagctgtctaaaaactatcagcagtttagcggtaagacacaccctttgtttacaaaaaatcaccgttctggttataacttttatgatacgctcgattcaattgaacatgagcgttttttgatctatctcgtgcaaagtacgctgaaattccagttgctgcacgacattttttttgaagaattccatacaatgtaccaatttgcgcaaaagcattacattagtgaatctactgctcatcgaaaaatcaatgaatggaaacagcaactgcaaacttacggaattcggctgcaacgaggtacatatatcgctcaaggcgaagaagaaatcattcgactttacttgcatatgacattctggcagttgtttcgagggaaaatctggccatttgaaacgatttctcaaatggacgtaaagaatatggcagaacatatcatggctttttttaatgttcgtctgaacgagatcaaaaaaagacgattggaatatatgctaggtgccttttttttaagaaaatcacagaagcattatgttgtattgaatgagaaaaaaagacggctgatttctgacaatctgttgttccagcgattttgccaggtcatggagccggtatttcctaattattttcaagtagaagacgagttaggcgcattatttcttgtactgatgactcgtgaagaatattatagtgatcctaagatacggaagaaaatttttgattttcatcaacaagcaaaaacaccgccctttacagccctttcagaagcaaaagccgctctttctctttatcaggaagagcaggggctgccagcagaaaatctaaccttcgaggcagaaaactatttattcagcagtcattttttcgcctatctttttcctaatgcgaaagaaacgattgatggcaatagtagtgattttattaatcatttagttattgaaaacaaggaattgaaacaatggctcgtacatttttttgaaagtagacacaaacatcccaatcatctggcatttaaaaatcatgcgtttttgatggggcggtatctgactgtgtttaaaacattaggagcctttactccacagcttccaaagatcacgatccttttaatgacagatttcccattatttgaagagcaactgttagaggagggattacggacatttttccgtaatgagtatcagctgatttttctgccaacagattatcgggggagagaagttgatcttctgatttcgacaagtaaagtccaccgcaaaccatgggcggatcttgactattttattgtgactgaagaactaaaattaattgattacatccaactatctcaaaaatttgaaatgattcaaaaacaaaaactattaaaacaataacaaagaaggagaaaaaagatgacatttgaagaaattttaccagaattgaaaaaaggtgcaaagattattcgtaaaggatggagtggatttgaactttatgttgttctcgtatccgatgatgaatttgatggctgtccggtgacgccgtacttattgatcaaaacaagtgacgaaggtttttccagcttcgctcctacagtttgtgatattttagcagatgattgggcgatcgtagaatgaaaaaccagtatccagatctagctaaacaggttgtatttatcacaggagctgcttctggaattggtgctgcgcaagcccgagcgtttcttgaacaagatgcttttgtatttggattagatcaaaagttcggtaaaatggaagaaatttctttgcgatttcctgaaacttttgcctacgcactaggtgatgttcgacaaatgaaagaactccaacaagcggtatcgaaatgccaaaatcattttggtgaagttacgattttactgaatacagcggggatattggatgcctacaaacccttgatggaaactgacgaatcgctgtgggatctgatttatgagacgaatgtgaaaagcatgtatcagctgacaaaaatcatccttcctgatatgatccgccaaaaaagcggaacgatcatcaatatggcttcgattgctggcttgattgctggtggaggtgggatcgcttatacaagcgcgaaacatgcgattgtcggatttaccaaacaactcgctctggattacgcaggacagggtatccgagtaaaaggaattgctccaggagccatccaaacaccaatgaatgcggctgattttgaagggaaaggtgagatggcagagtgggtggcaaatgaaacaccagtcaagcgatgggcacagccggaagaagtagctgagctgacgttatttcttgcctctcctcaagcaagctacatacaaggaacgatcatcccaatcgacggcggatggttgttaaaataaccttgtgtttttttcaagcttctgtatgataaaactaaagagagaaacaacggttgatgataaaaaaagtcgatgactgttcccgacattcgatgccgaacagccagttcaaaaaattctttttaataatcgttaatattcgaaactaagcggcttttcacgacctcttgatataaacgatattcaaaagcttgcaactgcggtaacaagtccagccaaatgaaaaatataaggagctatttttatttgaccattcttattacttgttgcagggcagctttttcactaccttctgcgacacttcagttggaattttcttcccatcctttggtcgcggtcattaccaagataaaattatcttgcaaaggagaaatagaacatggaaaaaaataatacccgttcagccaaacgctggacaacgacagatgtgactcggatggcgctagtcactggtttatatgtggcagtgacgctggttttgtctgtctttagctttggagtgattcagattcgtctctcggagatgttcaactatctgtccttgtataacaaaagatacatcgtcgcggtaacagcgggagtagctttggctaatattgcttctcctcttggactgatagatgttgcagtaggaagcgtcagcacgctgcttgtattgcttatcaactataaaatcactagtcgcatcaaaaacatgaaaatcaaaatggccgtgacagcatgcgtatttgctttttccatgtttacagtagctggtcagctaacgattttatatcaactaccttttttcttgaattggtgggtgattgctttaggagaattggcatcaatgattgtcggtgggataattatttattggatcggtaaaaaagtggatttgtcaaaataaagatctgtttaatttaaaatagggcagcatggaagagactgaatgttgagtcttcttccatgctgcttttttgattaatttgtatgaagaaatcgatttagccgttttttcatcaagataccgatataagctgctccagttgccttgattgcttccggcagtaaaaacggcagtagtccactggcaaatgcagttgtaaaagtaagatcaccacttattttcagccagatcgttccgcagatcaatgcagcaagagagcccattagattggcaaagattgcatataagtaatgagcatccgttctttcgatcatccaaccagttatccacgtttgtaagagaaatccaatcaaatatccgccagttggcccaaataaaacagctatacctccagtcatccctgaaaatacaggaagaccaatcaagccaagtaaaagataaactccaacagatatcaatcctagttttcttccgagaaaagttgctgttaatccaatagcaaatgtttgccctgtcaaaggaaccaaaccaaaaggaatggtcatctgagaaaggacagaaataatcgcggcaaattccgcagcaagtatcaattctttcaatgttcggttcataacgccctcttttcgttaacttaatatttttatttggttaacgaaattgtaaaacaaagtgattactttgtaaatagaaaatataaaaaaagaccagctatccaatagatagcggtctttttcaagaaagcttttgaaattataagctttggttgtagtattcaacgacaagagcttcgtcgatttctggatatagttcgtcacgttctggtaaacgagtcaatgaaccttccaatttttcagcgtcaaagcttacgaatgctgggcgtccaacagttgcttctacagcttcttttactgttacgatgttttgtgatttttcacgaactgagatcacttgacccacttctacgtggtatgaagggatatcaacgcgtttgccatcaactaaaatgtgaccatggttaactaattgacgtgcttgacgacgagtcgttgcaagtcctaaacggtaaacaacattgtctaaacgttgttctagtaagatcatgaagttaacaccatgtttaccttctttgattttgctagcttttacgaacaagttacggaattgacgttcgttcattccgtacatgtgacgaagtttttgtttttcagttaattgcatgccgtattctgattgtttgccacggctattaggtccatgttgacctggtgcgtaagggcgacgtgctaattcttttcctgtgcctgacaatgagatgcctaagcgacgagaaattttccatgatggtcctgtataacgagacattaaaatttcctccaatgaatataagtttttggagtaaaataatccgttgaaaaattcataatcatatagtttgttcttcaatcttcacctttgcagccgcggttacacaatcgaacccgagacggggcaacaaactagggatgagttattatttttctgctgcattattttacacaaattacagtatatgatagatcatccacgaatgtcaagataattagtacataaaaacgctttacaaacctaggctgtctttataaaatgagagggtatgtgcaaatggaaaaaagcgaaggaagtttaaggagaaaatcaatgaatccggtatcaccattatttgagaaaatcgatgcttcaattgaaaagaaggcgaatctttttgaaaacagcttttcacgttacgctgttcgagcggttctcgcctgtttgtttttgactttaggaacggctgtggcatttgcgatcgcgatgaagggggaagatatcgcgcatggtctaggaaagattttatacgcatttatgttcagctggggtctggtcatgattctatacatgaacgccgaattaggaacatcgaatatgctttatatgaccgtgggtgtttttcggcagagacttgctttaagtaaggcagccaagattctatttgcctgtatttttttcaatatgattggcggtatattatgtggatttctaatttctatgactacgccatttcaagatttaacgttggacaactttatgttagaatcaatagcagtaaaactagcaaaaccttcagcaacgattttggtggaagggatgtttgcgaatatcgttgtcaataccgctgtactgatcagcatgcggatgaaagaggatgtcggaaaagtgatcacagtcgtattcatcattttcatttttgcttttttaggatatgaacacgtgatagcgaattttcctgcctttacgcttacttactttgcttctcacggacagatggatggaatgacagtcagcaatgtgttacataatttgttttttgctttggcaggaaattatattggtggcggtttagtaatgggactgggatatgcttggctgaatcagtcaaaatcatcctatgtggactaaaaagtcgttcattaaaggggaagtgccatggaagttttagtttttccaaaaaatgaggaaaaagcgttacaaatggaaaagtacatgaaaaatcttttttcctttgctggagtacctaagccggaacgcgctcttttacaacaaccgttactggatgagagcaaaaatttatctatttctgaagttttagcttttgttcattattattatgaacaaatcgaaagagagtatcagtatgtagcgatcgatttagtccagaaaaacatcaaacggcttacatttgaagacttagtcgtattgttgccactagttcagaaaaaagaatggtgggacagcatcgactcttggagaaaagtatacagcacatggtgtaaagcctacccagagcagcgtgaagaagtctttcaattgtttgaaaaaaaggaagatttttggctacgtcgaatagcaatcacgttgcaattaggttataaacagcaaacagacacaggactattgatccgagcaatagacgaagatcgtcaaacaaaggaattctttatccaaaaagcaattggttgggcattacgcgattatagtaagaccgatgccgattgggtaaaaagacagctgacaacagatttgagtaagttagctgttcgagaggcaagtaagtatttataagaaagcgagacgacaagagatgagacgcaaattatttgcttttgatattgatggaacgttgttagattcaaacaaacaagctttagatagcacaagagaagcattggaaaaattacgcaaagccggtcatctggtcacgattgctacagggcggagccgatttcatgcgcaagagatcattcgcgatcttgattttacgaactacattttatgtaatggagcggccggttttttagaccatgaacaagtatataagaatttactagatcgcgaccagttggatgcgttcgttcaagaagcgcatcatgagcagatcgatacagcttttgtcagcttagacaatatcaagcgttcttcttccaatgatgtaacggtgatggaagaagcgatgcattctttcggtgctgtcttgcctgaattagatcagttttttgcagaggaacaagaaatataccaagcgttagcatttttcgatcaaacatatgatgggaagttctcttcatatgataaaattcgatttgtccgctggcatgagaacagtgtagatgtcgtacctaaaaatggttctaaagcagcgacaattctgcacttagcagaacaagtaggcatccctcatgaagacatcatcagctttggcgatggacaaaacgaccgtgaaatgttgcgcatgtcaggaattgggatagctatggggaatgctgtgccagaagtacaagcagaagctaagatggtcactgatacaaacgatcaggatggaatttggaaggcattgaaagagttaagcgtgatttaaaagaggttgtgaaaaagctgttctgcatcaagtaataagcccagccaaacaaaaatagctcctcctatttttcgtttttctgggcttattaccgcagatgcaagctttcgaacaccgtttaaggaagaggtcgtgacagaagtggtcagtttcaagaaataagaagggatttacgaaaattgcttctcaaatttttgtaaaattacggcttatttctgaagaagtagatgaaacaacgtttattcgggaaatgggactgtgacaagatgtttgtcatagtcccatttttttattttatttttcaaaactaagaaataccaggaaagagttccttttgtttgaccttttctttcttattgaaaacaactataatatagagtgatgttaaaagagaagaggaatttagtgtgcgggtattgtttattggtgatgtagtaggttcaatgggacgagagatgattactgaatatcttcctagattgaagaagaagtaccgtccgcaagtaacgattgtaaatggtgagaatgccgcttctggacgtggaatcacagaaaaaatctataaaaaatttttgcaagacggcgtagatgtcgtgacgatggggaatcatacgtgggacaaccgcggaatctttgagtttgtaaatgaagctaaaaagatggttcgtccggcaaattttccggaagggacgcctggacaagggatggtctttgtcaaagtgaaccaagtcgaactggcagtgatcaacatgcaggctcgttcttttatggtggacttggatgatccttttcgtaaaatgaatgagctggtagaagaagccagaaaacgtacgccgatcatttttgtagattttcatggagaaacaacaagtgaaaaacaagcaatgggctggtttttagatgggaaagtttcagcagtggtcggtacacatacacacgttcagacaaatgatgcgcgaattttgccaagaggaacagcgtatctgacagacgttgggatgacaggtccctatgatggtattttgggtatgcgcagagaacctgtaatcgaaaagtttctgactgcattaccaaaacgttttgaagttgtggaacaaggccgatcgattttaagcggctgtatcttggaattggatgatacgacaggtcatgcaaaagaaatccagctgattcagatcaacgatgatcgaccgttcatggagtagaaagagaggcagttttttgcagcaggagccggaaattcaaaaagaagtaaggaaactgacaaaacttttaagagagaatgaaacgatcattcgctacaaagaacttgaagaaaagatccagcaaaaccagtatttagctgagttgagagaaaaaatcaaacaagcgcaaaaagatgctgttcattttgcccactatgacaaaccagcagcagaaaaagaagcaatcaaacaagcggatcaattcatgcaagaatttgatcagcatccgcttgttgtagcttatagaaaacagctgttggaagcagatgatctgcttcatcatttaacaactatgatacaagaagaaatcaatggacaaatagaggaggaaaaacatgcctcaaaaaactaaaaatactcctatgatggaacaatatctaagcatcaaggcccaataccaagatgcttttttgttctatcgtttaggagacttttatgaactattttacgaagatgcgatcaaagcgtcacagcttttggaattaacgttgacgagcagaaatcgaaatgcagaagaacctattcctatgtgcggtgtacctcaccatgcagcacaaggatatatcgatgccttgattgaaaaaggctataaagtagcgatttgcgagcaggtagaagatccaaagacgactaaagggatggtcaagcgcgaagtgatccagctagtcactcctggtacagtcatggacagcaaaggattgtcggcaaaagacaacaattttttaacagctgtagttagtcaaggaaatgaatttggctttgcttatgccgatttaagtacgggagaattgaagacggctcggttgcatgatgaagaagctgttttaaatgaagcctctgcattgcagacaaaagaactcgtattaggcagtgagatcactgatacccttcgtgaacagctaagcgggcgtttagggctagtcttttctcaacaaaatgagatggaagaaaacgcggaatttagctttttgacaagcgaactagtcgatccgctggaaaaagaagcaaccggcaaactattgacttatttatcggtgacacaaaagcggagtttagctcatatccaaaaagcagtagaataccaaccagatcattttttgaaaatggattattattcaaaattcaacctagaattaagccaatctattcggactgggaaaaagcacggcactcttctatggttgttagatgaaacaaaaacagcaatgggtggccgtttactaaaacaatggctagaccgtccgcttatccaggcaaaacaaattaaagcaagacaagaaatggtcgcttctttgctagacagctattttgaacgtatcgatttgcagtcagcattaacgaaagtctatgatctggaacgcctagcaggtcgagtagctttcggtaatgtcaatgggcgagacttgatccagctgaaaacttctttagaacaagtgccaatgatcagagggttgattgaaggaatcgatcaaggtcaatggcaaagtctgctttcagaaatgcagccgatggaccatctcgtccaattgatcgaccaagctatccaagatgatccgccgttacaaataacggaaggaaacatcatcaaagatggattcaatgagcagctcgatatgtaccgttctgctatgagaaacggaaagaaatggttggcagaacttgaagcaaaagagcgtcaagaaacaggaatcaagaacttaaaaatcggatttaaccgcgttttcggttattatatagaaattacaaaagcaaatcttggaaatgcagaactggagaagtatgaacgaaaacaaactttagcaaatgcagagcgtttcatcacaccagaactaaaagaattggagacacaaatcctcgaagcagaagaaaaatctgttgatttagaatatcagttgtttttagctgtgagagaagaagtcaaaaaggctatccagccgctacaagtacttgcaaaagcaatcagtgcagtagatgtgctacaaagttttgcaacgatcagcgaacgctatcagtatgttcggccagaacttgtcagtgacaagcatcagcttctgatcaaagacggacgacatcctgtagtagaaaaagtattaggacatcaggaatatatccctaacagcgtagaaatggcagaagacgaaatgatcttgctgattacaggaccgaatatgtctggtaaaagtacgtatatgcgacagttggcattaactgttctgatggcgcaaatgggctgtttcgttccggcaaaacaagcagttttacctatttttgatcggatttttacccgaattggtgcaagtgacgacttaattgctggacaaagtacttttatggtagagatgatggaagccaatcaagccctgcgttatgctacgccaaacagtttgattttgtttgacgaactagggcgaggaacagcaacctatgacggaatggcgttggcccaagcaatcatcgaatatatccatcgtcatgtacaagcaaaaacactcttttctactcattatcatgaactgacggtacttgagaaagaacttccgcagcttaaaaatgtccatgttggagccgttgaaaaagacggagaagttgtcttcttgcataaaatgatggatggacctgcggataaaagctacggcatacatgtggcaaagatcgcaggattgccttccaatctactagaacgagcagcagatatcctgcatacgctagaaaatggcgataacggacaccatactgttccagctgaagtagaagagaaaactaaaacagccaaacaggagcaaataaaaccacctgcagaaaaagtaaatcaagaccatatacaagaccgtgtaaaagaagaaaaccaacagctttctttattcagtgaattatccgaaaatgaaacagaagtcattgaatcactgaagcaaataaatttactagaaatgacgccaatggatgcactaaacacattatatgaattacaaaaacaactgtaggaagaaggcggatatcgatggccaaaatccaagaattatctgaacgtttagctaatcagatcgctgcgggagaagtagtggagcgaccagcttccgttgtgaaagaattagtggaaaatgcaattgacgccggcagtactcagattgatatcttagttgaagaagcgggactgcggacgatccaagtgattgataacggagaaggcattttggcagacgacgtagagaatgccttcaagcggcatgcgacaagtaagatccataatcgcgacgatctttttcgcatacgaacgctgggctttcgaggggaagctttgccaagtattgcctctgtttctgaaatgactctggaaacggcgaatcaggaagaaaaacaaggcacctatctgtcgctgaaaggcggagaagttattgagcatcgaccagcaccactgcgtcaaggaacgaagattaccgtcagcaatctgtttttcaatacgccagcccgcttgaaatacgtgaaaacactgcacacagaattagcgaacatcggggacatcgtcaatcgactggcattgagtcatccatcgattgcttttcgtttagtacatgatggaaacaaaatgctggcaactgctggaaatggcgatctgaaacaaacaattgcgggaatctacggattatctaccgcaaaaaaaatgctgaaaatcgaaggaaaagatctagattttgagttatttggctatgtttcattgcctgaggtgactcgtgccagtaggaattacttatcgacgatcatcaatggacgttttatcaagaacttttccttgaataaagcaatcgttgcaggttatgggtcaaaattaatggtcggtcgtttccctattgctgtattggaaatcaaaatggacccgcttttagtagatgtaaatgttcatccgacgaagcaggaagtccggctgtcgaaggaaaaagaactaacagagctaattagtaacgccattcaaaaagcattgtctcaagaaaatctgattccaagtgcagcggataatctacggtttaagaaaaaagtacctgatcagcctaaaacagaacaaatcgaaatcgatttgtcctacgcttttgaagaagaaaaacctaaaaagccaagtagtttgaattttgatcgagagacaggtacctttttcgtagaagaactaaagaacacatttgttgacagaattgttgataagtctgtggaaaatgttgaaaactattctggtttttctgaagaaaacaccacttatccagaaaaaacagcgaaaacggtggataagtttggtgaaaatgttgataactttgtagaaaaaacagtggaaaaatctgaaaagaaagaatttcccattgtggataacatggagaaaacaaatgaagaacaagcagataaatccgtagaagaggatgaaaagatttacgaggaagaattgacactccatcctgaatttgatttcactcaaggaaacgacaaaacattagaacaagccatcaagaaattagaaacggaaaaaccagtacaacgttttcctcagttggaatattttggacagatgcacggaacgtatctttttgcccaaagtagcgatgggttgtacatcattgatcagcatgctgcccaagagcgcattaagtatgaatatttccgggaaaaaattggggaagtatctgatgatctgcaagaattgcttgttccatttgtgttagactatccaaacagtgatgctttgaaattaaaagagcaaaaacacttgctagaagatgcagggatttatttagaagaatttggtcaaaacagctttattgtacgggcccatcctacttggtatcccaatggagaagaagaatcgattattcgggagatgatcgatatgctgctgacaactggaagtgtgagtgtaaaaaaattccgtgaagcaacagcaatcatgatgagttgcaaacgatcgattaaagccaaccattatttgaatgaagcacaagcacgtgtgctgctgaaggatctggcacgatgcgaaaatcctttcaattgtccccatggccgtccagtattgattcactttaccaattcggatatggaaaggatgttcaaacgaatccaagacccgcattaagtcaaagagaagagggaaaacatgaagattgtattagcatcccaatcaccaagaagaaaagagttattggctcatatcgtttcagaattcgagattgaacctgctgatatcgatgaaacgccatttccagacgaacagcccgtcgattatgttcgtagaatggctgaagaaaaagcacgaactgtctgggaacaagatgaaaaagaagaccatttagtgattgccagtgacacgactgttgttctcaatcaagagatcatgggtaaaccagaagatctggctgaggctgaattcatgctgaaaaaactaagcggggaaacacatactgtatatacagctgttgttttaaaaacaaaggaacgagaagaacggatactagcagaagcacatgtcactttttatcctttgacagacgaagagatcaaacgctacttggagacgggggattatgcggataaggcaggggcatacggcatccaaaatgctgcgagtgtattcgtcaaagaaatttctggagattattacagtatcgtaggatttccgattggtgctgtcaatcaggcactgaaaacattcatttaaacaaaaaagcggactatctgattttcgattgaaaatccatgatagcccgttttttttattgaaaagattacttatctactctgactaagattttacttcagctttaccgactgcttcgcccgggcgaacaagtcctgattggtcaagagaaagtcctgcaactttttcattattggtcaaagcaacaataatgtcagttttcttgccagcttgttctatttctggcaaatccatttcagcaatcagggtctctggtgtgacaaggtatccttctttcacgaatacattgaaaggaacaccctttagttcaacagtatctaatcccatgtgaacaagtacttccagcccctcattagaaagaataccaatggcatgttttgtttcaaagacactcgtcactttaccgtttactggtgcatagactttgccgtttgacggttcgacagcataaccgtcacccatcattttttgtgagaaaactgggtcatttacttcagttatttccttgatggtccctgcagcgactgcgaataatgtttcttttgttgcaactgccgtaccagttgctgaaacaggttcgaaagactgtggcgttgctgttgcgccatttgctgtttgaagttgtacatcagcagcattttcaggaacagcaggatcaatcttattcaaaattccctgacgtctaaagatgatcgtcaagccaaatggaatgatgacagcaatgatcattgcgatgatgaaaggtacccatgtttctgcttggatagctagtattcctggcaaaccgcctactccgatcgcgttagctcgaacacccatcaagttagcaaacatgccagctaatccagagccgaccattgcagcgacgaaaggatagacgtatttcaaattgattccgaacatagcaggttcagttacgcctaagtaacaagaaatcattgctggaatcgagatttgttcttcttttttattcccacgatgtaagaagatgatggctaagactgcagagccttgggcgatatttgataaagcaatcatcggccataaattcgttgatccgaaatctgcaatcagctgcatatcgatggcattggtcatatggtggagaccagtaatcactaaaggagcatacaggaatccgaatacggcactaaacaaccagctgatagaagacgtcaatccagtatttacgatatttgagatccagcttccgactgtccagccgataggacctaaaataacgtgtgcagctaaaacagttggtaacaatgaaaacaatggaacaaaaatcatcgagatcgactgagggatatatttgcggaagaagatttctagatacgctaacataaaccctgccagcatggctggaataacttgcgcttgataaccaatcatctggacttgagcaaaaccaaaatcccaaaatggaatatctgctgcggctgtggaagctacactataagcatttaataattgcggagaaactaacgtaattcctaaaacgattcctaatatttgtgtagtacccatcttttttgcaatactccaagtgatacctactggaagaaaatggaaaattgcttcaccgggtaaccacaaaaaggcattgacaccattccaaaacttcgagtgttcaacgattgttccaccaagactttcaaactggataccttcaagtacatttctgaatccaaggatcaatccaccgacaatgattgcaggaatcagtggtgtaaagatttctgctaaaacggcaatagcacgttgaacgggatgaaggttttgttttgcagctgcttttccttgttctttggaaaccccttcaactccagatactgcaacgaagtcgttataaaaagtagaaacatcgtttcctatgatgacttggaactgtcctgcattcgtgaacatcccttttacgctaggtatatcttcgatcgctttttcgtccgcttttcctggatcattcaggacaaaacgcatacgagtcgcacaatgactaactgcagcaatattttcttttccgccgatatcatgtaacagcttctcggcatctgcttgatattttgccatatcaataaacccctttctcttaacttgtctatgcaagttgtttcttcatttactatactttttttcggagagaattgcaagcgttttattaaaaagtacgagagaaaatgatatcgttttaaaaagcttaaaataagcttttcttaaaaataggaacattgaaatacaaaaagagctgtagtatagtgaagaaatgatggaagaacgagtgagggaaaaaacatgaataagttcaatgaaatttttttagatttggaacagaaaattttagcgaaagaatatcctccgcattcgcttttacccagtgagaaccaattgatcaaaatttatggtgtttcacgagaaacaattagaaaagcgctgaatcttttgactacggaaggttatattcaaaaaaaacaaggaaaaggttcgatcgtactggatcggaatcgcttcgactttcctatttctggattgactagctataaagagctacaggagacccaacgtattccaagtgaaacgatcatccatacgttagaagaaacagaagtgacaaaagcattgaacgagatcactggctgggagatcggtgcgcctgtttggcatttgatacgcgaaagaaaaatcaatggcgaagtagttatattagacaccgattatctattaaaggaaatcgttcctattttaactccagcacaagcacaaggatcgatctatgaatattttgaaaatgagctttctttgacgattgcttacgcgcaaaaggagatcacagtagaagaagtaacggaaatcatgaaaacagcgatggatcttcacgatgacacttatgcagtagtagtcagaagcctcgttcatctggaagatacccgctgtttcgagtattctgagtcggttcaccgattagataaattccgtttcgttgagtttgcccgacgccgaaaagtgtaaatagttcaaaagaaagcaaattgttggcatctgtccactttggcgctatgataggatcacaaagggggcatttttaatggataaaccaataagaccagaaaaagaagaactgaaagaaaagttatcacccatggcttatgcagtcacacaagaaaatgcaacagaacgaccatttagcgggaaatatgatgatttttacgaaaaggggatctatgtagatatcgtcagcggtgaaccgttattcagctctgcagaaaaatatgatgcaggttgtggctggccatcattcagcaaaccaataacgaaaagacaagtgcgcgaaaaagccgatttttctcatggcatgcatcgaatagaagttcgaagcaaagaagcagattctcatctcggacatgtgtttaccgatggaccagtagatcaaggtggtctacgttactgcatcaattctgcctcactgaaattcattccatatgaaaagatggatgaattaggttatggggaattcaaatcacttgtagaataatggaaatacacaaagagcggtacaatacggggatttactcgatcgtccgctctttttttattcaagcgattgctatttgaaagaaacgctccctagactccttttttcacaaggtgaaatgtgctacaataaagggaacgtatgtgtgcaaaagaaagaggactagaatatgtatgaatatctgacaggtgtggttacctttatcaacccctattacatagtagtagaaaccaatggtatcggctaccagatcgcactaggaaatccttaccgctacagtagcaaactaaatcaaaaaataaaaatttatgtccatcaggtaatacgtgaagatgcgcatcttctgtatggatttgattcgctagaagaaaagcaactgtttttgcgattagtaagtgtttcaggaatcggtccgaaaagtgcccttggcaatcatggcaagcgaagaccactccggtttgattcaagcagtagaatccagtgatgtcacttatttgacgaaatttccaggagtagggaaaaagacagcacaacaaatgatcttggatctaaaaggaaaattcggtgagctgagtatcgatacaccttttagtctatttgatgaagcaaacacaaaagacgctacagctctatctgaagcaatggaagctctctcggctcttggttacagtgatcgagaaatcaaacgtgtagaaaaacaattaaaagaagtagataatcagacaacggatgagtatctacgccaagcactcaagctaatgatgaaaaaataaggaggagaccaaatgacagatgaatacttgttatcaccagaatctggcgaaaatgaactgagtttggaaaaatctcttcgaccacagctgctttctcaatatatcggacagagaaaagtcaaacaagaacttcagatttacatcgaagctgccagaaatcgggaagaacctttagatcatgttctgttgtacgggcctcctggattaggaaaaacgacgatggccatggtcattgctaatgagatgaccgtaaatattcgtacgacgagtggccctgctatcgaacgtccgggtgacttagtagcaatcttgaatgaactggaagcaggggatgtcctgtttatcgatgagatccatcgattacctagagtggtagaagagatgctttattcagctatggaagatttctatgtagatatcatggtaggacaagggccaaccgcacatccggttcatttccctcttcctccctttactttgattggcgcgacgacacgggcaggtatgctttctgcacctttacgagatcgatttggcatcatttctcatatggaatattatgacgaacaggatctgcaggagatcgttttacgttcttcggatatttttcaaacagagatcattgaagaaggggcattggaaattgctcgccgatcacgaggaacgcctagaatcgctaatcgcttgctcaaacgggttcgtgattttgcgcaagtccaaggagacgggaaaatcgatcgtcctatagcggatcaggcacttactttgctacaggtcgatcaggctggattggattatgttgaccagaaattgttgcgaacaatgatcgagttatatggcggcggaccagtagggttaagtacgctttcagtaaacataggagaagagcgtgagacggtagaagatatgtatgaaccgtatctgatccaaaaaggatttttaaagcgtacacctagagggcgaattgctactgcttatgcctatgaacattttggttacgactatcatatatgatttttgcttttagattggaggaaaatgaatgagtgatacaacacgtacgaaacaattgatcaaaaacgtattgattgatttgtgccaaacgcaatcttttcgaaaaatcagcgtccaaaaaatcgcaaacgaagcaaaaatcaatcgacaaacattttattatcattttacagataaatacgatttgcttcgttgggtctattgtgaggatgcattgcattatttagatccacaatgtctttcacttgataattgggaagagcaagcattgaaaatgctgaaagcaattgctgagaagaaagaattttatgcaaatactgtgctttctgacccagaaattttacaaaaagagttttctcaactgatccaaaaatcatttatcaagatttttgaacaaatggatgaagaaagacaactttctgcaagagacaaactattttatgctcgttttttttcttacggttgcagtggtgtattagtcaattggatcacgaatgaatatgaagaaacaccgatggaaatcgctatgcagcttttccgtttagccaaggatacggaattatattcttatcgtctttatgcaaaagaagagttggaagaacagtaatagaaaaattttttgttggaaaagcaataatcgctaaaaggagatggggaaatgacaaaaattttatttgtttgtttgggaaatatttgccgttcaccgatggcagaaggcttgctgagaaaacgaatagcattagaaggaagggaagcagaattttttgtggattctgctgctacaagcacgtatgaagttggaaagacaccgcaccctggaacgaaaaaaatattaaaccaagaaaaagtagatatgacgaatatggttgctcggcaaatcacaccccacgattttgaaacttttgattggatcattggcatggatcaagaaaatgtagaagaactgaaacgaagagcaccacgctcagcgcaggggaaaatccatttgtttttaagtagcattcctggaaaagaaaaagaaaatgttcccgacccatactataccaataactttgatgagacatatcacttgatcacagaaggcctgaatcattggtggaatatttggattgatgaaaataaaataacaaacaatttgtaaagttaacgctttctttttaaggcgatgttagagcatttccttgtttttttgtaaaatgttaggtaaaataaaattaattaagtaacactttcttagctaaaggaggagtgcattcgatgaacgaagagacagtatcgccaatgaagaagcttacgaagttagttactcatacttcgtatcaactttttgattcttttgtaaatgacactgaagaacatgctaagaatgtacgattgcaaggaaagtttattcttgagctgcaaaaagctgctactgaacatagtctagttatcttacaagtaagagcaaatcgtttgagtagcaagtatgaaacgatctcaggctgggtggcgacaaaaacggtcgaaaaagaccgagtgatgatccgcctacaaaacgaagagcagcagatccggatggttcctgtagaacaaattgaaaaaataacaatcctttcaccagcaggggaacaggaacggttatcaaaataatttataccagatagaaaagcacgtatgagcttgtaccatcaatcattactaatcaaaaataaccgaatgctttaagctgatatcagtaaaacggaacgttttaggatgagtatcatagcatgacagcattcggttgattagttgaatcgattggatggtacaagtttttttgataaaaaaaggtcctgctagccggggagctagcaggataaggagttaaaaatgaaaaagtgttgttagggttgtttgttggtatgcttatataatagtcattagttgtgaatattttgtgacgaaagttttcgaaagttgttaagtttttgagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctcccaagtttttttgcgaaaactatttttatatcatatatatgtctaaaatctatattataaaagaaatgttgtttgatcagcttctcttcggtattagttcaaaacaaaacggcaaagtatatggagctactttgccgttttgtttctctaatactcaggtcagtttatagacgctcaataaacggtgttcaaaagccagtttctcggtattaagtcaaatttatgcaaaaatgtgagaagccattttcacaaaatatttcttaatacttgaaactaagcggctttttcacgacctctcaataaacggtgttcaaaagtcagtttctcggtattaagtcaaatttatgcaaaaatgtgagaagccatttttcaaaattactttttattgctcaaggctgaacgtctctttcacaacctcttttatcaatctgctacttcttctttcttagcgaaactccaaatcagtccgataacaaaaccgataactgctggtacgatccaccccatccccaatttgaaaaacggcaagtagctttccgcaacatataaaagattttgaacaataggtgtttgtttgatagtttctgggcaagcgttcaacccatcaaaaatcgaagcaatcaatgtaaaataagtagtcattcgataaacagccgtacgctgcttaaacaaaggaccaactaacactagtaaaatcagtgtcattgctaatggatagatgaacatcaaaacaggcaacgaaaattgaatgatattcgtcaagcctacgtttgccgctaaacaaggaaggatactagcaagtgcaacaaagaatgcgtaatttctttgcggaaacaaatctgtgaatgtttctgcaaaagctgtaatcaaaccaataccggtcttcaagcaagctaatataacgataaatgctaataagatactgccataagtacctaaataatgatcagcaatctgagccagcgtgatcccgccattttcacttagagcaaagctacctaagctcatagcacctaaataagcgagcaaagtataaatgattcccatcaatataatgctgatcgcaccagatttgatcgtgtctttagcgatttcagcaggttttgttacacccatgttttggattgttgtgacaatgatgatcccaaatgctaaagcagcaagcgcatctaatgtgttatatccttgagtaaaccctgtgaaaaaagcatgctcttgataatttggctgaataggcgcttgatttacagaacctagtggattcaaaaaagcaaggagaagcaaagcacctaataaaaccaaaaatgcaggattcaggaactttccaacataatctaatatctttgtcggttttcttgaaaaccaccaagccagcacaaaaaatacaatactgaaaattgctagatatagcgtctgtctgctaggatcgataaatggtgctaaaccaatctcgaaagatgtggttgcaaggcgaggtaaagcaaaaaacggtccgataactaagtaaagcaagatggtaaaaaccatcgcatatgtttgatttatccgttttgctaattcatatacacctgagcttttcgatacaccaatggcaatcacccctaagaagggaagaccgataccggtaaccaagaaacctagattcgcccaaaaggtagcagcgcctgcttcttgacccaaatgaacgggaaagataagatttccagcaccaaaaaatagaccgaaaagcatggagcctataaaaagatagtctttaaatgataatttttttgtcatacataactcctttacggtttttttaaaagtaacaaaatttcgaaaaatatgcaacaattttcagaaaattccctatataaaacgatggttatttaataacgtaagtgataaaataaaagcgctgaatcatctgaggaggaatcatcgtgacaaagtcgagattagaagcatttactgatggagtggtagccattgttttgagagttcttgtattagagatcaagatccctaatacatctagctttcattctttatgggtcatccgaaatacattattagcttataccatcagctttatatttgttgcggtgatctgggtgaaccatcatcgtatatttcagatggcagaacgaattaattaccgagtggtctggtcgaatatctttttgctcttttggctgactttatgtccttctgttactagttgggtcgggcgtaaccctgaagctttttggcctgagatggcttatgtcttagtatacacgatgtggagtttttcttttggtatcttgatgaggcaaatcatgaaagcaaataaaccagattcccatgtcgtgagagttttgtcaaaggaccgtcgaagtcttatctccatgatgattaacttatgcttgattgccggtgtcttttttgtaccgttgatcgggttattcggacgtttttttgtatctggtatttggattttttcctataaaaaagcagatgcctattatcagcggttgtttccggggaaatagaaaagaggctgggacagaagcttttatctccaagaaataagccgaaatttcacaaaaatttaagaagcaattttcgtaaattccttcttatttctcgaagctgaccacttctgtcacaactactttcttacttcttacgttcatatttcatatgatagattagtaatagaagcaagaaccacacaggtgttagtaataaagcgattctcgtatcttttcctaggaacaagacgacacacacaaaggccatgtaaagaaataccagataattactaaatgggtacaacggcattttaaatgaatgagcttttttgccgaggatacttttacgatatttcatgtgcgtgtagacaagcatactccagataaacaagaaacaagtagtggcaatactgcttactagtgtgaatacttcactaggcatcacgtaattcaagataacagaaatgaaaatgacgatagtagaaaatgtcaaagcattccctggcacatgatgtgttgttaactttttgaattttttaggggcactgccttcttgcgctaaagaacgaagcatacgtcctgtactatatattgcactgttgcaggcagaagctgctgcacttaatacgactaaattgatcaaggaagcagcaatcgtgatcccaatttccgaaaatacttctacaaatggactgttatctggattcaagctgttccatggatagattgccataatgacaaaaagagatcctaagtaaaataagatgatcctgataggaatattattgatagcttccggcaacactttttcaggattttctgtttctccagcgactaatccaactaattctatcccagcaaaagcaaaggttaccatttggaaagctaagataaatccttttgcaccagttggaaagaatccgccatgagaccatagattcgtgatactggctgtgccaatatctgtcgtatagtgggtgaggatcatataagctcctacgaggataaaggcaatgatcgctacaactttgatcaatgcaaaccaaaactctaactcaccaaacaatgagacagccaccatattcaagcaaagaagaagacctaatgcaatcagttcaggaagccactgaggaacaccaggcgcccagtagcgtacatacattccgatggctgttaaatcggccattgcaatcgatacccagcagaaccaatacgtccagccagtgatgaaagccgcttttttgccaagatattctgcaacaaaatccagaaaagaatggttattggtgtttgataacagaagttcgcctaacgcacgcataatgaaaaaacagatgcatccagtaataagataggcgagcaatatcgaagggccagctagctggatagactttccggaacctaaaaacaaccccgttccaatcgctccgccaatagaaatcagttggacatgtctatttttcagtccacgctgcagttcttgctcttcattcatttttaaatcatcctaactaaaaaagtttaattacttccatattaagagagttttctgaaaaacacaactaagattccaaaattttcagaaatttaccttttatgagtaattcataaaaaagaactgcggtaaacaccgcagctctttgtcccaatcagctattgatcctaagcatttaaaatacgtgaaaggaattcttttgtacgttcttctttcggatggacaaagatatcttctggtgtaccttcttctgcaatcacacctttatccataaaaatgacacggtcagatacatcttttgcaaattccatctcatgcgtcacgataagcattgtcaagccagtatgtgctaagtctttgatcgtattaagcacttcgccaaccatttcagggtctaacgccgaagtaggttcgtcgaatagcaatacatctggattcattgataatgcccgagcaattgcgacacgctgtttctgtccaccagataattgtgctggtttggcttcgatataacgatccataccaactttttccagattttcgattgctacttttttggcagtttctttatctcgtttcaggacagttgtttgaccagacatacagttttccaagacattcatattgttgaacaggttgaaggattggaaaaccatacctagattcgttcgatatttaggtaaattatatttaggagctaatacattttctccattataaatgatctcgccgcctgttggtttttccagtaaattgatacagcgcaagaaagtagatttaccagaaccggaagaaccgatgatcgtcacaacttcacctttattgactgttacgctgatatctttcaatacttcattttcaccgaagctttttcttagatgtttgatttcaataattttttcattcatgattcttcctccttattcctgcaaatttgaattgtcgatttcttcaagcttggtataagctgaaggaccatcgattttcttttctaccgcccgcaggattctggtgatcgtaaaggtcatgactaagtagatgatcccgacgatcgtaaatgtttggaagaattggaaattcgcaccggaagcagagtttccttggaagaacaaatcagctacgccgattacacttaaaactgctgtatctttgatattgataacaaactcatttcctgttgctggcaagatattccgtaaaacttgtggaataacaacttttctcatcgtttggccatgggtcataccaatggcttgcgcagcttcgaactgcccttcatctactgcaaaaatccccccacgaacgatctctgtcatgtaagctccagtattgagagagacaataaacaaagcggcaatcgttcggttcaatgaaatgccaaaagcgagtgccagaccgtagaagatgaccattgcttgtaccatcatcggtgttccgcggaatacttcgacatagatagaaagaagtgcatttccgattttttggaagaagcgagtcagtgcatttcctgattcaggtaccgaacggaagacaccaatcagtaatccaagtgtagtaccgacaactgtcccgatcaatgcgatgaacaaggtaagtccagcacctcgtaagaacatattgccgtattgtttccaaatcgtagtgaaatcagaaatgatgccaggtttttcttcactatcagttgcagcaggctgatctttgactgcttggtccataattttggttcgttcatcgttagagatgccagaaagaatctggtttactttttggatatccgggtcgcctttacgcataccaacagaaatctgaacatcttccgggtttgtctggaagccatctgcaccgctgaattcaagcatttccaagtctttgttcacactagttgccgttacaccttccggacgttcgctgacataaccatcgatcattccagaagctaaagctgttctcattgctgagaaattatccattgcttgttgtttctgcacatctggtatctgatcgatcacagtatagtggaatgtatttaactgagcagtgatctttgctccagaaagatctgctaaactttttgcttttgcatatttgctatctttttgaactactactactaattgtgattcgtaataaggatcggtaaaatcaatttcttttcgtcgttcagcagtagggctcattccggcgatgatcgcgtcgatcttgcctgattgaagggcaggagccagaccatcccatttcgtttggacgatgactaattttttccctaaaccatctgctacttttttagcgatttgaacatcataaccgccggcgtaactattttggccttgaattggcaaggcattattctcatctgtttgttgagaccagttgaagggtgcatacccagcctccatacctacgcgaaactcatcgctcggtgttttttcatctgcatttgccagagatcccacactgaatagtgagaagacaaaagcaaatagtacggcaactgaaaccatattttttttcatttttttctccctttctgattatatgatacacgagcggtctagatgaaatgcggtaaagctttatctgaaaaaataaaaagcgaccgatttatagatataaaaaggccgctaaaattccataaggtgataaacctctcacaaaacatagcgcaacttagcatcactgctaagacagtccgcaagctcttaacttgcgtcccaacatacactccaagcaaaaaagtgcacatttcggcgatcctccctattcctgcttctccatgtttgcttcactccacagggttaatgattctcgcgacctctacctcattgattgaggcatctcgtattcagttatttatacaaaaaaagtttacgatactcgagaggctttgtcaatctataactgctggtttttgaaaaaatactgataaatatagaaatctttacttttaccgaaaaaacaatcaaaatgtgaatcatctatccattgcaaacgatagtataattatacacaaaaatgtatgtaatacaataaaaaaagaactagaacagaaaatttcctgtgtccagttccatctcgatcatttaagctgccgctttctttggctcacgtcctaggatcgcttgcaaaagaacaacgacgccataaatggctaatattagataaatcaaacttgagtattgggtgattccccagccccatgttcgatatacggctaatgtaatggctaaaacaattgcggcaatcacgttgaataaagcaaaagcccaaagatttccattttctttgcgtacaagataaaaaacagagaaataaacgcttaacgctaaccaggcgatacaagccagaataacgccccaataaataaagaatggtaacatatcgattcacctcacttttatacagcagtattgtaacacgttttcattcttttgtcagtgaacattgtgataaattgctcaaatgcccataacacttttttattcccatttttctgacttttcaacaataaatttgttcgagtatgggctataatggaaagtgaggtgacaaaacatgaaacaattaacagtagacgaagcagcaaaagagatattagcttatcagcaaattacatttttgaccggtgcaggggtatccacaccttctggagtgccagactatcgatctttgtcaggaatctaccacgggatggagcagccggaatacttgctgagtcatcaagcaatggtgaatgaaccggataaattctatcaatttgtcaaaaagatttatcatcctgaagcaaaacccaatatcattcatttggaaatagcacatctagcgaaagaaaaaaatgtttgggttgtttcccaaaacatcgacggtttgcacgcaaaggctaaaagcccgcaactcgtcaattttcatgggagtctgtatcaatgtcattgtcgaaaatgtcaacaaacggtagactggaaagaatatcttcacagcgacaaacatcaagcatgcggaggacaaatacgcccagacatcgtgttatatggtgaagggtttcaagatggagtcatggagcaggcggcttatgccgtcagccaagcagagctgatcgtcattgttggaacgagttttcaagttcatccgttttgtgatctggtacagtttcgccagccgtcagccaaaatcttagtaatcaatcaaacgcctgtttatttagcggagccttatacgtttattcaagaagacggagcggttgttttcaaaaaaatacaagaattaggagcagattatgactgaattcaaaaccgaaaaagaaaaaatgattgcaggcgagctttattttgccaatgatcctgagctggttgccgaccgtatgtttgcaagaagtcaaagccaaatcatcaaccaagcagaatcagcggaactgcgatcccaattgttgaaagagacttttggccgtacagggaaaaaaatctatatggagccagttatcaattttgattacggatataatatatttgttggggagaatttttatgcaaatttcaattgtacatttttagatgtcagcacgattgaaatcggtgataactgcatgttcgctccgaatgtccagctttacacggcgacgcatccactacatccagtgaaacgtaacagcggtctggagtacgcaaaacccattaaaatcggtaataatgtttggttaggcggaggagttatcgtcacgccgggtgtcactctaggggacaacgtagtagtcggcgcaggttcggttgtgaccaaatcttttcccgacaatgtagtgattgcaggaaatcctgctcgtatcatcaagacagtagaggaagaactaacagaagagtctcttgaaacattacgtcataagatcgatatgatcgatcgagagttggttgctttattagaaaaaagaatggatacggtaactaaaataggacaagtgaaaaaagaagaaaaccaagcagtttatgatgcaaaaagagagcagcaagtattggataaagttgttagtctgctgaaaaataagggatataaggaaacaataacagacacgtatgttgatttgatgaaacactcgcgcgaataccaaaacaaaatgaaggaggaataagtgtgatcgaaggagagacacggcgaaaacaaatcatgcaaaccttggcaaatacagaaaaaccagtgagtgctagcaagtttgcgaaaacttttggagtcagccgtcagatcattgtaggcgatattgctttactacgagctgcaggtaaaagtatcgtggcaacagcaagaggttatatcctcgaaacagaagaaaccaatactgggcacatcagtaaaatcgctgtccagcatggaaaagatcaaacagaagaagaactgagactaatcgttgaaaatggtggtgaaatcattgatgtaattgtggaacatcccctttacggtgagttagcaggaactttgcacatcaaaacgccacaagatatcgattcctttatgagacgttatcaaaaaagtaatgctactttgttatccgaattaacaggcggcatccatctgcatacgatccgctacccagaaaagcatatgctgaaaaacatcaaacaaaaactagctgaagcaggaatcctctacgaaggataacatcgtagctgctactttttatcctagaaactattctatcatctctgagataaacacccatatggaagaaataagaaaaaataagaaaagatgcgtatccaatacacagaattttttggaattgcgatttctagatgtctatctaaatttcgattagtggagaaacataaaaaagggaagtgcagcttttgagcactccccttttttataaagctttcttgtagcatagtatcgaaggaacctgccaattctctactcgatcaccaatacgccttcttttagtgcaaatggattttgatcgttgatgtggtcatagaacatcacaccgttgatatggtcgatttcatgttgaacgacgatcgattcataattcttcaaacgaatcttgtgtttttcaccattcatatcataataagacacagtgattttggcatggcgaacaacatatcctggtacttctcgatcaacagataaacagccttcaccttcccctaaacaagcatcttgaacagaatggctcaaaattttaggattatacataacagtacttagagaaggtccatctgcctctgggtcaggacttggtacgtgaacagcaatgattcttttagaaatatctaattgaggagcagctaagccaacaccgcctcgtaagtgtagttcttcagctttgattggatcttggctgttttttaagaactcaagcatctcttttcctaaagagatatcttcttcgcttaatggaagagaaacttcttttgcaacttcgcgtaaggtcggatttccttcacgaatgatatcatccattgtaatcatggaatatgtacccctttcttaaaagactgtgtttcaagtctattttcgcattatagtttaccacaaaaatggaaaagtagtagtaagattgtttgaaaactaccttttcttaatgattaactacttgattttcaacccggtttcaggtaaagtatagctgtgtgctctaggcacatgacctgccacttggttaagcgaatcaccaacgttttactcagtcgcaggggaataatcgaaagaggtgaaagaaatggcaatttcaaaagaacgcaagaatgaaatcatcaacgaatacgctcgccatgaaggggatactggttctccagaagtacaaatcgctgtattaactgaagaaatcaaccacttgaatgaacatgcacgcgtgcacaaaaaagaccatcattcataccgcggcctaatgaaaaaagttggtcaccgccgtaacttgttagcttacttacgtaaaactgacgttcaacgttaccgcgaattgatcaaacgtttaggcttgcgtcgttaattttagtcaaaaagagtgggattcacatgaatctcactttttttactcgtatatcaattaagtaaaattccgtgatcaagctagatggactcctactaaccaaatgaaagctgctcaaaagacggctttcggcagttttcatttgtttagtagcgtcttgctttcacgagaaggaaaaggagaagttatgtcagaaaaacaagtattcaaaacgacatggggcggccgtcccttacaaatcgaagtcggtcagctagcaaaacaagcaaacggagccgttttagtccgttatggagatacagtagtcttaagtgcagctgtggcctctaaagaagcaaaagatacagactttttcccattaacgatcaattatgaagaaaaaatgtatgcagcagggaaaatccctggaggtttcatcaaacgagaaggccgtccaagtacggaagcaacattgactgcccgtttgatcgaccgtccaattcgcccgatgtttgcagaaggcttccgtaatgaagtccaagtaacgaacatcgtgatgagtgtagaaacagactgctcgccagctatggcagcaatgctaggttcttctttagcactatcaatctcagatatcccatttgacggcccaatcgcaggcgtagaagttggtcgtgtaaatggcgagtacgtcttgaatccaacagtagaacaagcagaacaaacagatatcgaattgactgttgccggaacgaaacaagccatcaatatggttgaaagcggcgcgaaagaagtttcagaagaagacatgcttggtgcattgctgtttggttttgacgctatcaaagagttagttgctttccaagaagaaatcgttcaagcagtagggaaagaaaaaatggaagtgactttactgcaagttgatgaagtattgaaaaaagaaatctttgatgcttcttacgctacaatgaaagcagcagtaatgactgaagaaaaacttgctcgcgaagataatatcgagcaggtgaagatcgatatccgcgaagcttatgctgagaaatttgcaggtcatgaagatgaagatcacttgttgaaagaagttaaacaaatcacagaagatcttgaaaaagatgtcgtacgtgaattgatcaccatcgataagatccgtcctgacgggcgtaaattggatgaaatccgtccattgtcatcagaggtcagcttattgccacgtgtacatggatcaggtttgttcacacgaggacaaacacaagctttatcagcttgtacactcgcacctctaggagagcaccaaatcattgatggtttaggggtggaagtcagcaaacgattcatccaccactacaatttccctcaattttctgttggttctacaggacgtgcaggctctccagggcgtcgggaaatcggacatggcgcattaggtgaacgtgcgttagcacaagtaatcccttcagaagaagaatttccttatacgatccgtttagtagcagaagtattggaatcaaatggttcttcttcccaagcaagtatctgtgctggcacattagcattgatggatgcaggtgtaccaatcaaagcgccagtcgccggtattgcgatgggacttgtttctgatggtgaaaactatacgatcctaactgatatccaagggctggaagatcatcttggcgatatggactttaaagttgccggtacaaaagatggtatcactgctttacagatggatatcaagattcaaggaatcacagaacaaatcctaactgaagcattaactcaagcaaaacaagcacgtatggaaatcttagaagaattgacttcaacgattgctgctccacgtgaagaattaagccaatatgcaccaaaaatcgaaatgatccagatcgaacctgctaaaatcaaagatgttatcggtaaaggcggcgatacgatcaacggaatcatcgatgaaactggtgtgaaaatcgatatcgatcaagatggaaaagtaagtattgcttcagctgatgcagaaatgatcaaaaaagctatcaagatcatcgaagatttgaccaaagaagtcaaagttggtgaagtttatctagggaaagttgtccgtatcgaaaaattcggtgcattcgtcaacttgatcaaaggaaaagatggacttgtccatatttcccaattagcaaacgatcgtgtcaataaagtcgaagatgttgttaaactaggtgatgagatccttgtgaaagtaactgaaatcgataaacaaggacgcgtaaatctgtcaagaaaagcaatgttgaacgaagatggttcaacgaaaaatgaagaaaaataatttaattcataggaataatgtacttgtgatcgtgaaggtgacagggggacaataattattcgaaaaaaggggactgtgacaaaagccgtgtcacagtccttttttttcgaataaacggtgttcaaaagcttgcatctgcggtaataagtccagccaagttaaaaacattaggagctgtttttacttggctgttcttattacttgatgcagaacagcttttttacaacctctccaataaacgatgttcaatcagctgtccctcgatattagctcaaaaaacggcaaaatatgaggaactatttttccgtttgtttctctaatactcaggtcaaaccgctgatttcacaacctctgattcacggtgttccagaagcagcttctacggaaataagctgaacacttttgttacaacttctttttttctggagtttcttggcgcatatttttggagtccttctgaataaagcgtaaaataaaagtgagaaatatggataaaggagggaaaggagatgctgaattttttatggtcgttatttatcggcggtatattaggtttgatagctggcgcaattttaggaaaggaagtcccgggaggcgtatctggaaatatcattatcggttttttaggtagttggctcggcgaatttttactaggaccactgggaccggaactcggcggtttttatttgataccagcattattgggtgcaattttttgccttgctctttattcatttgtggcaagacgtatcagagaacgtccaaagaaagaataattttattcaaataagttgacacttcagtgtgttacttggataattagaagcaatttaggaaagcgggtgtcatggataagaatatcatctatcattcaagcttacctaaaggatatccatataacaagaaatgagggaaaaacgtggcaacaacgcacaataccaaaaagatatcaatggctggcctgcttgtagcgatgggagtcgtctacggagacatcgggacaagtccgctttacgttatgaaatcgattgttgaagataatggcggattgtcaggaatcaatcctgattttgttatcggatcagtctcattgattttttggacattgactctactgacaacaatcaaatatgtcgtgattgcattgaatgcagataaccatggtgaaggtggaattttctcactctacacacttgtccgaaaaggtgggaaatatttgatcattcctgcaatgatcggaggagctgccttactagcagatggggtattgacccctgctgtgacggtaacgactgcgattgaaggcttgcgaggaattccgcagttttttgaccggttcggtaataaccagaacgtgatcgtcattatcactttagttattatttttgttttattcatggtccaacgctttggtacagatattgtcggaaaagcattcggaccaatcatgttcgcttggtttacttttttaggcgtaatgggattaatgaacttcagtcaagactggacagttatccgtgcactgaatccttattatgctatccagctgctttttagtgcagataacaaattaggcttgttcattcttggaaatattttcctggctacgacaggtgcagaggcgctttattccgatcttggacatgtcggcaaacgaaatattcgtctgagctggccttacgtcaaaatttgtttggttatcaattattttgggcaggctgcgtggttgttgaatgtttatcaaaaccctgaagcacagcaaatcaagaacctgaatccattcttccaaatgatgcctcaaagttggatcgtgatcggcgttgcttttgcaacagtcgctgcagtcattgcttcgcaagcattgattacaggttcgtttacgctagtttcagaagcaatcaagttgaaactgctgcctcggttaaagatcatgtatcctgggaacagtatcgggcaaatgtatatcccagcagtcaatctgattttatggatcgcctgttctctagtggttgtcacattccgaacgtctcatcatatggaagctgcttacggtctatcgatcactgtgacgatgttgatgacaacagcactgctttacttttatcttatccaaaatgggcattctcgttggcttgcatatttagttacctttttcttcggtgcgatagaagtcgttttctttatctcaagtgttgtcaaattcttccgaggcggttttgtagccgttctgattggtttgatcatcttagtcgtgatgtttatttgggaacaagggaacattattcgcgaatcgtcaaccgaggatgtgtctttgagagattatatcccgcagcttagagaattacgtgatgatacttctttaccaatctatcagacaaatgtggtcttcttggttcctgatatggctgaagataaagttggccgacagttcatctattcgattttagataaacggcctaaaagagcacgagtctattggtttgttcatgtggaagtgacggatgagccatatacgaaagaatatcaagtagatatgatggacactgattttattgtccaagtgaatctgttcttaggtttcagggtccaacaggaaatcaacgtatatgttcgccaagtcatccatgatttgatgaaacaaggccgtttgccaaaacagccacaaagatactctctgacaccagggcgagaagttggcgatttccaatttgtcctgattgatgaagtagtttccaatgtgacaactctaggaaaatggcaacgtcaaatcatgcaggcaaaactggcaatcaaaaaaatcgctacctcgccagaaacatggtttgggctagagtacagcgaagtaaaacatgaaactgttccgcttatcattggaaatactcggaaaacatggttgaaagagcggttgtgaaagtagcgctttgacctgaactaatgtcgaatgtcagctacttgaacaccgtttatcagaggtcatgaaaaagctgtttagcaacaagtaacgcaatgattttgaagtgataaggagatgtggctgaaaaatgccgcatctccttttttattcctaaatatgaatacgcattattttcaatctttttgtagaaaaagggtacaatagaaaaagagaaaggcgggagaatatggttatcaatttcattattttatttttgatgattgcaattacttcattttttgtagcaagtgaatttgctttagtgaaaatcagacgatcaagattggaacaactagaaaaggaaaatgtaaagaacgccaagctagctcttcatgttacacaccatttagataactatttatcagctagtcaattaggaattacgctaaccggtttgatcatcgggtgggtcggtgaaggatctgtcgcggctttactagaaccagtgatcggtaaactaccttttagttcggctattagcagtacaatctctgtggcgctgggatttattttagttacgtatatcgatgtggttattggcgaactgcttcctaagagctatagtatcgtcaatacggagaaggtcgtcttgttcgtagttaaaccacttcattatttttataaagtaatgtttccttttatttgggtattgaatcattcagctgcagggctagggaagctattaggtgtgcgtctcgtatctgaaggagaagagacattgtctcaagaagagctgacattagtcgcattgaattcttatgaaaaaggagagttgaccaaagaagaatatcattatttggaaaacgtgtttgaatttgatgataccttggcaaaagatatacaagtagaccgtacgtccatgcaagtattcgaagcttcagaaaccgtcaaagaagcgataaaagcttcgattgaacaaggacatactcgctatccggttatcttagaatcaaaagacaatgttttaggttatgtcaccttgccagatttgatcaagcaatcttataaagatgaccagctgacagtagaacagttgattgaagagccgatcgtaacaactgaaacgatccctataaaaaaattattgacgatcatgcgaaaaaagggaaagcatattgctatcttaaaagatgaatacggagggacaagcggcttagtgacgattgaagatattttagaagaaatcgtcggggaaatccgagatgagacagatttggacgaagcattgatagcggaacagtcagatggctcttatatcatctccggcaaactaacattagatgatttccagcgttattttcatgtagagattccagagtttgaagaaacgaattttactacacttgcgggctttgcttctagccgatataaagaaataaaagcaggaacaatcattgagattgcatcattccgtttcacggtattagaataccagcatgcacatatcgattatttcaaagtagagtccacggaaagaaaaatagaataaaagaaaaaaggctgtgacattttttgtcacagcctttttgttatctaaaaaacctgttttcggtaaacgaagaagatattttcaataaaagttttcatttttagccgcaacgatttcttttaatcaaggctatcttgcttctgcatgttctaatgtgaaatgttcctcttcacccatgtgtttcaattgtttcatcgaacgcatataagagtaaagcaacacggcaacagaaccgatccaagctaaaggagaagctgctgctgctcctgggtatccccacattcctgtaagaacgatagctgcaaaagaacgcataagcaattccatcataccggcgatcgtagggatcttgctttgtccaagcccttgaagtgtgtagcgtaaaatgaacaggactgctaagatccagtaaagagacccattgatattgaagtaggtttgtgctaattcaaatacacgtgtttctgatgggctaacaaacaattgaacaaagaaatgaccgaagaaaatgacgatagcacctgctaagagactaaatccgacactcatcagtaaagtttgacgtaccccttgcaagattcggccatattctttcgcaccatagttttgtgcagtgaaagttgccattgcaataccaaatgacatcatcggctgatttgcaaattggtcgatacgaccagcagcggcttgagcagctacgacatctgtccctagactatttagtgctgcttgtaacacgatagcaccaacagcgatgatcgaagattgaaacgccattggcaaagcagcatttaggtgtacagcaaactcttctttttcaaatttgaaatcttttttgcgtaactgtaacaaaggcatttttttcttgatatacactagacacagtacgctggaagaaacttgtgcgattactgtagcaatagctgcaccttccacacccatgccaaaatagataataaagatcaaatcaagtacgacgttgatgatgaccgcaatgatcagaaagaatagtggtgtgcggctgtcaccaagtgcgcgaatgacattagaaagcaaattgaaactgactgatgcaaagatccctaataaaataattgaaataaatgtttgtgcttgatcaagtatttcaggaggagtttgcatcaattgaagcatcggacgaataaacaggagacttaggacagttaaaatcacagtgacgacaagactaatgacaacactagcagcaaaacttttcttcagaccccgataatcttttgcaccgtaacgttgtgcggtaataatggctaaaccagctgttaaaccttgggcaaagccaatgatcaaaaatgtcaggcttccagttgcaccaaccgctgccagcgcatttttacctagcgtctgacccacgatgatcatatcgatcatattgtagaactgctgaaaaacatttccgatcagtaaaggaacagtgaacatcaaaatcagtttagcggggcttccttttgttaaatcgcgcatcttttaaactccttatatctttaaaatttagttagtagtatatagcgtttatcctgagaataccaattagaaatcaatgataatttatgaaactccataaaaagaagccaagaattgagtcaaagaatcaacaacttggcctggtctgtaaaataagggacatccacgtttatctatcaccttaatattgtctaatctcacttggtaaaaggatcgtttctctcgtaccgtcatcataggcgtatacttgagcaggaaattggttcgaataggcaaacggcaaatcaatatccatttccacattgcttcctgcttgagaaaaatgcatcgtcacttttccacgattttcgatcaaatcaaaggttaatatattttctaatggaatgactcccttaagatctaggtcaataataaaccatatactgtcaatcaattcatctggcaaacttgatacgacaccaactgaagcgtaacggttgcggctgctatcaaaactttcaaacatctgtttaacctccttcgaatcaacgaatgttttatttttataattaatcctaggataaactagaaatacttacttcaacgagggttcattctaataaagaatcaggaaaaatgcaacaataattgaatactttttttcaaagtataaatttttataaaggtacgataaaagtatgcgaggaaaagcttggtaaattaggatttttcgtttgtaaagccatttacaaaagtggaagccccatatgaaaataaacgattagaaataaaaaaggcgtgttaaaagctgctgacccgccgcttctaacaccacctgattgtttcagtattattcttctgttgaaccgatcacttctggttcgccaccttcacctgtgctttcttcttcactttgagcgactacagcagcgatttgctcttcactgtcggtcacgaatttgtaatcgtcgttttttggaagatcggctactgtaatagaatcacctaattccaagtttgtcacgtcaacttcaattcgttcaggcaatttgtctggtgtagcagatacgactactgtatacaagttttgagctaacactccaccagatttagcacccactgattcgccaacaagaacgacttctgtttcgacttctgtttcttccgacatgtttacagatagaaattctgcatgttcgaaatgattggtaaaagtgttcgtttggatcttgtgaaccaatgtattgactttttgtccatcgatgtccatcgtgatgactgtgttcgctccatgttcacgcaacaatttgcttagtgtcaaaccatcgaatgagataggggtactttctactttatacccataaacaacagctggaactttcccttcgtgacgaagtttgtttcttaatgaacggggacgtacttctcttttacttacttctaatgatactgacataaccaaaattcctccttaaaatgtgactgtctgctttggtaacggacagattttatttaagtgaattctaaaggctaatctcgtgcacatcatcgaaggcagggcgcttaaaaaagcgcaaaaggagagatgcgcgcatctccccttagaaagtcaggattcaacttttctccaccaggtcattacgctgtgtatgagaaatccaattcactttactatttaaccgtaacgtgaactgttaattaagtcaaggaataactatgatgatgtatttgcaagcaagaatattcaaggtataattaattagtagtaataagaaaggaaacagcatgcgtttagataaattaatagaagaaaaattagaaacgacacgcaaggaaatgaagcggctgtttgctttgaagcaagtgatgatagatggcacagtcgaatttcgacaaaatcgaaatgtagatagtttactgcatcaaatcgaagtagcaggtgaacacttagaaacaaatgagtcctattatcttctcaataaacctgaaaaagctgttacagctgtatcagatccagaaaagacgacagtaatcgatctgattgcaagtgccgatcgtttccaaccattatatccagtgggaagactagatagagatacaacaggactattgctgatcacttcgaatggacaattgggatatgaaatgctacttccagaaaaaaaggtttcaaagacttatcaagtagttgtgaacgaaagggtgacaccggcagacgtaacagcatttgaaaatggaatcgtattcgctgatgggtatcaatgtaagccggctgatttaaaaatactcaaagcagacaagcaccaaagtacggttttattgacgatccaagaaggaaaattccatcaagtcaaaaagatgttcttagcccaaggaaagaaagtgaccgcattgaaacggctaagcatgggaccattggaattagatgaacagctaggagtaggcgagtatcgatcgttgacattagcagagatgaaaaagttaagtatttattttaaataggaggtcaaaaagatgaaatataaaactttattgttcgatgtagatgatacattgttagattttcaattaactgaagccaatgctttaagtgctttgtttgcagaacaaggaatcacattgacaccagaaatcgaaaccagctataaggctttgaatcatcatttatggcaggagtttgaaaaaggcagactatcacgagaagaaataataggcagtcgttttgggttacttttccagcaatttgggaaaacagtagatagtgatcaaatggaaaaacgctaccgccactacttgaaccaaggtcatgatcttgttccaggaagtctagaaatcctgaaaaaggtccatccgcatgctgatctttatattgtgacgaacggtgtgtcgcacacgcaacatcggcgattaacagatgcaggaatgcttgattacttcaaggatatctttgtctcagaagctgtcggagcgcaaaagccgatgaaagaattttttgatcatgtcttttcccacattcctaattttgataaaaagcaaactgtgatcattggtgattctttgacttctgatatcaaaggaggaaatatggcagggatcgatacgatttggttcaatagaaataaattaccagaaatcgaagaaatccagcctacttatcgaatcgattcattagaggaactttattcattattggaaattgaaaaggattaattttcagaaaaatatagcattttcgtgttttttcgctataatagattagaatgaaaaaacggatacgaaagaggttttagtcaatgacaaaaagcaagccaattatcattggtgtgacgggtggatccggaagcggaaagacaagtgtcagccgtgcgattttcaacaacttcccggaccattccatcatgatgcttgaacaagattcttattacaaggatcagagccatttgagttttgaagaacgattgaacacaaattacgatcacccatttgcctttgataatgatctgctgattcagcatgtaggcgacttactgaactataaagccattgaaaaacccgtgtatgactatgtagcgcatacaagaagtcaggcaacgatcattcaggaaccaaaagaagtgatcattctagaaggaatcctgattttagaagacgaacgtctgcgtgacttgatggatatcaaagtatacgtagatacagatgatgacattcgtatcattcgtcgtatcaaacgggatatggaagaacggggacgcacattggactccgtgatcgaacaatatttgacagttgttaaaccgatgtatcatcaatttatcgaaccaacgaagcgctatgcggatatcattgttccagaaggcggagaaaaccacgttgctattgatttgattacaacaaaagtagctagtttcttaaaccataaatagtgcgcagcgaaacagttgaacggactgcgaccgtttgaaaagcaaggattctgctttttgaacagtcaccagccaactgtttttttatttataacaagaggttgtgaaaacagcatcttgacctaagtattaaaaagaagaaacggaaaatagctgtttatattttaccgttttttgagctaataccgaaggtcagctgattgagcaccgtgaagtagaggttgtaaaaaagctgtctttgcatcaagcgataagagcatccaaataaaacagctcctcacgtttttcgttgggttgggcttattatcgtagatgcaagcttttgaacaccgtttaacgagaggttgtaacagaagtggtcagatgcaataaataagaagaaacttacgaaaattatttctcgaatttgtgtgagatttcgacttatttttttgaagaagctcttttgtcgcaccccctaatgaactgaaccccaaaagttgaactatttaatggactgtttccgatattctactggagatagtccatttaactttagttttatccttttgttattataccacctaatatactcatttaatttactttgaaatatctcaattgatcggaatttttctcgataaaaaaactctgatttaagcacaccaaaaaaattttctattacagaattatctaagcaatttccttttctagacatgctttgaataatgttattctcttttaattttttttgatattgtggcatctgatactgccatccttgatctgaatgtagaatcagtgaaccctcagttcccttttttttaattgcttgttgaagcatttcttcaatcagtttatatgttggactagttgatatactataactaattatttctccgttatataaatcaagtatatggagatagatagatttttcttccttttatcttgaattcagtgacgtctgtcacccattttttattgggtgtatctactgaaaaatttcgttttaacacattcttggcaatttttcctactgttcctttataagatttatatcgctttattcggatttgacaggtaagtcccatttgggacattaattttctaactgttttatgattgattgtatatcctttcatctttaacgctaaagtgactctacgataaccataagagtttcttgattcttttacaatcgctgtaatttcttgctttatcttgctatatttatctggcttatctaatttttttacccagtaataataagttgacttcgctaattgtgcaattgaaagtaatagattcaatttaaattcttttttgagctgaaggattgttttaaccttgatttcttcttgctcaaatcttgttcttgaatcaaggtttctaacttttttaaatatgcgttctctgctcttaaacgaataacttcttcttcaagagactcatctttaagttttttaggaatgtttagcttggaattcatactaatttttctgccccttttttggctctcaagtgaagaagcaccgccttcttcatattgctctatccatttacttagagttctatttgaaccgatattaaattttttagcagtttcttggatagaaagaccatttgtttccatatattctataacatcaagtttaaattttgtagtgtagcttttgccacctccaaccaagccttcccaaccatgatagttataaatccttacccaatgtctaaccagtgtacgatttatttgatatttatgtgcaagatatttgtagccgccttcgttatttaaatagtctgaaactacttttttcttaaaaacaaatgtatatttccgcaaaaaaagcaccccttttaattagatttctagtctaacttttggggtgcacatcataaggaggcagttttaataaatgaaaaaagatgtggggaatatagatgtctaaaaaaggatcagttttacaaaaatgtcttcagatcatgcccattattggtctgtttttttctttgtgttgattctttatgcttatcatcatgggatttttcgatcgagcacgtctttgcaagcgtttatccagcaatttggcaagtatgcagtgatgatatttgttctgttgcaagtgatccaagtgatcattcctattttgccgggagggatctcctcagtagcgggcatgctgatgtttggcaatggatttgggcttttatatagttgtattggcctagtgattggggaagcaatcggatttttgcttgtccgttactatggcgtagcctttgtccagcttattttatcgccaaaaaagtatcagaaatttgatgaattgctgacaagaaaaacgaaagatattaaaaaagtactagttgttaccttgctgcttccctttgcgccagacgacttgatctgtctagtagctggtttgacgaaattatcttttagggaatttatgcagattgtgattttcttgaaaccatggtcggtgggtgtgtatagcatgatcatgctctttttattccatcaagcgcaaggtcatttataatgtaaaaaaggacgtgggtgtatggaaaaaataaaagtaacagaaaatgaactggatgagctgatggcagtcatacaagaagtatggccggaagcttttgtgccgatcattggtcaaaaacaagtggattacatgctgaaaacttatcagtcaaaaaaacagattcaaaaagaactgacagaaggtgtgtcctactttttattaaaaagcgaagaaaagactgtcggttacactgcttatgaagagataaatggaaaaatttatttaagtaaattatatttgctaaataaagtacgtggtcaaggattgacttcttcagtttttcgctggtatgaagaacttgctgcgcaaacaaaggaaagagagatctttttgcgagtgaatcaggggaatcatcaagcaatcgaggtttataagcatgaaggatttgagattacagaagaacttatttcagatatcggtcaaggatttcaaatggtcgattataaaatgaaaaaagctctcgcataaacataggaactgtgttaaagtaaatttatgcgacgggtcgagaaggactctggtttacagagctcctaattgattttggaggcacaggataattgatttctatctttatcacctgccggatgcaggggtgtcgggcaagacttttgtggagaagggcttgtctgcttgagtaatcaagtaccgtaaaaatgcagaaagaagcttatgcttctttctgtatttttttttacaagaatatattctgtaaaattggtttatttcccctttaatgctaaaatcgaagagcagattagttataagactgtttaaggagccattgtcatgttcgaaaaactcaaacgatttgggcgtaattttacacaaacaacgccctttatcttaagtaacacggttatttttattccttatcttttatttttgggactaacagactcgcataattggctgacgattttgccatttacgctgttttatgcctttcggatgactggactatttttagtcaacagtctacgatttggtctagatagttacacgttgctgatgatcgctctgctgattggtggtgctggttcattgcttggaatattaggcgtattttattttcctttattttatttttcaagtgttttgctagggctgagtgcagcatggcttgtacctgctaataccacggtcaattttcacgaaaagacgcaaggttttatcaatatggatgggaaaaagtacttatttgcagctatctggctatttctcctgtatcaagcgattgagttgcctgcaccgactcagattgcagcaagctttactatttatacacttttttacgtcatggcctaccatacggttagtcattatccgcgttacgaactggatttcaaagacatcaaaagaaatctggtagctacgcgagagcttgttttatttttgatattctttggcttattgtttcttttgagaaatgcccgattgttattcgatgaaaggctttttgatcttgctatttatggtttcttgctgctgttcatcttgttcgtgtttgttttaggacaccagaagaaggaatggaagttgccaagctggctaaatctgtttacttttctaaatggaatgctagggaatttcctttttttatttagcagtttttatgttggcatactgtacggattagaaaaactttcgatttttatgtatttgccttatgcagcaggcttgattgcagcaaaaatagtcggaccatggattttgaaacgtttaacatggtctccattggctatgcaattgcttggactgagttcttctttattggtcctcttgattccaaatggttttgcgataggtgtctttctgcttagtttctggcacgtagtaacaggcagctggctaaataaggaatattatcaaactgatacagctattccaatggatcgccggatcgttgtcaagtatactactcaaaataaagggagtgtgatccaccagtttttattgatgacgcttttgtttgttttagcaaaagaaatgggagagccaatccatctattattgatcacgctgaaccatgaatcagtgccgatagaaagtgtacaactgcttatcttggcaaaatggatcaatgttggtcttttactgagcggattagtaactgtttatcatttatggaagaaggcgaaaaagaatgaggctattcattgatggagatggttctccagtaaaagaagatgtcataaaattaggagaatcctatggtcttgacgtggttatcgtgaccagtgtggaccattatacgaccaaagaatacgctaatcatgtccaaatcgtctacgtagaccgcggagctgatagtgcggattataaaatcgtcggtatggttaagaagaatgactttttgatcacgcaagattatggtttagcttcacttgtattgccgaagggtgtgcgagtgttccatcactctggaaaagaatttgacgaagcgaatatcggcacgcttctagaacaacgttatcatagtggaaagttaagaaaagctggcataaggacaaagggtccaaaaccctttacggagaaagatcatatgtcttttcgtcaagcgttaaaaaaggcaattgactaaggtttaccaagtacagaagatagtaggtaacgaaggtattttatttatgctcgaatacatcaaaaagggaacagggaaacaggataaatgtgttccatgttccctttttgattgttcttattactgggtgcagaacagctttttcacattttttattctcggtgtttcagaagtagcctcttcgaaaaataagccgaattttcacaaaaatttgagaaacaatttatgtaaaaccccttcttatttcttgaagctgattctttctgtcacaacctttttctactttttcctcttcttatacatttggatcaatgcatcgattgccaaaaaaataatgacgaatgcggcaatagcatacgtaaatatccctaataaggaaacgacctctgcgttttctacaggtgctgcttggacaagcagggaggaccctacgatcaatgcagctaaaatcataccgaaaacaagccgattgatcatactttcgatcctgctcaataatttgtcttgctttttcaattccaaattgacttttccttgtcccgaagtccacatttctaatagatggtggagctgttgagggatcttaggcgcagccttcatcccttccaataagtctaatccgctttgtttcaatgtatcttctacatccagatgagtgagaaaataatgttgagcaaaaggcgaagcgacttccatgagggaaacttcaggatcgaggacgcggatcaccccttctaatgtcccaaatgctttcagcaaaagcgtgatatcacgatcgaactgcagattattttgatgacaaatcgtcacgacatgtgtgaatacttcttgcaagttgatttcatcaataggagaatcataatactgttcaagaaaacttgtcagttcttggtggaaccgactttcatcaaacgagccttcttgctgacaaagtcgaaggaccgctttttcgattcgataagcatctttcgtatacagcgctaaaacggcttgtgtgagtttttgcctaagtcctgcagaaagatgccccatcataccaaaatcgatgtagttgatggtatatggcgcaacagggtcttctgcagaagtggaggctcgaaaagcaaaggaaccgaactctttttcatggactgtttcagtttttcggctagcttgtgtctgttcttcttttgttagtacatggaatagcagattccctggatgaggatcagcatggaaaaaaccatcatcaaacacctgtttcataaagttctcaactaaaagctttgcaacttcttgtttcagctgcttgttttgaattccagtgataaaagtttcagttttgttttcggcgttcattaaatgattcaagtttttaccagacatttcttccatcacgatcacttttttcgaacaaaaagcgtcataaatcttggggctgcggatctctttccagccattgttcttttgatagaattgttcgccattttgactttcttttaagaagtccatttcattgatcaaggaacgttttacttcttggagtaccccttttagatcaactacgctagtttcaggaatgtatttgatcaaagggatcgctcgttcaaatagttgaagatcaagtcggatctcttcggcgatgttagggtgttggatcttaacgactaccgcgtcaccgttcttcagcttggcacgatgagcctgccccatagaagcagaggcaaaaggcgattttgaaaaatcatcgaatatatctgataatgaaagagaaagttctgtttcgatcgtctttttgaccgttgaaaatgtgtcgctaggtacactatcttgtaatgttttgaatgtttgagtgaaggcagaagaaagcaaatcttctcgaacagaaagcatctgtcctatcttgatgaaggtggggcctagttcttcaaaggctttttttacctgttcgggatttttttgctgtacaaagtttggcactacattgtaattgatgaacactcgaatgatttctgccaagcggctgcgtggatttgtttgcgccatcatcatccctccttttctttatcataactttttataaaaaacgggacaaataatctagctgacaaaaaataaatgacgctcgttcttttagaagctggctcgtttttttataaataagttattcgtttatttttgttttgtgctaaaatatgagagtaaatcactgaacgatttagaatacaggaggacaatcttttgaagattactttactatatggcggacgcagcgcagagcatgaagtgtccattctttccgcattttcagttttaaatgccatttattataattattaccaagttcaactcgtatttattacaaaagaaggacaatgggtcaaaggtccattactaacagaaaaacctgccagcaaagatgtcttgcatctttcatgggacccaagtggacagacagaggaaggctttacaggaaaagtgatcaatccgggcgaaatcaaagaagaaggagccatcgtttttccagttttacatgggccaaacggggaagatggaacgatccaaggcttcttagagacattgaatatgccttatgtcggcgcaggcgtattgaccagtgcatgtgccatggataaaatcatgaccaagtatattttacaagctgctggtgtgccgcaagttccttatgtaccagtacttaagaatcaatggaaagaaaatcctaaaaaagtatttgatcaatgtgaaggttctttgctttatccgatgtttgtcaaaccggcgaatatgggttctagtgtcggcattacaaaagcagaaaaccgagaagagctgcaaaatgctttagcaacagcctatcagtatgattctcgagcaatcgttgaacaaggaattgaagcgcgcgaaatcgaagttgctgtattaggaaatgaagacgttcggacgactttgcctggtgaagtcgtaaaagacgtagcattctatgattatgaagcaaaatatatcaataataaaatcgaaatgcagattccagccgaagtgccagaagaagtttatcaaaaagcgcaagagtacgcgaagttagcttacacgatgttaggtggaagcggattgagccggtgcgatttctttttgacaaataaaaatgaattattcctgaatgaattaaactctatgccaggatttacggagttcagtatgtacccactcttatgggaaaatatgggcttgaaatacggtgatttgattgaagaactgatccagttaggaatgaatcgataccatcagcgtcaatctttttttgaaaaaaatgaataaagagaaataaagaagaggctggagtgattgcgtaaccgcgttcattctagcttctaaatacgaatagagaaatttacttggaagtgagagtcatgcgaacccgccgtttaggccaaacgcttttttcacaaccttttttaggagagatctcaatgaatctaacaatacaagaaattgcacaagccgtgggcagcgaatgctctgcactgacaaagattaccaatgtcgaatttgacagccggaagataaccgaaggaagtttattcgttcctcttgctggtacgcgagatggacatgaatttatccagcaagcgatcacaaacggagcatctgcttcattttggagcttgcctgttgaacaagctccaaaaaattttccagttattcctgtagcagatcctttgaaagccatgcagcaattggcaacctattacttggaaaaagtaggcgcagaagtcgttgcaattacaggaagcaatggtaaaaccaccacgaaagatctaaccgcgtctgtcttgtctgaaaaatacaaaacatataagacgcaaggaaattacaacaataatattggtcttccttacacgattttgcacatgccccaagatacagaaaagatcgttttggaaatgggcatggatcacgccaatgaaatcacggaactttcacttatggctcaaccaaaagctgcagcaatcacaatgatcggtgaagcacacatagaaaatcttgggtcgcgagaaggaatcgctaaagccaaaatggaaatcactgacggacttgtatcagacggattactcgttgtgcccgcagatgaaccgttgctgacacctttaacggcaacattagtacaaacagtcacaacattcggtattggaaatggcgatgttcatgcggaagtgacagcaaaaggaaaagcacaaaccgattttgtagtagaaggagaaacatttacgatcccgctgcctggaagttataatgtaacgaatgctttgattgcgtatacgatcgggcgcttctttggactgtccatacctgagatacgccaagggctcgcccatgtttctatcactcaaaacagaaccgaatggctaacggcaggaaatggtgcagctattttgagcgatgtctacaatgcaaatccaacagccatgggactggtattagatacttttaaaaatctgccaacaaaaggacgcagaatcgctgtgttagcagatatgctggaattagggaaagagtctttaaatatgcatgcgcaaatgagtgaacatatcgatcctgagaaattcgccatgattttcctttatggggaacaaatgcatgcactaaaagaagaattgaaccaaaaatacccccaactacctgtgttctatttggaaaaagaaaagaataaattgattgatgctatcaaacaaaatcttgaagcaacagatagtattatgctaaaaggcagcaacagcatgggcttatttgaagtggtagaacaacttcagcaaatgaaataaaaatctgtaaacttgcagaaaacgaaaaactatgttagaataacctattgccgaaagatgaagagaaattggactggttttgccatagaaacaacttgttgaagccagatgtcataataatgataaagctgaacgcgacccgtttggcttttctaatgcctaaacttcgcaaagtgatttttcggtggtgccacaggggctaagaatggataaaaacgtgcgtggccactgtcaaaaagaaacaatacactttgaccgaacaaatcgacggggtagcaaaaaagctacatcctcagttaacaaccatataggaggattcatttgaaatttaaagaactagaattatcaccagaattgttgaaatcagtcgaacgcgctggttttgaagaagcaacgcctatccaagcagaaacgattccactagcattagctggaaaagacgttattggacaagcacagacaggtacagggaaaacagctgcatttggattaccaatgttagaaaaaatcgatccagatcgtcacgaattacaaggtttagttatcgcaccaacacgtgaattagctatccaaacacaagaagaattatatcgtttagggcgcgacaaaaaagtacgtgtacaagccgtttacggcggagcagatattggccgtcagatccgtggcttgaaagatcgtccacatatcgttgtgggtacaccaggacgtatgcttgaccacattaaccgccacacattgaaacttggaaccgttcaaacattagttttggatgaagcagatgaaatgttgaatatgggcttcttggaagatatcgaaaaaatcatttcacaagttcctgatcaaagacaaacattacttttctcagcaacgatgccgccagctatcaagaatattggcgttaaattcatgaaaaatccacatcatgtgaagatcaaagcgaaagaaatgacagctgacttgatcgatcaatactatgtccgcgcaaaagaatacgaaaaattcgatatcatgactcgcttgtttgatgttcaaacacctgaattaacaatcgtcttcggacgtacaaaacgccgtgtagacgaattggcacgcggattagaagcacgcggttaccgtgcagaaggaatccatggcgatttgtctcaacaaaaacgaatgagcgtattgcgttcatttaagagcggtcatttagatatccttgtagcgacagacgttgctgcacgtggattagatatttcaggtgtcactcatgtgtacaactatgatatccctcaagatccagaaagctacgttcaccgtatcggacgtacaggccgtgccggaaaaggcggtatgtctgtgactttcgttacaccaaatgaaatggactacttgcatgtgattgaaaacttgacgaaaaaacggatgacgactttacgtccaccaaccgaaaaagaagcattcaaaggtcaattaggtgctgcagttgaacaaatcgaaacaaaacttgcagaaaatggtctagataaatacctgcaaacagcagataaattattagaagaatattctgcacaagatttagttgcacttttgctaaaaacgacagcaaaagatccagctgatgcagtgccagtgaagatcacaccagaacgcccattgccaatgcagaaaaaaggatacaataaaaatggcaaacgtggtggcggaaacaaccgtaatcgtcgtgacggcggtaattatcgtggaaacaaatcaaaaggcggttatagcaaaaataataacagccaaaaagatggcggtaaacgtcacaatgataaaaaacgcggatttgtaatccgttcaaataacgattaaacataaaatgaaagtttctcttttttaagagaaactttcatttttgttatttgtggacttatttgtggcaaaatggttataatttggtagaatgagagtgttctaaatttattgaaaagagaaaagcatatgataaaaggaattgggatcgatgcagtcgaacttcctaggatcactcggctgatcgaagaaaaaccaaaattcattgcacgaatcttgacctctgatgaaatgaaactattccagtccttgccttttcatcgccaagtagaatttttaggcgggcgttacgcttgcaaagaggctttctctaaagcttggggaactgggatcggaaaagtacctttcaagatgtcgagattttaaaaaatgaaaatggtcagcctgttgtgacgcgttcacctcatgaaggcaatgtatgggtcagtattactcatacaaatgaaacagcttttgcacaaattattttggaagactagaaagaaggaaaaacgatggttgtcgcttggcaccgcccaacgaaagcagtgatacataaaaaagctataactgaaaatgtagcaaatgaagttgcaagacttccgcaaggaaaagaattgtttgcagtagtaaaagcgaacggatacggtcatggagctattgaaacagctgaggcagcagttgcaggtggagcttcgggcttttgtgtttcaaatttagatgaaggagtcgagttgagagaagctggatttactcagcccatccttatcttgaatatggttccttacgacgcactgactgtagctgttgctcatgatttatcagtaactgcaggtacacgggaatggttgcaagcagcagctgctgttttagagaaaagtaagctagagacgcctctttcgattcatctaaaagcagacactgggatgggtcgtatcggattttgtacacctgaagaagtaaaagaggcagctgcattcatcaaagaaagtcgtgtattagaatgggaaggtttatttacccatttttctacagcagatcaggcagatgatacatattggaatctgcaaaaagaacgctttatagaagtgctgaaaaaacttcccgaacttcctcgatatgtacatgtcagcaatagtgcaacggctttatggcatgatgaaacaatcggcaatatgattcgttatggagtagcaatgtacggacttaatccctctgggcacgcactaccggaagtttatccattgcagccagcacttgagctggtttctgaattgattcaagtcaaaaaactcccagcaggtgaaggaatcggctatggagaaacatatatcactcctgaagcagagtggatcggaacgataccgatcggttatgcagatggctggccacgaaagatgcagggtttttctctattggtagaagggaactactgtgaaacgattgggcgtgtatgtatggatcaactgatgatccgattgcctcaagaatttcctgtcggaacaaaagtgacgcttatcggcaaaaatgcagacaaagaaatcactatgcaggatatagcagatcaattaggtacgatccactatgaagtggcttgcggattaggacagcggataccaagagaatatcaagaataaggaggatcctatggtaaaaagaggagatatttattttgctgatctttctccagtcgtgggatcggagcaaggcggaacacgcccagttttggttattcaaaataatctaggtaaccattttagcccgacgatcattgttgcggccataacggcaaaaatggctaaacctaagcttccgactcacattgggatcaaagctactggaacaggaatagaaagagactccgttatcctgttggagcagatcagaacgatcgataaatcaagattgaaagaaaaggtctgccatttggatcgacccattatggcagaagttgaccgagcattgaaaattagtgtgggtatcgaagcactgactcctgttactaaataaatatagcgaagtaaccatgcagcctttacatataaaaaaggaccagctgtgcgtaaaaaaagatacgtctgcttctagtaccagcatttctgctagaagaagcgaacgtatcttttttgatgatccaaggagtggtccatgcgccctcctcctttacattacagccagacttggattaccagctggctttttttactcctggaatcaaacctttatgtgctaattcacggaattttatacgggacatcccgaatttacgcatgtatccgcgagggcgtccatcgattaaatcacgatttttcaatcgttctggacgagcattaaaggaagtttacgcaagccttcgtaatctttttgcgcttttaattcctggcgtaaagcagcatagcgttcaatcgtttcttgctgtttttttgctttggcaatctttgattttttagccatcaacaaattcctccaattattttttattagcgtaaatcgtaatctttacgcttttagataaataatttaacacgttacgcgaaaaaagacaactattttgttttgaatcatgcgccaaaacgaaaagacattttttttgtcaaaataaaggcataaacgtaaacttaaagaaaaagggagatggtgaccatgcgaagatttgcaattaacggttacggagaagcacaagatgtttttgaagaaatcgatgctcatcccagagaagtcggttctggacatgttcgtgtagaaataaaagcattcagtgtgaatccttatgatgttgccttgcgtttaggagaaatgaaagagatacgaacattgaaattcccttatgtaccaggtaatgatggcgctggtattgtgacagagattggttcagatgtcacaactgttcatgtaggtgatcgagtagctgtccatgcagtcggcgggacttacggagaagaagtcgtgttgccatcagcaaaagtagcaaaaattccagataaaatgagttgggaagaagcagccggaatggtcacgccaggaattacggcttataatctaatcaaccatttgacggaaatccagccgacagatactgtaatgatactaggagcatcaggtgcggtcgggtcaagtctgatccagcttctccatgaaaagggaatccgaatcttaaccagtgcatccagtaaaaatgaggaaaaggtaaaaaaattaggagcttcagcatttgctgcttatgataaaacaaatccaggtctgcaatttgctgatcaggcagaccttgtaatcgatgcgacgaaaggaagtatcaaaggagaaaccggcatccagatcatgaaaccaggcggcaggtatgttgcattaaatgacctcccagatctagatttgcggcaaaaaaaggaaggcttttatgaatcgtttgttccaagaaaggaatatctagatgcagaagcctttgctggcataatcaaagcctaccaaaaaggagcctttcatgtttttatttcaatgaatctgtctgcttcacttaagcatgtcatccaagcacatcagctagttgaaggacatcctcctgctgggaaaatcatcctgtcattcgaaaaataagaaatacaggaataaaaaacgaaaaaagctgaaacatttttgtaggggcaaagacaaaaaatgttttagcttttttgcgtatacgtataatagataaaaactttggcataaaattatctttcccttttatttcatgataaagtaaaggctgtaatccttaattatttctcaatatgtaagagattacaatgagacaattgccgtgatatgtccaaaaattcgacttttttgaaaaaagccgattgaaaaaagtatgaaatacatggtaaagtaattcagctgaaaaaagaagaagggggagaactatgcagtcaatcaaaaatacgcttcgattatatttgcttgactggaaacggattttcaaaaacccgattgcaacacttctgatcatcgcgatcatgatcatcccttcgctatatgcgtggtttaacatcaaagcattatgggatccatatggaaatactggagagctgccaattgctgtttacagtgcagacaagccagcagagtttcaaggtaaagaagtggccattggggagcaagtcatcgaatcgcttcataaaaataaacaattaggatggcaattcgttgattcaaaagaacaattagaagacggagtccgttccggaaagtattacgcaggtatttacttgccaaaggatttctcagaagatctgctgagttttactagtggtgatatcaagaaaccaaaaatcgaatatacggtaaatgaaaaaatcaatgcgattgcaccgaaaatcaccgataaaggagcaagttcgatccaatcgcaaatcacaaatgaatttatcaaaacagccagttcgactttattgaaagtattcaatgagataggttacgacatcgatacgaacctagtaagtatcaataaagttaaagatatgattttatcaacagatgaaaatttggacacgatcgacggctacacaaaacaagtcctcgaattacaaagtcaactacctgaaatcaaggaaaaactgaataaagcaaatgaattcgtggattacatccctaaagtagatgagatgggtgaaaaagtcgttgcattgaatgacaaaatgcctgagttgaaagatcaagcaaaaatcatccttgatttgcaagaaaaaatcccagagatccaaaatgccggtaagcaactagcagagatcgacggcgattttgcttcgatccaagagacaatgaaccaaggaatcgatgaagcaaaacaaggcttgacgatcatccaacaagtacaagatatcttgccagatgtgaaaaatttagaaaatcaggcaagtgatctagcaaaccaaacaaaatcaggtgcctctcagctgaaagatgcgataccaagcatcacaaacagtgtagatgttacattgaagtcaattggacaagtggcaacaacgacaggttcgttaatagatactgtaagaacagctattgaagatggtaagctgactgatgatgaaaagaaaaacatcagcaatgtattgaacggctttattgacggaatatctcaacaacaaaatgcaatcgataaactggtcgagttcctgactaaattgcaaacaagtgctggaaatacgaaattacagccaattattgatcagctaaatcaattaaaacccttgctaagcaatctgcaaaaccgcctatctgctttgaacacagctgttcaaaatgaagacacgaaggctattgatgaattgctagatcaaattgatgccgttgttaataatatcaatggcatcattgctggtatcaatacaggtcaaatcagttccactgtcacttctctactagaccaagtcatcgatacgattgggactgcacaaggcgcactgagcaaagcggaccagatcgactttgattcgcttctcagctcaacgaaagcaactgtaacgaatgcagtggcaattttagaaaaatatcaaaaagaaatgcctgcaattggacaagaaatccatgatgccaatacaatgctgaatggaaatatggataccatcgtcaatggcatcaatgaaggggcagacctatacaacaatgaattaccgatcattcagcaaaaattaggattggccgctgattttatccaaaatgattggccagcactaaaaaatgaaatcaccggtacattgacaacagtaaatgaaaaaatgccagaagtcgaaacagctgtgaacgctgctgcggacttgatcaacaatgactggccaaatatcaaagctggtatccaaaaagcagcagacgcgatccgaaaaggcgaacaagaagtcgatctaggcgaagtcatcaaattattgaaactagacgcaacaaaagaaagtgacttctttacacaacctgttgagctacaaaccaatgcgctttatccaatcgcaaataacggttcagctagcaccccgttttatactgcactatgtctgtgggtcggcgctgttcttctttcaagtgttgctacgacagaatactatttaggaaagaaagaccgaaacaattttacgaaacgagaacaattcgttgctcgtatgctgacatttttgacaatggcgattgcgcaaagcttgatcgttacattagggaatattttcttactaggagtagatgtccaaaatccggtctacagcgtgtcatttgctgtcttgatcgccttagcgttcatgatgatcgtctatgtcttggctgcattattcgataatgtcggtaaagggatcgctattatcatcttagtactgtcgatctctggcggaggcgggaactatccgatccaagtctcagggaaattcttccaaatgatcaatccgttcttgccatttactcatgcggtaaacttgttacgggaatctgcaggaggaatttattggccaaatgctacgaaagcaatctggatcatgatcggtttgtttgttgtctttggaatcgtaggaacggcaatctatccgttcatcgaagaaaaaatgacgaaattcaaagaagcggcgcatgagagccatatttttcattaaaaaaagaggttgtgaaatcagtgttttgacctgagtattagagaaaaaaatggaaaaatagttcctcatattttgccgtttttttgagctaataccgagggtcagctgattgaacaccgtgtaccaagaggttgtaaaaaagctgctctgcatcaagtaataagaacgaccaaataaaaacagcttcttatgtttttaatttggttgggcttattaccgcagatgcaagcttttaaacaccgtttatcaagaggttgtgacaactgcgctatgcttcgagtagtaagaatgatgggtagaaagcagccttacatctctcttccaaaagttaagatatcaaaaaggatagaacttgattttctaagtcaagttctatccttttattatagaattcaaagaaaaagcccataaaaaaatgttagatttttgctgtattaaagcgtttgaaaaagcgcttgatatttttctgtttttttccaattattttcttaaagtttattgacttttaaggtcagtgagcgtactataacatcttgtttactataaattttcgactataaaacttgaagtaaaattgtgtgtaaaggagtttagaaattggattacttaaaaaggttgttagtaggtaagcctttaaaatctgctgaaaatgatgagcacaaattaacccgatttgctgctttggcattattgtcgtctgatgcgttatcatctattgcatatggtacggaacaaatcgttgtcgttttagtcgctttgtctgctgcagccatctggtattcgctacccattgccgcttttgttattattttattgatttcattaacgctatcatatcgtcaaatcatccatgcttatcctcatggcgggggagcatatgtcgtcagcagtgagaatcttggaaagaatgctggcttgatttccggtggctctttattgatcgactacatgttgacagtagcagtatctgtctcagcaggtgctgaagcgatcacatcagcggtgccagcactctacggtcatcaagtcgctatttctgtgacaatcgttttgctactgatgatgctgaatcttcgtgggctgagggaatctgcatcgttcctattatttccggtgtacacatttatccttgtgatctcgttactgatcgttgttggtttatataatatcgtgacaggtgctgtgccattgcaagctactgcacttccaggagcggctgtgccgggtgtttctatcgctttgattttacgagcattttcttctggttcttcctctttaactggggtggaggcgattagtaatgctgtaccattctttaagaagccaagagcaaaaaatgccgctgctacattgacgatgatggcattgatcttaggtttcttcttcgtggggatcacatttatcaactattggtatgggatcgttcctgaaaaagaagtcactgttttgtctcaaattggtaaagctgtctttggacatggtattttgtattacgtccttcaatttgctacagcgctgattttagcagttgctgctaacaccggtttttctgcttttccagttcttgcatacaatctggcaaaagataaattcatgcctcacatgtatcaagatcgtggggatcgactaggctattccaatgggattatcacactagcgctaggttcgatcgtattgctgtttattttccatggctcaacagaacgcttgattccgttatactctatcggcgtgttcattccatttgctttatctcaaacagggatggtcgtcaaatggaaaaaagaaggaaaaagatggttaagcaaatcgattgccaatattacgggtgcgttcatctcatatgcaatcattgcgattttgtttgtctatcggttaggggacatttggcctttcttcatcattatgccaatcgttatgttcattttttataagatccatgatcattataaaaaagtagcagaacagcttcgtttagaaaatgatgcaaaactacatgattatgacgggaataccgttcttgtattagtcgggaatgtgacacgggtaaatatcggtgcgttgaattacgcacgttcgatcggtgattatgtcgttgcgatgcatgtttcgctagacgaagatgtcgaaaaagaaaaagaaatcgaagcagaatttaaaaagcatttcccagatgtccgtttttcaatcgtccactcttcttatcgctcgattgaaaatccaattatccgttatgtagatatcgtaagtaaaaatgcagcgaaacaaaactatacaactactgtgttgattcctcaatttgtaccaaacagacgctggcagaatattctccataaccaaacaagtttgcggttaagattgcgattgtcttggcgtgaaaatatcgttgtcagcacctatagctaccatttgaagaaataaaccaagttttaaaatcaaaaacagaccctctagctcttaattgaagctagagggtctgttttgtcttattctcagctaaaggtgccctctataagccattaaagatgggaacagcgtatgaaatgttattattcttcctatttagctgtaaaacattttgattttgatgtcttgatcataatttccgaatcctttgccaaataatgtacagcctcctatattttcagcttcttcctttacctcgactcttaagtgccatgtgtcttcataagtaggaatctcagcctcgtcaagtgaccattttttgttaccataactcagtgccatttttaattggtgattcacaaacccaacggtctaagcaagtatcaaatcgatagtgaacatgaatgacaggagacgaaagaggcaatcatttttgaggcagtagaagacttgacggccaaaatcagttttgaataaccgttacaaatctttcgtgcgtatcctcaggttattcaagatatcaatcaagtcacactgcaacgaggaaccttcgtgtattggtgttgttgcatagactcacaggctttggattcgacctttgctaaagatgatacgttgttaccaattactttacgtttggctaccgctagtcgtaaaggagtaagaagtgagcgtggacaaagatcctccctaaaaaggggtctttttctctatgtaaaaaagaggaaaagtttgctgaatttaagtgctttattgtatttttttgacgtacttaatcaagtacgctataattatatcagaaaaaggaggagagacaatggctaatacaacgatgaatcctagcactgctcgtaaaaatttttatcagttattgaaagaggtaaatgaaaatcatactgaaatcgagattattagtgatcgtagtggaaacaatgctgtattgattgggctggaagactggagagcgattcaagaaaccctttttcttgagcaaacaggtactttagataaagtacgagaccgcgaaaaagacgacagtagctttacgaatatcgatgatattgattgggaagctctttgatgagtaactatacagtcgcaatcaaaaactctgcgaaagtggatttaagaaaaatcaagcaaacgaatttaaagaaacaatttgaagaagtgattcagacattgaaggaagatccatatatgcccacgcagtcttttgaaaagctgagacctacacatgaaggcagatactcacgcaggctgaatagacagcatcgagtggtttacaaagttgatgaggaaaataaagttgtagaaatttattctgcctggacacattatgagtgaagtgagaagagccaacctttttagatagttaacaaagagtctccccaaaaaggagactctttttttgttctaaaaccaaccttcttggatttattgcatgatttctttaatttgttcctatatctccacctttgaagggtcattgtttgagtttaggaatggaatgttgacgggtttatgtaaaacaaggaggaagaagtgtgacaaggaaaatcagtaaaattggagcatcgttgttagtgttggcagtggcaacgaccatcgattatcgccaaagtgaggcgaagacaattggaaatgtcgtttatcgagaaacagccaaaagtatgttgaaaaaagcaatggacaatcaaccggagtcgtcttattggttcccagaggattcgttggcatggtcttttggaaaagatacagatacgaaatacaataccagtgtcgttcctttagcagagcgggtatccaaagcgacattgccgaacatgaatgtcactcaaacggaagaagttaaagtcgtggcgctttcggccatgaatagcagtatcaacggcaatgcatcacgagggatcgatatcttttacgccaatgtcttttcttattggcaatatatcgatcaattggtttacgggggtgctcttctggtgaaggatcatcgtatcgccaagtctagttgcgacggatgcagtccataagaatcgtgtaccggttttaggaaccgcaaacctcccatggcgagaagctggaatggctagatatgtttttagccaaggatgaggatggcaagttcccgattgtataaaagatgatcgaagttaccgatacggcagtcaccagttttgatgatgcagctgaaggcatcgaacaatcgaggactgatggaaaaggcttaaatgaaagccacgccaaaggatgtaagaattgatgcccaattcaaagaacaagcagacgagtatttagagatcatgtggtatgaattccatgacgagtgatgggaaaatggattggcaaaatgccttagcggataagaaaaaaacttagtcggtggatgcagatatgaacccgttggcagtatgaagttggagtatacggaatggataaatagctaagaaaagcaactctttgcccataaggagggaagaatcagagtggattattgccttaaaaatgacagaactaaaaaagcctttgcgaccaacaaatggtcgcagaagcttttgttttttacaataacatcagcgtgatgtacggctggctggatctagccgtctttccaaaatacctaaaagccagtccgtgatgatcgccattaatgcagttggcaatgcacctgctaaaataatcgatgtgccctctgttgcattggttcctcggataatgatatctccaagaccaccagcaccgacgaatgcaccgatcgcggttatcccgatggcaacaactaacgcgtttcttatgcctgccatgataacagaaacagagagtggtaactctaccatgaatagtcgttgtctagcagtcatccccatgcctttgccgacatcaaggatgtttttgtctacttggatcatcccggtatacgtattcttgatgatcggtaagagggaatacaaaaatacagtaacaatcacgacattgactcccaggcctaatccaatgattaaaatggagatcatggctagagaagggatcgtctggatgatattcgccaaacgaatcacccagtttgctaatttacgtctcctagaaatcatgatcccaaccggaatcccgacaactgctgcaaagaggacaccatagatagaaatcaggaagtgacggataaattgtgcaaagatataggagccattttcctggaaataatagaaaaattgttgaaagacattcattttatccaattgcttcacttcccttcaaaatagtggttttcttgtaagaaacgttgtgctactactgatggttccactagattattatctgcttcgtagttcaattcctgcattttttccgtactgatggtatgacctaacttatttaaggcttcttttaaatgaggcgtatcagctaatatcttgttgtctacaactggagcagcatcatatggtgggaagaattgacgatcatcttccaacatgactagatcataactggcgatccgtccatccgtagagtagccaagaacaatatccatttttcctgcttcgactgcgtcataaacaagtccaatctgcataggtaatatcgaattgaaggagaagccataagtttcttggaagccgtcataaccgtctcctttacgattgatccaagaagtatctacaccagctactaattcatccgctacatttttcagatcgctgactttagatagatggtatttttgtgcggtgtcttttcgaacaagaaagacatacgtattttcaaaaccataggacgggaaccacgtttgaccgtatcttttctcaaattcatctttcacggtagcaaacgcttttttcggatctttttcaggaggaaggttcaatgtagtcgttaaatctgttcctgtgtagcgagccgctgaaattgaagcatctccgttcatcatcgcttgatggttgatagttgtagtagccagattgttgatgattgcggtatttttatctgtataatgttcaaccattccggcaactagacttgctaagatctgtgcttctgaagtgattccacctgtgatcgaaatggtgtcttcatctgtattgctggcaagaccagggaaggaacaactcgcaagtataagaagagagaaaagaaccatggtcatttttagtatacgtttcattcttcattctcctctctaagtgcgatcggtgtcagccggtgttccaagagacctagaagccaatcagccaatagtgctaaaattgttacagggatcgtacctgccaaaatgagatctggttggtaattattcagtccactaaaaatcaaatcgcctaaaccaccagcgccgatataagaggcaagtgtagcccatgcaatcacgtaaacggcagctaaacgaataccagccatgatcgttggcatagcaatgggcaattcaacggaaaaaatggattggaactcagtcatccccatgccttttgccacatcccgataattccaatcgacatttttcatcccaatgtacgtattacgtaaaatcggcaataatgaataaataaagagtgcgataatcgcaggtaatttacctacgccaaatagcgggatcatcaatgccaataaagcaagagaagggattgtctgcaaggcactggttaagccaatcacaatcgtggcagcttttggaaaacgtgtcagtaagacaccaagcggtacagcaatgatgataccaatgatcaaagcaagtcctgaaatataaagatgttcaaaaccttttgagagaatttctgaaccgtgctgatgaaaaaactgctgcataggtcagacctccttagattcttcaggagtagctgactctgcaacatcagtagttgcgggatcttctccccaaatcacatcgtagacgatatccactaatgatgcacgagtcaggatacctacgactttgttctgttcatcaacgaccggcacgtatttcagcccgcgttttaaaatgcgttgcaaggtatcacgaagataggcggattcttttacgtaaaaaacatgtttattcaaaatgtcgccgacactggatacttttcctcgttttttattcaacgtttctacatcgataaatccttttaatacattcgaattatcggtaactaacaacgtatctacacgtttttccctcatcagtttgattgcttcttgtaatgatttttccggtgtaatcgtgattgctgtatttagcataacttcgccgactcttgtcgcatttggcttggcttgtagtaggcgatcttctccaatcaactcttctacgaaatcgtttgcaggatgacgtaaaatattttctggtgtatcaaattggatcacacggccttcactcatgatggcgatacggcttgctagtttaatcgcttcatccatgtcatgggttacaaatacgatcgtttttcccaaacgctcttgtaaatctttgacaaggtcttgcaaggaatcacgagtgattggatcaagcgcaccgaatggctcgtccatcaagatgatatcttgattcgctgcaagggcacgaacgactccaatacgctgctgctgaccaccagataattcatgtgggtagcgatctaacatctcacggggcaattccacaagatcaatcattttttcagctgttttattccgttcttcttgactgactttcaacaatttttggacaagagtgatattttcacggatcgtcatgtgaggcatcaatccaatactttggataacatagccgatctgacgtcgcaattccactggatcaatttcttggatggattttccatcaatcaaaattttcccttgtgttggatcagtcattcggttgatcatccgcatcgtcgtcgtttttccgcttccgctcgtaccgataaaacaaatgaactcacccttttcaaatgaaagattgacgtcctctacagcgacttttccacctttataaatttttgacacattttgaaattcaatcatggtgccacctctttttctattttcaatgaagaactatctattactagtatgcctaaaacaatgaaaaaatacaaatagggtagtttttttatttaggaaaacaaaaaatagaagtgaaaaagtgctgattttgccaacagaacgaaaaacatgatagaatgatgaagcacatgatagaaagtgagtgacgatatgttaacaacagaagattttgattttgacttgccggaagaattaatcgcacaaacaccattaaaagaccgcgatcattctcgtttacttgttttggatcggaaaactggagagatggaagataaacatttccatgaaatcattgaagagttacagcctggtgatgcgctagttatgaataatacacgagttctgcctgctcgtttatatggagaaaaaccagatactggtgcgcatttagaagtccttcttctaacgaatacacaaggagatacgtgggagacattgatcaaacctgcgaaacgtgccaaagttgggacaagaatctcttttggtgatggcagattgcaagcagtagtgaaagaagaattggaacacggcggacggatcattgactttgagtatgaaggaatttttctagagattcttgaatcattgggagaaatgccattgcctccatatatcaaagaacgtctggaagacccagatcgctatcaaactgtctatgcgaaagaaaatggttctgctgcagcgccaacagctggattgcattttacgaaagaattacttgatgagatcgaagcaaagggtgttgaattagtctatctgacactacatgtagggttaggtacattccgacctgtcagcgtagataaaattgaagaacaccatatgcatagtgaattctaccgtttgacggaagaagcggctgagcgattgaaccaagtacgtaaaaatggcgggaaaatcgtggctgtcggaacaacttcaattcgaacattagaaacgattggaacgaaatttaatggagaaatcaaagcagacagcggatggactgatattttcattacgcctggctatgaattcaaagtggtagaagctttctcaactaatttccatttgccaaaatcgactttagtcatgttagttagtgcctttgcaggaagagaattgactttatctgcttaccagcatgcgattgaagagcgctatcgtttctttagttttggagatgcgatgttcgtgaaataaggttatgaaaagccgctagttttgaataacaaaaaagctttacaaagattttatgacaaagaaaaagccgagctctcgataagctcggctttcttgtacctcggaaggattcaaataaacagaaatgattgtaactttccatcatacatgcaaagcacggtgttgaatttcttcatgttaaacaaaaattttgttttcgttacatcttcaacatttgaaacatctcttgttcctattcaattttcagacgtttacgttattcaattgttacgtatcgcattacttcttgtttcggatacttcgtgatccaaacatccatacgcattcactatttataggtttgtactctacacgcatgtctgggtgaaacctgtacttctaacaactttgtttgcttacactgttctatcgagaaattcttctgtctatttgatggtatcctccttccttacatctatataatagcatcctttggtagcgtttgcaaatataagcactttaaattttacgctttcttaacaaataatcgataagccctttatttgaagtaaataaaaaaaggatgttatagtaaaataagtacctttttttgtacgaagattttaaaggaggaataggatggaagaatacaagcagacaatagaagaagtaaagaaggtaacagaagcagatccagatactgggttgtcttcacaagaagtggatgaacggcgaaaaaagcagggattgaataaattcgatgaggcgccgaaagaatcgatgatcaaaaaattctttcgaagcttgtccgattttacaacgatcatccttcttgtagcagcggtgatttccttttataccgcatttgctacagaacatggggatttatttgaaggactgctgatcatcgctatcgttgtgatcaactcggtattggcgattgtccaagaaggaaacgcagaaaaagcactggaatccttgcaagatatgaataaacaaacggcaactgtcatacgagacggcaaagtgaccactgttgagtcagagcaactggtagtgggtgatattcttgttttagagtccggtgatgctatttctgccgatgcccgtttgatcgaagcatcacaattacgtgtagaagaatcggcgttgactggagaaagtgaagcagttgaaaaagatgcagcatttattgctgaagaagatgagtcattaggtgaccaacttaatatggtatttaaaggatgtacggttgctgcaggtcgtgggaaagcgatcgtcactgccattggcatggctacagaaatgggtaagatcgcggatcttttgaacgaaaatactatgcaaaaaacacctttacaggtccgattgaatcagctaggcaaacgaatcagtatgatcgctttagcggctgcggctttagtatttgtgattggtgaactgcaaggagaaccactccttgagatgttcatgacttcgatttccttggctgttgcagctgtaccggaaaccttgactgttattgttacgttgacacttgcatacggtgtgcagaagatggcgaggaaacatgcgatcatccgacagttgccagcagttgaaacgctaggaaccgctaatgttatctgctcagacaaaacaggaacgctgacacaaaatgaaatgcgcgtccgccgggtatggagcaaagaagatgaagtaacgaatatcgaagattcaatgacgaacagcgcgatggaaatattgaaaatggctgcactatgtacagatgtgacggtcgagcaagaagatgacgaccttgttatcaaaggtaatccaacagaagtagccatcgtaagggctgttgaagagaattatcatacaaaggcagaattagaagaaaaatatccacgagtaaacgagcttccttttgattctgaacgaaaaatgatgacaacagttcaccaaatgggcgaaaaatacatctcaatcaccaaaggagcattcgatgttcttgctccgcgctttagttcaggcgatgtagaacaagcggcgatcgttaatgatcgctttggtaaacgggcactgagagtgattgctgttggttatgctacttatgacgaagaaccgcaagatatttcttctgaagcactggaaaaagacttacgtttgattggtctgatcggaatgatcgatccaccacgtccagaaagtaaaggagcaatcaagcgagcgaaaaaggctggcatcaaaacagtcatgatcactggagatcatgtggtgactgccagtgccatagcgaaagaattaggtatcttgaatgatccgtcagaagcactttcaggatcagaactgcatcaattatcagacgaagaattagatgcgcgtgtcaaagctctctctgtctatgctcgggtaacgccagaagacaagatccggatcgtcaaatcttggcaacgtacgggtgcagtcgtagcgatgactggggatggtgtgaatgatgcaccagcgttgaaagcaagtaacgttgggtgtgccatggggatcacaggaacagatgtggcgcaaagtgccgcagatatgattttgacggatgacaactttgcgacgatcgtagacgctgtcagtcaaggacgttcggtttatcagaatattcgtaaagctatcaactttttgctaagctgtaatatttcggagatctttattgttttgattgcgatgctgttaggatggggagcaccatttacagctgtgcaactactgtttgtcaatgtagttgctgatggacttccaggatttgctttaggaagagagccagcggaacacggcatcatggatcagccacccattccgaaaaatgaagggatctttgctcgaggtttattgcaaaaaattgccataaatgcaggggtcttcaccatcgtaaccttgtttggttattatttaggtagttatgtcgatactatcagcccatgggtagacgcaagtcagcatgtcggtcaaactgttgcattcttgatcttagcttattcatcgattctgcatgtgttcaatgtacgcagcagccaatcgatcttcaaagtcaatttagcgaccaataaagctttggtagaaatggcgttactggcattagctattacaacggctgttgctttgctgccatttacgcaagaactattcggcctagtacacatcagtttgaatcactggttcttggtagggattttatctatcgtaccaatcgcggtgaatgaactgatcaagttccatcgattaccggaagcagaagaagaggaatgattaactgtttctaagttgattttctttttactggaactatacaaaaaggaggtgtgacatgaatgttgtcacacctcctttttgctaatgggctgaatgtttcttttactgcctctcgataaacggtgttctcctgccaccccctcggtcacaagtcacactctcttttaaatatcttttggcaattgttcataaaatgctgcttttgttgcagaaatgtatgggctgagccatagataaccaataccagcagttgctaatgctaagatatgccagccgataaatgaaagatctaaccagaaaagttgtcctttataaccatccatcaattttcgacttgcagtgatcgtatccagtactttaggtgtttgtcctgtttcttggacgatatcgtagtaaataaaatagctttgagaataagaatagcttttaatgattccaggaataactaatagcaaaccccataatgttgtaaagatcgagatcagcacagctaagctgatcactccgccgataaacaaacctttgaatccacgaaatgcatctttgaatggttcgatctgatctttttgtccacgtaaaatatcaagataagtccaagaaataccgctcatgaacaaagcgctaatgatgctggaaataattccgccaccgcctcctgaactaccgcctcctgaagttgtcgcttctgagacgctcgctgatccatcatatatggtggtggcaaacaagataataggaatcataataagaagaatagtagcaataccaatcaatgtagggattagatttagtaaaacagcttgtccccaacgtccttttagactctcttttgcttggcgttttaattctgcagaagattgcatgatttttccctccttttctttaataacaccaatataccatgtatcaaaaaatatttctgtcataatgtttttcttttttttgttattcataaaaaaaggataaaaaaaagaatattaaataaagtagaaggaagccgagggaacttgcaaaaagcacttgaaacgattatgatggtgggagttgtcaagatattttatatagaaagtagggaaatgaatgacgcaacctgccattcgctatcgtttaatcaagaaagaaaaacatactggcgcgcgtttaggggaattgatcacgccacacggaactttccccacaccaatgttcatgccagtaggaacattagctacagtaaaaacaatgtccccagaagagttgaaagaaatgggtgctggcgttattttaagtaatacatatcatttatggctacgccctggtgaagacttagtagaagaagctggcggactgcataaatttatgaactgggatcaaccgattttaacagattcaggcggctttcaagttttttcattaagtgatatgcggaatatcgaagaagaaggcgtgcatttcaaaaatcacttgaacggttcgcgtatgtttttatcaccagaaaaagcaatcaacatccaaaataaattgggctctgatatcatgatgagttttgacgaatgtccaccattcgatgaaagttacgactacgtgaaaaaatcagtagaacgtacgtctcgatgggcagaacgaggattgaaagctcatgctaatccagaccgtcaaggattatttggaatcatccaaggagcagggtttgaagatcttcgtcgtcaaagcgcgaaagatctagtcgggatggatttccctggttactcaatcggcgggttatctgtcggggaacctaaatcagaaatgaatcgtgtattagaattcactacaccgttgatccccgaaaacaaaccacgttacttgatgggtgtcggtgctgctgattcattgatcgatggtgttatccgtggagtagacatgtttgactgtgtcttgcctactcgaatcgctcgaaatggcacatgtatgacttctcaaggccgtctagtagtgaaaaatgcgaaatatgcccatgatttccgtccaattgatgagaaatgtgattgttatacatgtaaaaactatacacgtgcctatatccgccatttgatcaaatgtgatgaaacatttgggattcgtttgacttcttaccacaatttatacttcttgttgaatctaatgaaacaagtacgtcaagcaatcatggatgataatttgcttgaatttagagaagccttttttgaagaatacgggttcaataaagaaaacgcaaaaagctttctaaaggaaaatcttttaaaaattaagtaaaaaactagtgttatcagcatttttctgctaaagtgttttttgtagatacagaattagtgaggtgaaaaaaatgggaacattaccaatgcttgtgatgtttatcgcgctattagcaatgtggttttttatgtcacgttcgcaaaagaaacaacagcaagaacgtcaaaacttgttagatagcatgaaaccaggtgattcagtcgtaacgatcggcggattacatggagttgtttcagaaatcgacaatgacaaacggacagttgttttagactgcgaagggatcttccttgagtacgatcgtgcagcaatcaaaacggtcaaaccagggactgtcgtaacaaatgatgcaacgactactgttgaaacaacagaagaaccagctgagacagttgaagtaaaaactgaaacaacagaaacgctggaagagacagaagagaaggaagaaaaataagtatcaaagcttatttaaagacgaggtagggcagaaagatgtcctacctcattttttattcaaaaaagaaagagataagagcatgggatatattgctcaatattgaataatcgggtgtgtcatataaataataataaataactttatatatttttctatacaaacacctgtaaataaagcaattttatatttaaaaataactgtgaaaaaaatcacaaaaaagtgtttacatagaaaaataaatattgtatgatatacatgtgaattatttaacaaataaccatgacccattaggaggataatgatggctaaagtaatagaaaaagaaaaaacgaagacaattgacgtacaagcaatgattgatgatttggcagaaaaagcaaatgcagcattgaaagaaatggaaagctttgatcaagaaaaagtagaccatatcgtgcatgaaatggcaatggcagctttggatcaacatatgccattagcgaagatggctgtagaggaaacaggccgcggtgtttacgaagataaagcaatcaaaaatatgtatgcgtccgaatatatttggcataatatcaaacatgataaaacagttggtgtgatcaatgaagatgtccaaaaagggttgattgaaattgctgaaccagtcggtgtggtttgcggagtaactccaacaacgaatccgacttccacaacgattttcaaatcaatgatcgcgttgaaaacaagaaatccaatcgtttttgctttccatccaagtgcccaaaaatcttctgcagaagcagcacgagtggtacgtgatgctgctatcgctgccggagctcctgaaaattgtatccaatggatcgaacatccttcgatcgaagcgacttctatgctaatgaaccatccaggtatcgcgatcgtcttagcgacaggtggagctggaatggtcaagtctgcttactctacaggaaaaccagctttaggtgtaggtccaggtaacgtaccagcttatattgaaaaaacagcaaaaattaaacgtgcagtgaacgatttgatcgtttcgaaaacatttgataatggaatgatttgtgcttctgaacaagctgtgatcgtggataaagaaatctatgcagcagtaaaagcagaattccaagcacaccaagtttatatcgtaaaaccagatgaattgcaaaaattagaagatgcagtgatgaacgaaggaaaatatgcggtcaatccatcaatcgttggacattctgcgatggaaatcgcaaaattggcaggaatcagtgtaccaaaaggaacgaaaatgctgattgctgaattggaaggcgtaggcccagattatccgctatcaagagaaaaactttctccagttcttgccatgatcaaagctaacaacacggaccatgcgtttgatttgtgtgaaggtatgttgaatcttggaggattaggacatacagcagttatccattcagaaaacgaagagttgcatgtcaaattcggtcttcgaatgaaagcttgtcgtattttagtgaatacaccatctgcagaaggcggcatcggtgatatctataacgaaatgattccgtcattgactttgggatgcggttcttatggtaagaactctgtttctcgtaacgtctctgctgtaaacttaatcaatgtcaaaactgtagcgaaacggagaaataacatgcaatggttcaaattaccgccaaaaatcttctttgaaaagaactctctattgtacttagagaaaatggaaaacgttgaacgtgtcatgatcgtttgtgaccctggtatggtccaattcggttactgcgatacagttcgtgaagtattggcacgacgtaaaaatgatgtgaagatcgaagtcttctcagatgttgaaccgaacccatcgacaaataccgtatacgcaggaacgaaactgatggcagacttcaagccagatacagtaatcgctcttggaggcggttctgcaatggacgcagctaagggaatgtggatgttctatgaacacccagacacatctttctttggtgcaaaacaaaaattcttggatatccgtaaacggacatataagatcgacaaaccagaaaaaacacaattcgtatgtatcccgacaacatcagggactggttctgaagtaacgccatttgcggtcatcactgacagtgaaacacatgtgaaatatccgttagcagattatgcattgacgccagatgtcgcaatcgtcgatcctcaattcgtcatgtcagttccagcatctgtcacagcagataccgggatggatgtgttaacacatgcaatcgaatcctatgtttcagtcatggcttcagattatacacgtggattgagcctacaagcaatcaagttagtctttgactatttagaaaaatcagtaaaaacacctgatatggaatcacgtgaaaaaatgcacaacgcttctacaatggctggtatggcgtttgctaacgcattcctaggtatttgtcactcagtcgcacataaaatcggcggggaatacgggatccctcatggacggacaaatgcgattcttttaccgcatattatccgctataatgcaaaagatccacaaaaacatgcgatgttccctaaatatgactatttccgtgcagatacagattacgcagatatcgcaaaattcttaggtctgaaaggcgaaacaacagaggaattagtcgaagctttagcaacggctgtttatgaattaggaaaatctgtcggcatcaacatgagtctaaaagctcaaggagtcacacaagaaacactagatacaaccgtagaccgtatggctgaattagcttacgaagaccaatgtacgacagctaatccgaaagaaccattgatctctgaattgaaacagatcatcattgatgcttacaacggataagcaaaagaaagcgtagaaaaaagataagaaaatagatgaaaaagaacttggaaaacgttgtttctccaagttctttttttaatttccaagtaactgaaagttacttttgttatttaacatttaggtcaattttagacagtttttgttcaaaaagcgatatttatagtggacggtattactgctatattaaggatataaaatgaaagcgtttaaaaaggtggcgtaaagatgattattaaagaagagatttttgtacctaaagaattagtgaaagaaaaaattgacctgctcgttgaaaacctgacaacgatcaaagacgataatggtgaatttttgttggactttgatggactgaaagtagatgacaaaagctggacagtgtggaattggccacaaggtgtcggtctatatggtatttataaaaattaccagatgacaaaaaatcctcgcgcttatcaagtggtcaatgaatggtttgaggatcgtatggaagaaggcgctccgcccaaaaacgtcaatacaatggcaccgctattgactatggcttacttgtatgaagacacgaaagattcacgctatttgccttatttagaacaatgggcagaatgggtcatgaatgacatgcctcggacaaatgaagacgggttacagcatgccacatatggaccggaaaataagaatcagttgtgggacgatacattgatgatgacagtgcttcctttggcaaaaatcgggaaactgttgaatcgcccagaatatttagaagaagctcgttaccagtttatgatccatatcaaatacttgatggataaacgaacaggattgtggtatcacggctggacgtttgaaggaaatcataactatgccgaagcattttgggctcgtggaaactgctggttgacgattgctattccagagatcattgaaatcttagaattatcgaaagaagatgcattgcgcaaattattgatcgaaacacttgaagcacaagtgcgtgcattaaaaacttatcagtctgaaagcggtttatggcatacgttgttggatgatccttcttcttacgtagaatcttctgcaactgcaggatttgcttacggtattttgaaagcggtccataaacgttatttaccacaagaatataaagaagtcgcttatcgtgctatccaaggattgcttgaacaaatcgatgaaaaaggagaagttcaaaacgtttcaatcgggacaggaatgggggacagtttagatttttatcggaatatcggaatcacagcaatgccttatggacagtcgttaacggtgctttgtttgacagaattgctcgtctcttattgttaaaagaaaggaaacccatatgaaaaaaacatcactgctgtttgcagcaagttcgcttagcctaggtctgctaggtctaagcggctgcggaaataattctagtgtggcaactgtcgcagatgcagatgtaaatgagatagttaccttgcgctttgcttatgcaagcaacagccagccagtaattgatgcaatgaatgaatttgggcgtttagtaaaagaaaaaacagatggttccgtacagatccagtatttcccagatggacaactgggtggagaacgtgaactgatcgaattgacacagtcaggagcagtagatttcacaaaagtaagtgcctcagcgttggaaagtttctctaaagattattcgattttttcagttccttatctattcaatgatgaagaacatttctttaaggtgatggataatgaagaaataatggagccaatctaccaatcgaccaaaaatttaggatttaccggattgacctattatgattctggtcagcgcagcttttatatggtagacggtccgatccatacgccggaagatttggagggaaagaagatccgtgtgatgcaaagcgaaaccgctatcaaaatggtagagcttttaggcggttcgcccgtacctatgggaagtgatgaagtgtacacgtctcttcaatccaatttgatcaacggatcagaaaacaatgaatttgtcttgtatacagctggacatggtggtgtggctaaatactattcctatgatgagcatacacgtgtgccagatatcatcatcatgaatgatgccatcaaagaacagctaactgatgagcaggaaaaagccattgaagaagcagcgaaagaatcaacggtttttgaaattgaagcttttgcaaaagcaattgaagaagaaaaagctttagcacaagaagaacatggagtccaattcaatgatgtagataatacaccgtttcgagaggcagttgccccacttcatgatatattcaaaaacgatcctacctacaaagacctttatcaaaagatccaagagcaaggagcgtagctgtgatgaaaatgattttaaacaaggtattagagatcctgggagctgttttgcttgttgggatggtcgctgttgttttatggcaagtattttccagaacggttttaggaaatccaaatacggtcacggaagagcttgttcgattcggtcttgtctggtttgccatgttgtcttccgcgtatgttgtgggacaaaaagcacatttagccgtaacggttttaagtgaaaaattaactggcaaaaaaagtaaaattttagaagttgttgttcaaagtttatttctggtatttgctgcgatgatcatggtgtatggcggatggaatgctgtcacattgacaatggggcagatctcgccttctttaagtattcctatgggatatgtttatctgtcagtacctgtatcgggggtactcatcattatctatagcctgatcaatctaatcgatacattaagcaacaagccagcaattcaagaaaaaatataaaaatggaggaataaaatggcaatagaagccggattagtgttattttttgtatttgttgtgttgcttgtattagggatgccgattgctataagtattgcattctcatcgatgatgactttattgttagttataccgtttgatgtttctgcttttagttcagctcaaaaaatggtgggaagtatcaatagtttttcgctgatcgctattccgtttttcgttctctcgggcattatcatgaataatggagggatagctaagaaactagtggattttgcgatgttgttcgtcgggcgcgtgccgggggctttggctcatacgaatgtgttagggaatgctttatttggttccatctctagctcggccattgccgcttctaccgcgattggcggagtgttgatccctcagcaagtggaagaaggatatgaccggaagtttgcgacagcggtcaatatcgcgtcagctccgacaggtatggtcattcctccaagtactgcttttatcatgtattcacttgttgctggtggtgcttcgatctctgctttgtttatgggaggttatctcgtaggcgctttgtgggcgctaggaatcatgctagtagcattcatcgttgctaaaaagaataaataccctgttgtcgaaaaaggacagatggctcatgctggaaaaataataaaagaggcgattcctagccttctattgattgtcatcattatcggtggtatcttgacggggatatttacagcagtagaagcttcagcgatagctgtcatttactccctgttgattgctatgttttactataaaacggtaaaactaaaagatatacctaatatgttgtttcaatcagtagcaatgtcagggacgatcatgttcttattggctacttcttccatgatgtctttcgccatggcgtttaccggtattcctcaggcaattagttcgttgattatgggcgtaacggataataaatttattattctgttattagtcaatcttgtgttattactggtgggtatgtttatggatgtggcgcctgctatcttgatttttacaccaatatttttaccaatcgtcacaagtgtaggggttgatcctgtacattacgggttgttttcaatcatgaatctgtgtgtaggctccatcacgccgccagtaggtacaggactatatgtcggtgcaagtgtaggaggcgtaaaagcagaggcaatgctgaaaccgcttcttcctttttatggggttatcttagtcgtcttgtttttgattacttacttcccgcaaatcgtcatgtggctacccaatatgctgagttaggagaatagttatgttgaacattacaattagaggacatgatctttccgaagtccaaacgatagaagatcttgcagaaaaaacaaaagaacaagggattcatacactgcagctcgccttaggtctttcgtttcctgaaacaccttctggcgcaaatgagatcaattctgggatgggaaattatgtcaaacgagttttagaaaagcaagaagtgaccgtaggaattttaagttgctatatcaatatgattcatccagatttaacgatacgacaagagttgctgacaaagttcgagcagtatcttcgctatgcttcttcctttggtgcgtcgatggttgcttcggaaactggatgtgttttgccggaaatccaatatacggaagaaaatttcacagatgaagcatttgctgaagctgtgtccgttatccgtcgcttggtaaaagctggagaaaaataccaaatgatggtggggatagaaccaggtttgaatcatccggtgtattctttagcaagggtagagcagctgatccaagcagtagattcggactatctaggaatcattttagatccgaccaatttgatcacaagtagtgattatcaagaacaagtccaattggtagaagaagcttttgaacgttttggtgaaaagatatgtgcggttcatttgaaagattttcgtgtcgaacaggaaaaaatcgtgccggtaaatttgggagacggtgtgatcgagtacacaaaaatcaaagaaatcatcatgaagaatcgtccgtacctgtatgtggttcttgaagaaacaaaagatgatgggattcgttatggaagaagtcttcttgaataatgtaaagaagacgttggttaactaatatttagaatggagggggcggggctagaagatgccacgtctcttcttttttataagagtatataaaagcagctctttttgattacaaaaaacgtggtataataaaattgtgcataagtgaacaaaaggaggtgcggcacatgctccaaaagaaaatcagcggtgaacaagtcaatacgatggtttctgatcagtatgaaatctatcatgtcaaagatgtcgtcagccaaaataaaacgatctatcatcatcatgatttctatgagatccatgctacattaaagggagaagcgactttttatttgaacggacgacaatttacgatcaaagcaggaagtgtgctgctcatccattccaatgatttgcatcgtatcgtccgccaatcttcagatgtattcgagcgtgtctatatctttgtcaccccttcttttctagaaagtcgttccacgccatggtctaatctatcggcttgttttcaaccaatgggagagaagaggagtcgtgtattgcaaatagaacaggaagtattgaagcaaaaattatcatttatcgaccatcctcctgataaaaaaatttacggtgaagacataaaatatgaacaagctctggtagaatacttgatttttctcaatcaagttgtacaaaaagaagagagtgcgcaagaacagaatgctgtagttcctaatgagcgtgtggaacaaatgttacaatatatctcaaaaaatttatctcatccgctttctttagaggaaatggaaaagcagttttttgtcagcaaataccatatcacacgagaatttaaaaagtacactggatttacgtttcatcagtatgtaatgaagaaaaagctgatctatgccaagcacttgttgcgagaataccgcagctctagtgctgtatatagtaaaagtggtttttcttcttatccgcattttctgaaagcattcaagagagagttcggcataacgcctaaagaatttttgaaacgtgatacacagaaacagttggttcattatgaacattttgaagatgaacaatgagaatgatcactaaaaaataaccgcagtagctgctgttgtttacatagaagcagaaactgcggttattttatttttatctatatatttcaaaatattttgaaaaaatgacgtacatattatatgaatcagctgaatttacgaaagtctctcggcgatagtcctgtttttgctttgaacaggcggctaaagtaagcaaaattctcaatccctatttcttcggaaatcattcgaaccgtaaattctgtataccgaagaaggtctttagcgtaagaaagttttttgctgatcaaataatcgattggtggagaaccgataaatttggaaaaatctttgctcagctgatatttattcaataagaattgttgttctaattgatcaagtgtaatcgtttctttgaaatgttcgtctaagtattgcttcagtttgtaaacgtaggcgggaatatcctcttcttcgaaatctagctgatacttttgcaaaatcagttcattcagcaactcgtggatagctacagaggactggaaatcggtacgggcattcgtgccttgttgcatgtggatcaattctgtgatcaaatggtggatcttgttttctgatggatcccctgttgaatggaaggtgttatggccgtcttttgtgaactcctgataaaatgattggacgttctgaccattcaaatggatccaatccatttcccatggttcttcgctgatcgtttgataacgctgatattcttggcagtcaataaaaaataagtctccagcttttagctgttgctgattatcattatatgtaagcgaacctttgccagacaaagtaaactttatcaagtaagaaggtaaatgtgctcgttcagtatagtaagggattggtgctttgaagtaaccgatttcttggatataaaaaaataaattcctgcttctttgtgtaggcgtcaagatcactctttttgagtcttccgaccatgagtggttggctttttcccagtaatccatgtaaacactcccaacttgtcaagataatgcaattatataccaaaatagtgtgaagcaaaatataagattctgtattatgatagcattgttaataaatgataacgctttattaataaagtgctaatcaacaataaagtaaaagaggtggagaaatgaatccaacatttgttgccatcgatatcggtgcatcaagcggacgactaatgaaaagtacgagggatgcaaaaggttctttgatcttggaagaagtacaccggttcaaaaacggctttcggaacaaagacggtcacgatcgctggaagatcgattatcttatcaaagagattttgattggatttgaaaaattaaagcagacagggattgatcgcctttttgcggggatcgatacatgggcagtcgattactgtctgattgatgaacaaggggatcggataaatgatccgattgcttatcgggacaagcgtaccaatggagcagtagaacagttttctgaaatctattctctagataagttgtatgagcagacagggattcagatccagcctttcaataccttgttccaattgtttgctgaagaaaaagaaaatttggcaaaagcacataaattgttactgatacctgattatttagggtatgtctttactggtaacatggtgacggagaaaactaatgcatctactatgcagctgctgaatgcagggacaaaagaatgggaaatagaacttcttgaaaaaatcggtgtctcgaaggaattatttccaccattgacagagccgggaacgatactaggagatctgcaaaaagaacaattttcaaaatatgatttgccagatgtgacctttatcacagtagcaagtcatgatacggcgtcagctgtattaggaacgccaggtcaaggagaacgttggggttatatcagcagtgggacatggtcgcttttagggattgaaacaaagatcgccaatgtttctcgcaatgctttttctgaaaattatacgaatgaatggggtgcccataacacggtgcgttttttgaaaaacatcatggggatgtggttgatccaggaagttgcccgaatgcaagagtacgagtacagttatgcggaattggcagagcttgctgcaaaagaaaaaccgctgcagcaagtgatggaaatcaatgaccctcgatttttgaatcccccaaatatgatagaagagattcagcaatactgttttgaaacagagcagccagtccctgtctcatcgggagctatcgctcgttgtgtgtatgataatcttgctctttgttacgcacaagagctgatcaaagtagaacacttaactggaacgaaattggaaaagctgcacatcgtagggggcggatcgaataatcgtctactgaatcaattgacagcagattatgccggaatcattgtagaagcaggacctagtgaagccacagcaatcgggaatgttgccatgcaaatgctcagtacaggtcagttttcgaatatagaacaagcaagaaatgtaatcaaacagtcgtttccatgtgaaactttttacccagatgaaaataagcaaaacacgatggaatggtacgtgaataaaatcaaaggagtaatcgtatgaacacgattgaaagaaattacgaacaagcaaaagaaaaatatgcaactatcggtgtagatacagatgctgtactagaaaagatacaggacatcaaaatttctatgcattgctggcaaggagatgatgtcaaaggtttcttgacaccggatggcgaattgaccggtggaatcatggcgacagggaattttccaggagccgcacgaacacctgaagagcttagacaagatctggagaaggcttattcgttgataccgggcaaacacaaattgaaccttcatgctatctatttggatacagaagaatctgtcgatctaaatgaaattgagccgaaacattttgaaaaatgggtagagtgggcaaaaaaagaagaaatcggtcttgacttcaatccgactttcttttcgcatccaatgatgaaagacggctttacattggctcatccagataaagaagttcgtgaatactggatcgaacacgggaaaagaagccgcaaaatcgcggagtactttgggaaagaaactgggcaaacaagtatcaataacttttgggtacctgatgggatgaaagataatccgattgatcgttttaccccacgggaacgtttaatggaatcactcgatgaaatttttacagaagagttagatgaacggtatgtacaagatgcagtagaaagcaaactatttggtttaggcgctgaagcttatacagtcggttcccatgaattttatatgggttacgggttgactcgtgacaaacttgtttgtctagatgctggacattttcatccaacagaagtgatttccaataaattatcttcattagctttattcagcaaaggaatcatgttgcatgtttcccgtccagtgcgttgggattcagaccatgtggttttgatggatgatgaattgcaggaaatcgctaaagaattagtccgtaacgaattgttggaaaaaacaaatatcggtctggatttctttgatgcaacgatcaaccgtatcgctgcttgggtcatcggtacgagaaatacacaaaaagcactgctgaaagctatgctggaaccagttgagcgattgaaagaaatggagctggcttttgactttacttcaagaatggcttatacggaagaattgaaagatttcccgtatgccgatgtatggaattatttctgttacaaaaatcaagttccagttggtttggattggctggaagaagtccaggaatatcaaaaagacgtgttggaattaagaaaataggagtgtggctatattgaaaaaaatagatattttacaagcgccttatgtgaaagaaatgatcgaaacgacgtcgaatctttatcgcttgggatgggatgaaagaaatggcgggaatatttcttatttactaaaagaagaagagatcacaccgttcttggatcctgaaaaagtgatccgccgcatctcgatgatttttgatgccagccgtttagcaggatgctattttattgtaactggttcaggaagatattttaaaaatgtagcgagcgaacctgccgagaatcttggaatcgttcgagttgctgaagatggcaaaacactggaacttttgtgggggctggaaaacgaatgccttcctacaagcgagttgccaagtcatttcatgagtcatatcgcccgtttagaagtagacccagataatcggatcgttatgcattgccatgctagtcatctattagcgatgagttttacgcatgaattagacgaacgttcctttagtcgtacgctatggcaaatgtgtacggaatgcttagttgtttttccagaaggaatttccatcattccgtggatggttccgggaacaaatgagattggggaagcaacagctgaaaaaatgaaagaaactcgattggttttatggccacaacatggaatctacgggtcaggaaaagacatggatgaagtctttggtttgatcgagacagcagaaaaggcagcagaagtctatacgtacgtcaaagcgcaaggaccaatcttgcaaacaatcacggacgaaaacctgtggcatttagcagatgcgtttggtgtcactccaaaagcaggttatttggaggaagttcatacgaaagcaggtgtctgacatggtgaaaaaagctttttgcatgaaagtttacccagaaaaacaagaagaatacaaaaaaagacatgatgaactttggccagaaatgcgtacagcacttcgtgaacacggggtcatcgactattcgatctatcttgatccgagtacaagtttgttatttggttacttagtgatcgaagatgaaaagttatgggaaaaaatggcaaatacatctatcaatcaaaaatggtggaagtacatggaagatatcatggagacaaatccagatgcctctccagtcagttgggaattgatgccagtctttgaactgtagcaacaagcaactgggcaaccggttgcttggggttctttcgtttttattgtgaaaaataatacaaattaggaggaatagaaaatgagtaatcgaatgattttaaatgaaacatcgtattttggaaaaggagcgattgagtcgatcgtccctgaatttcagcagcgaggattcggcaaagcagctgtcattactgacaaaggattgatcgagcacggtatagcaacaaaagtaacagaacttctagataaagcagcaatcgcttatgctttatacgacgggatcgtacctaatccaacgatccaaaatgtaaaagatggagtggcttttgttaaagaggcagaggcagactgtttgatcgcaatcggtggaggttcgccaatcgatacggcaaaagccattgggattattttgacgaatccagagttttcagacgtcattagtttagaaggtgttgctgatacgaaaaatccatgtttacctatattagctataccaacgacttctggaacagcagcagaagtaacgatcaactacgtcatcacagatgaagtaaatcaccgaaaatttgtttgtgttgatcctcatgatatcccaatcgtcgcgttcatcgacagcgatatgatgatgggaatgccgaaaaaattggctgcatcaacaggtatggatgctatgacgcatgctattgaagggtttatcacaaaaggcgcttgggaaatgactgatatgctgcatttaaaagcaatcgaaatcatcggccattctttggaagtttctgtagatggcgatcaaaatgggcgagaaaaaatggcattaggacagtatattgcgggaatgggcttctcaaatgtcggtttaggactggtacacgggatggctcacccgttaagtgcatggtacaacattcctcatggcgtagcgtgtgcagcacttttgccaactgtcatgaaatataacaaagaatatactggagaaaagtaccgtgagatcgctcttgttctagggattaaaggagcagctgaaatgtctttagaagatgtaagagaagcggcttgtggtgagatcgatcggttgagcaaagcggttggaatcccagaaaccatttctgaattaggtgtaaaagaagcagatattccagcaattgcagaagatgctttgcgagatgtatgcacaccaggaaatccaagagaaacgacagtagaagaaatcattgctttatatcaaagtttgatgtaaaaacgaagcggatcttcaacattaaattgcctgtaaagagaaatggtagtttatatctggatatctcttttaaattgatggtatttccgctataatttttcttataaagaaataggagaatattatatggaaaataaaaagccttatggaactgtattgatcaaagcctctaaaatactagactatttagcggaaaaccaagatgtctctttgcagacgatcgcaaagggtgtgggaatgacctcttctacagtcttgaaaatactagatactttgttgatgatcggctacgtaaataaaaattcagagaaaaactatcgtttaggtgcaaagcttattcgctacgcgaataaaaacattgaacaaatcgatttggtagagttgactttaccgtttttagaacagctgcagcaaaagatcgatgagactatccacttaggggtattggacaacaatgagatcttgtacgtgaacaaactagatccaaaacatcaaacgatccgcatgtcttcaaaaatcggaatcacccgaccattatacaattctgcgatgggcaaagccgtattagcagaattcagtgaagagcagtacactgattatcttgaaaagcatccgttgatcccttacacagaatatacgatcaccaatgcattacggttgaaaaaggaaatccaaacggtaaaagaaacccacatcgcatttgacgatgaagaaatcgaacgtgatattttttgtataggagcctcaatcgtgaaaaacgaacaaatcattggtgcatttagtgtaagtatgccgaaatatcgtttaacagatgagacaaaagaacaaataatcagtgccctcaagcaaacaaaaagcgaaatcgagcaaagaattcaaaaataatgaaaaaagcgtttgcaatttttcttttctgccgtataatatgggtatagatttccaagttataaaataaaatttctaaataggaaataggtggagaagatgaaaaaaattgatattttatctcgattgaaaaacgccggagtgattgcggtggtacgcggaaaaagcaaagaagaagctttgaatgcttgccacgcaatcatcaaaggtggtctaactggtattgagttgacttttacagtccctcaagcagatcaagtaatcaaagaacttttgtcattctacaaagaccaaccagaaatagtgattggcgcaggcacagtattagacgctgtcacagctcgcttggctatcttagctggcgcagagtatattgttagcccttcctttgatcaagaaacggcagagatgtgcaatctgtatcaaattccttacttaccaggatgtatgactattaccgagatcaaaacagcgctgaaaagcggggtagatatcgtcaaactatttcctggaagcgcttatggaccaagtatcatttctgccttcaaggcgccgatgcctcaagtcaatatcatgccaactggcggtgtgagtctggacaatatgaaagagtggttcgatgctggtgtcgtaacagtcggagtaggtgggaaccttttagcacccgcagctacaggagattttgacaaagtaacggaagtcgcgcaacagtatgcagcaaaaatgaaagaaatcaagaggtagctgcttatgggaaaagtagtgacactcggagaaatcatgttgcgattgtccacagagcagggaacccgtatcgattcaagtgaacgattcgctgcccattatggcggaggggaagcaaacgtagcaatttctttagctaattacggacatgaagcgatttttgctacaaaagtacctgataacgcattgggaaaagcagtcaaaaagcacttgcaatgttatggagtagatacgaaacaggtattatctggtggatcaagactaggtacttattatatggaaactggtagtggcgaacgcgccgcctcagtgatctatgatcgtgccggatcaagttttgctgaaatggatcatttggaatggtcgctagaggagttattccaaggaatagatatatttcatgtttcaggaatcaccccagctttgtctaaaaaatggcaaaaaatgacgaaacaggtgatagaagctgcaaaaaaagctggctgcctgatcagcttcgatatcaactatcgtggaaaattatggacacagcaagaagccagcgaagtaatccatcagcttttacctttagtagatatctgctcagctggaaaaatggatgctctttatttgttaggtatcgagaaagcgccagaagcagaagaacaacctctaatttattattatcaaaaaatgcaggaaaagttcccgaatattcaggtgttttattcgaccaagcgtaccgttcattcagcaagtgaaaatgaattgaaggggacattgtggatgaaccatgaatatgtggaatcccaagtccatagaatcaccccaatcgtggatcgagtaggtggcggagatgcttttgcaggtggcgtgctccatgggattttatccaatatgtctccgcaagaaatcattgattttgctacggcagcttctgccttgaagcatacgatccatggggactgcaaccaatttagtcaagaagaagtcgcacaatttttagcatgcggctctggaaaaatcattcgatagaaggagtagaagaaaatgcaagaaatggaaacacgttatacacacagtccagaagatatccgtcattattcaacggaacaattgagaaaagaatttttagtagaaaaggtatttgaaccagggaaaatcagtttgacttatacgcacaacgatcgaatgatctttggtggagtgacacctactgaaaaagaattagaaatcacattagacaaagaactaggtgttgattacttcttagagcgtcgtgaactaggtgtgatcaatatcggtggaccaggattcatcgagatcgatgggcaaaaagaagaaatgaaaaaacaagacggatactatatcggaaaagaaacacgacatgttgtattttcttctcaagatgctgaaaacccagctaaattctatattagttctgttccagctcatcataaatatccaaatgtaaaaatcagtatcgaccaagtaaaaccaatggagactggtgaaggcctgacactgaatgaacgtaaaatctaccaatacatccatccaaatgtatgcgaaagctgtcaattacaaatgggttatacgattttagaaccaggaagcgcttggaatacgatgccttgtcatacacatgaacgtcgtatggaagcttatgtctactttgattatgccaatgaagatacacgtgtgttccacatgatgggcaaaccagatgaaacaaaacatttagttgtagacaatgaacaagccattatttcgccaagctggtcgatccattcaggtgtaggtacaagcaattactcattcatctgggcaatgtgcggagaaaatatcacctatacagacatggatatggtgcaaatggatcaattaaaataagcataagggagagaaaatgatggaatttagtatggatatgtttcgtttagatggaaaagtagcattagtcaccggtgctgtctatggtattggatttgagattgcacgctctttagctacagcaggagcaaaaatcgtatttaataacttgaatcaagaatcagttgatgaaggtatagcgcattataaagaagcaggcatcgatgcaaaaggttatgtctgcgatgtgaccgatgaagaagcggttcaagcgatggttcaacagatcaaagaagatgtaggttcagttgatattctagtcaacaatgcagggatcatcaaacggacaccgatgatcgaaatggatgcggcagacttccgccaagtaatcgacgtggatttaaatgccccattcatcgtttcaaaagcagttattccggatatgatcgaaaaaggcggcggtaaaatcatcaatatctgctccatgatgagtgaattaggacgcgaaacggtcagtgcttatgctgcggcaaaaggcggattaaaaatgctgacgaaaaacatcgcttctgaatacggtcaatacaatatccaatgtaatggaattggaccaggttatattgctacaccgcaaactgctccattacgcgaaacacaagaaaacggtgaacgtcatccattcgatcaatttatcgttggacgtacgccagcagcacgctggggcgagccaatcgatttggctggaccatctgtcttcttggcttctagcgcatctgatttcgttaacggccatgtcttgtatgtggacggaggcatacttgcctatatcggaaaacaaccttaaaagagctttagtacactgtttagtggagaggttgtgaaatcagcggattgaacgaataccgaaggacagctgattaaacatcatttattcgaaaaaagaggctgggacagaagcatttaactccaagaaataagaaggaattcacgaaaattgcttttcaaatttttgtgaatttcagcttatttccgaaggagttgcttttacttccgccgtttgtacgtgtttagagcgtgagacaaaagtgttctttacttttgtcccacgctcttttctgtgcgtcttccatacttcactaagtcgatccctcttgcttcgcaccaatccttcactggtccggaaaagatcagagattgttggtgtagggccgcggtattcgttgcgccgaccatagtataaagcagacgaagctcttcttgccattgcttcatcagtataatagtttcttctacgccgtgattcatcagatgcgtcagtacggttcctgaagtacccacggcatttgcgccgagacaaagggctttaaatatgtcataggcattgcggatacctccggaggctaggatttccatagaagtgtctgcttcatttgcttcaagcaatgaagagactgtcgattgcccccagtcagctaaataactcagttcccgcttggagcgacgggcgttttcgatctgggtgaagcttgttccgcttcgaccgctgatatcaactgtatgaactcctaaagcagctagatcattgagcgtttctcttgtcatgccaaaaccgacttcttttacgatgagggggacgtcaatggctgtttgagtttcttgaataagtactttccaattggtaaaatcacggtctccctcaggcataaccaactcttgaggtgcattcaaatgaatctgtaaggcatctgcgtgaaacaatcggatagcttctttggctctttcgacagaagtccctgcaccgatgttggcaatgattttcccgtgaggatattcttgtcgcataatcgtataagtatcggctaaagaagggactttcaaggcagcgctgactgaaccagtggcaatcatcaaatctgcttctcttgcgacgattgcaagatcttggttgattttttttgttttttcgcttccgccagtcatcgcattgatataaaatgggctgcttagtgtaaacccaactgcctgtgtacttagatcgacatcagaaactgctatttgcggcaaagggttatggatgatccgtacgaagtcaaattcgtttttttgtttatcatgaaaggctttagctagtgaaacatgttcgtcttttcgattcatcggttttcctttctttgatcgctatagacatgtaacggcagtggagtgatttctgctttttcccatgcactcattaaaggaagaatgccagatttctggtcaacaattacgattccgcaatcgcccccacctgcaccagaagattttgcggctccttcatactgttcagctaaattacacaatttgttcaaagcaggcgtttcgatgacgaccccagtgattgcagataaatcatgcagtaattgtcggttttttcgaatcatctgttggatcaacgttacattattttctttaaaccctttgatcatttcgttgacacattctgtactattttttaagaaaagctgataagccaccattttatcttctctcgaacggtgaacttgatcgaccaaatcagaagtagaggcagggctacccgtccaaccaatcaataaacgtaaatcttcaggagcaatcaatggctcaatggatagacctggccaatccagggcaagtaactcactgatagaatgctgagtttcttgttcttggagccaaggatggtcgaaggttgagaaagcgatccagccaccataacagctagcagcgatgtcgccgcaggaaccattatcttgaactgctaaattggctagtgctgcaatcttgaaaatctccaactgagataaattcaacgcgtaaaaaacattcaaggctttgaccgttgcaacggtcacggcaccgctagaacccaatccatatttccggccatttgaactgtctaactcacttgttactttcagatcataaaaggataaaagaatgtttttttcttgtgcatacttttcagtcaagcgaatagcagcaaggatataatgaaaaggattttcccgaatatctaaaactaattctccgttgcgtcttgtccaacgtacaggcatcccactatattgtgcagattggatacttccgacttttcgtgcagattctacagtgactgtcacgaattgatcgactgcagcgataactgctggatggcctgtttcaacaactgcatattctccggcaatatagagtttgcctggtgcagatacttcaatcataaaaatctccctttattcaataatcgcaattcctggaccagcatgtgcagtaattacttgttctttgctaaataatttggtaaatgtttcttgtacctcagataaatggctgttttccactaaaactttgacattagggccagcatccatcgtaaagtagcatggaatgccttgctttctcaattgtcgcaccgcatccatcgcttttaagctgtcaggagaccagtaagtgaatggaggctgggcagctaaagtcgttccatgcatttttagtccgtttctttccatcgtttctccgagaagttggaaatcttttgttttgattgcttgtttcaattgatatagatccccttcaacggaatctaaccagccttgataaaaactggatgtttcgactgtccgacgcatcccatttctgctggacacttcttttttctggtcgttgatcaaaacgaaaaccattgctaaatcgtcttcgaaagaatcggaagggactggcttagcgtaagaacttaagtcgtcatggcctttttcccattcgacgaaaccaccgaaaatacttcggcaagctgaaccagacccgcgtcgagcaaatcttgaaagagagagatcatctaatccaagcttaagagcagtattgcaagcgcctgctaaagcagctagcccgctggcagaggaggctaatccagctgcggtaggaacgaaattctgactgattactgaagcttttagtgagaggccggcttctttacgaaaaaggtcaagaaactgactgactttttttgttgctttttcgtcttgcaaggtgccatctagataaaattcatctaccatatagctatcagaaaagatgacttctgtctctgtataaaatgcatccaatgttaacgaaaggctgttgttcattggaaggatgagttcttcatttttcttaccccaatatttgattagagcaatgttggtatatgcgcgtgctttgcctttaaacataggtatgtactcctaatccttgtatccaagtttcagcagcacccgcatcttcaagtgcttgactgatttcttgggcttttgtttttgtttgtgctaatgcaatcatacagccaccgcgtccaccgccagttaatttggcacccaatgccccggtatcttttgctgtttggatcaatagattaagaaaatcattgctgattgtcagcttttccagaagtgattgtgattcatccattgtctgtgccaacgtttctggtgaattttcaatgattgcttgttttgcttgcttcgtcaagtatcctaatttttggatcatttgtccagtttcatgaggctgggtttcaaagaggtgagcgacatctttgacggcttctcttgtttgtcctttgattcctgtatcagcgacaatcaaaaaagcatcgatgttcaaagaaaagtagtcgaaaggatgcccttttgtaaaataaatcggctgcaagctgctagtagcggctgcatcgattccactaggattaccgtgggcgattttttccgaaagctggacattttctaatagtatttcacgagacaaaggaaatgctaagtaatcataaaaagcacgagtgactgctgtggcgactgcagcgcttgatcccattccacgttcagcaggaatcgtgctttcaatggtcagttgcaagtttttttggatgtcatgctgtttttttaagtgaatgaataattttttgatattttttaatgcatgaggagcttcggctaaatttcctgaatagtaggaagaaaccagttgatcgtccattgcatccagctcttcaaggaatgcggtgacttttgttgcatagaaaggaaaggcaatcgctggttctccataaacaaccgcgtgctcgcccatcaatatgatctttccgcttgattctccttggccatagtttgccataatctaactccttctcacgtaaaagtgatttttaagcaaaaaataaagcgcccaaaacgagttgcgctgcttcacgaatttttttgtccactaagggtctcaaaaaacattcctcctttattttactaaaaccatctcagaagtaaaactaagaatacgttttctaaagaaaaaacacttttttcttaagaattttttgactttttttcttctttgactagaaaaaaatacaattgacactactagatattgggggtatatttaaaaaggttggagttaaacacaatatttagtgatgaagtgagctggaggtaaatgagcgtgatcgttttagcaggtacaattggtgccggaaaatcaagtttaacagaaatgatggctgaacactttgatagtcaggcattttatgaatcgattgatgataatgaagtcttgcccttattttatgcaaaccctgaacagtatgcttttttgctgcaaatttattttttgaataaacgttttgcaagcatcaaacaagcaatgaaagatgacaataatgtattggaccgttcgatttatgaagattcactgcttttccatctaaatgcagatctaggaagagcaacagaaacagaagttcgtgtgtatgatgaactgctggaaaacatgatggaagaacttccctatgctgcccataaaaaacatccggatttattagttcatattcgtgtatcttttgatacgatgttggagcgtatcgaaaaacgtggtcgttcgtatgaacaattgtcctttgatccaagtctatacgattattacaaagaattgaacagacgttacgatcaatggtatgaagaatacaaagaaagtccaaaaatccaaatcgatggagaccgctataattttgtggaagatcctcaagcaaaagaagaagtcttgaaaatgatcgaagaaaaattagcagagattcgccaaaccaaagtagccatttgatttacagttgctcaaataaagggtaaacctttatttgagcgacttttttctttatactggaaacaaatgtcaggaggatagagtatgcgggaaaaacactattttaatcaagaccgtaatttttggatcaatgtacagcaaaacgatgtgctagctgttaaaaacttaaaagaagaatatggcattagtgacgagatgctgacttattctctagataaaaatgaacgggcgcgcgtagagtacgattcttttgatgaagcgttactgcttgtatcaaatgttccgcaccagcaaaaagtcgataatcattatgaaactagtcctatcgcttttattttaaaagaagacggtttgtttacatttaccacgccgaataccgagtacgtgattcgactaattcgatcgcttttggaacgaatgccagacatgagtgtatacagtttattgtttcgtacattgtttttgatttctgattccttttttcctttaatcgaggaagtgaatagtgaacgtcagcggcttaatctgaaattaagagaaaaaacaacgaacaagaatctgctgcaactttcagatttagagatcggtttggtttacttagttacaggaacaaaacaaaatgtagtacttttagaacaaatcaaggcattggctatttatcgcaagttgtcagaaaaggaaaaagaagagttggacgatgcgctgatcgaagcacgacaagcagttgaaatgacgaacttagcttcgcagattttagaccagctctctggcacttataataatttgctgaataacaacttgaatgacacgatgaaatttttgacggtctggtcgctgatcttgaccgttccaactattgtgacaggattcttcggaatgaatctccagttaccctttacccattccgttttcggatggggaatcgccttgatcatcagtttggtcttatctatttggatgcttattgcactgtggcggcggattcgttgatctagtctttgatctgcaaaccaagggcttgggcgatcacaagtgcttgctcttggttgacgattagtcccgccaaagaatcttgagataaagcgattgctgtgaagaaattagtcgtaaagtctaatcccttcagagaagttcgaaaccagttcgaaccggtcaactgattgtcagacaaaaaaaggtttttccaagtgacctcataaaattcgctgtcttctaattgacaatgatcgaaggagacagctttcaagtttgtactactaaaggaagccatcgaagcaatacaatcagtgaaagtacagtctcgaagataactttcggcaaaattcgtacctgttaatttacattgatgaaacacgacttggtggaaactgccaccaatccactccagattggaaaaatcacatttttcaaaaatgacattactgcattcaaaatgacgtaaaactgttttttgcatcgtaagtttttggatatgactctctcttaataccatatttttggcatcgagatagctttggtcacccccgttgatcagaagaccagagaagatctcctcatcttctaaataaaactctccctttgtaagaagaggaagagaaggtggaataggttcgatttttttcatgtgggttcacctcgtttttctttagtatagcaaagaagcgggaatcactgctagaaagtctgctaatctaatcattttcagaaaaggaagacaaactgtatgaaaaacattgacaaaaagattagtttttgctatactatgatggttgagaaataaaagcagaagcacccgcttctcgccttagttgataatgtcactgggctagatagttttcactggttctattaggtgaagtacgcgcgggttctgtaagagaactcgtttttttattgccgtttattcggtaagcttttctttctctcataatatttggaggtgaatgaccatagcaaaggatatgatggttaacgacggcattcgtgcacgagagttacgattgatcggttcagatggtgagcaattaggagttaagacaaaagcagaagcattgaatattgcagaacaagcaaacttggatcttgtgttagttgcccctggtgcgaaaccaccagttgcgcgaatcatggactacggtaaataccgtttcgaacaacaaaagaaagaccgcgaagcgcgtaaaaaacaaaaagtgatcaatgtaaaagaagttcgcttaagtcctacgatcgacttgaatgacttcaatacaaaacttcgtaatgcacgtaagttcttggaaaagggcgataaagtgaaagcttctatccgtttcaaaggccgtgccattacccataaagaaattggtcaaaaagtcttgaatcgcttagctgaagaaactgcggatattgcaacagtggaacaaaaagcgaaaatggacggacgcagcatgttcttgacgctggcaccgaaaaacgacagtaagtaatttgaatgactaactggctgttggacagccgatagtcggataacgaaagattttgaggaggaaatatagtcatgccaaaacaaaaaacacaccgcggatcagcaaaacgtttcaaacgtactggtaaaggcggattgaaacgcttccgcgcgtttacaagtcaccgtttccacggcaaaacaaaaaaacaacgccgtcaattgcgtaaagcaagcatggtttctagtggcgacttcaaacgtattcgccaacaactagcaaaaatgaaataagaagtacaaataacagaatctgaagatttatttttattaggaggaattatacatggcacgtgttaaaggtggaacagtaactcgtaaacgtcgtaaaagagtgctaaaattagcaaaaggttactacggttcaaaacacactttatttaaaacagcaaaagaacaagtaatgaattcatacaactacgcatatcgcgatcgtcgtcaaaagaaacgcgacttccgtaaattgtggattgctcgtatcaacgcagcagctcgtatgaatggcttgagctactcaaaattaatgcacggtttgaaagttgctgaaatcgacatcaaccgtaaaatgttagctgacttggctgttaacgatgcagcagcatttactgcattggctgaccaagcaaaagaagctttggctaaataagctaaacaattataaagaggaaagaagataacgaaaagttatgttctttcctctttttttatttacaatcctccatcaaatgaaacaggacaataacgtataagtctaaaatagcataattaaggttttttaattgaaaactgaacatttatggtcaccctttaatgaaagcgctaactacataagttagaatgagtttgactgatatattagtttgcttatcagaaaaacaaaatggacggaggaataacatgagtgatattattattggtattttgttagttatctcattctttttcatggtctggtactgtgtaaaaggctacaacttgatggtcggctttgccatcatggctactgtatggatgggattagcgctagtcggaaacacgttttcaccaaacccggcgatggaagggcaaggagtaattgatgtgttgacgcatatctatacgacggggccagctgagtacgccaaatcgatcttggtaaatgtcttctttggtgcctttttcgggcgtgttctagtagatagcggaatcgcagctaccctgattcgaaaggtagttgaacttggaggggacaagccaagaatcacgatgagcttactatgtattgtaaccgctgttatattcatgtcgatgacaggaatcggaccagtgatttctattgcagttattgtgttgccaatcttgatgtcattaggtatttcagtaccggttgcactgttctcatttatgggctcgattatggctggaatctttgctaatatcgtcaatttcaaacaatatcaaacgatttatgctggtttcaatccagcggctgaaagctatacttataatgactatttccaaattggtatgattgggatgattgtaagcttagttgtggtactaacggtcgctaatatatcaatgaacaaaaagaaacgctatgcaatggcagcaaacgtaccagctgaaggtggcgacgcaccaatgatctcatggttagccgtattattaccagttttaggggtcgttcttttagatcttccaatcatcttaggttttattctagcaggtatctgggcattgctgtttactggaaaattgcgcggaggttataaagaaatctgtcgtcagtttgcgaaattatttacagatggcgcagtagatgttgcaccaatggttggtttcttgatgaccttagcgatgttcaataattcagctgcgtatgcttctccttatttttcagctatttttggagattggataccgcaatcaccattagtcttggcaatcgtatttgctatattgacaccactaggatttttccgcggtccaatgaatctagtcggttcaggctcagctattttagctgtcgtattagctgttaatccaacgatgtcgccagcctttttgttcccgttatttgcaatcacaacgattgctcctcagcatttagatattacacaatcttgggttgcttggggattaggttatacaaaagtaacttctcgagaatatatgaagaaatccatcccaactggttggatcatcggagcgatcttatgcctgatcacgttcttattgtacgggaacgcctagtaaacaaaacgtcgataaaaacgattagatgaatggaggaaaagaaaatgaaacgttttgtgcgaatgggaattgatgttggcggtacacatacgaaagcagtcgcaatcgataatgcgacgcacgaaatcatcggaaaatcttcagtgaaaacaacccacgatgatgtccgtggagtagccgcaggtgtcgttcagtcttttcaaaattgtttgcgggaaaataatatcagtccagaagatgttgtgtttgttgcacattctaccacacaagcgactaatgcactgattgaaggagacgtagcaaaagtcggcgtaatcgggatggcaaaaggtggattagaaggttttttagcaaaacgacaaactagattgaacgatatcgatttagggaataagaaaaaaatagagattgtcaatgcattcttacctgtcaaacacttaaatgtagaccgtgtttcagaaacgatttcttctttagaaagagaaagagcggaggtcttggtttcttctatggcatttggagtagataatggggaaccagaacgagttgtttatgaagcagcatcggtaaaatcgatccctacaacgatggcttctgacatcacaaaattatatggattgacaagaagaactcggacagcagcaatcaatgcatctattttaccaaaaatgctagatacggcaacctctacagaagattccgtacgagaagcaggggtcaatgtttctttgatgattatgcgcggagacggcggagtaatggaaatcaatgaaatgaaaaaacgacctgttttaaccatgctttccggtccagcagcatcagtcatgggctctttgatgtacttgagagcgtctaatggtgtttattttgaagtaggcggaacaacaaccaatatcggggtcattaaaaatggacgtccagcaatcgattattcaattgtaggtggccacccaacatatatctcttcattagatgttcgggttctaggtgtggcaggcggttcgatggtacgggctaatcagtcaggaatcatcgatgtcggtccacgttctgcacatattgccggtctagattatgcagtatttacggagacagaaaaaatcaaaggtcctaaggttgaatttttctctcctaaagaaggagaccctgctgattacgtcaaggtagtgatggaagacggagaagaagtgactattacaaatacatgtgcagccaatgtccttggattagtgcaagaagaacatttttcttatggaaatgtcccatctgcacgaaaagccatccaagcattagctgattattgtcatacgacggttgaagacatcgcagaacagatcatggaaaaatcctatgctaagattgaaccggtgattttagaattggcagacaagtatcacttggagaaagatcagatttctcttgtaggtgtagggggcggcgctgcctcattgattacttactttagtaataaaatgggtgtgaaatattcgattcctgaaaacgccgaagtgatttcttctattggtgtagcacttgcaatggtccgagatgttgtagaacgtatcatcccttcgccaagtaaagaagatatacgatcgttgaaaaatgaagcgatgaataaagcgattgaatcaggcgctacaccagaatcgatcgaagtccacgtagaaatcgatccacagacttcaaaagtaacggctatcgctactggttctacggaagtgaaagcaaccgatctaaccaaggagatcacaacagaagaagcactagagcttgctgcagaggatatgcgattaaataaaaatgaagtttgcttattggaaaatacacctttcttttatgtatgcggcgaacagaatcgttcaaaaaatgctggaagtcttcggatcatcgatcaaaaaggatttatcaaggtccaacgtggacatgcttcatgtatgaaaacaactgcagccaattatatgacagctgtcgaacaactttgggaagatatggcagtttatcaaactgaattgattgcccgaccagaattttatctctgcttaggagcaagagtctctgattttacagcgacggatctggaacaactacagcttttgatggatctggaagtatctactatggaaccggaggaagaagtgatcgtcgttgccggaaatatcaaacaaacataagttagaagagttactaaacgaattacaacagatccccgaagaaatttggggattctaccagtttcggcgagatttattttggaaaaagattcctttgtccaagcagaaaattcttatacaacaatcaatcgattgtggtatcgaaacggcatgtagcatcaaaaaaaagtacccttttgccgatgtaggagaaatttgtgaacaaatggctgttccaatcgtttcctgtgaatcagagcaaataaacgaacgaatcacttttgcaacttatgcagaagatgaagggattcgattgatgacggagccgttagaaaaattaaaatgttcaggactagcttcgatctctaaagaaacagcgcaagctttgattattggacatgaactatttcaccacatcgaagcttctgttaagggaatttatacgcaaagcgaaaaaattgtgctgtggcggttgcctttttatacacatcaatcaaacattcgtgcattgagcgagatagcagcgatgagtttttcaaaagagatgaatcaaagcgatttttcgccttatgtattagaggcagtcttactttggccatataatgaaattcgtagccaagggatcttagaagaaataaaaaaaatagaaaaaagatgtacggagtatgatttagattacaaataaagagactgtgacaaaagtcgtgtcacagtcctttttttccgaataaacgatgttctcctgtcaactcctcggtcacaagtcaaaatattcaacaaacatgagaagctgttttttgaaattgttccttgtgactcggagatgaacggcaggctcacgacctcttggaaaacggtgttcaaaagcttgcatctgcggtaataagtccagccaagttaaaaacataagaagctatttttacttggctgttcttattacttgatgcagggcagctttttcacaacctctcaataaacggtgtgcaatcagctgaccctcggtattagctcaaaaaaaacggcaaaatatgaggaactattttgccgtttctttctctaatactcaggtcaaaacgctgattccaaaacctcttatttgatgggtctgtcctgaatatcttcaaaataatcggggtaattatgaatcacgtattcttgctcctcgataatcatatgtaaatgcatcgtgcaaagaaatccgacttcatcaaagttatgatcaatcattgattgaagcattgtctgatgttcatctaatactcgaccccagtctaattctgaaatcgtcaaacgtaaccatctgaaacggttcaagtgcgtactataactttctagccaatcccaaatttctcgttttccagcaatttcataacaagttcggtgaaaatcagtatccaaatcaaaaaaagcttttttattttgagcgattactgcctgatcggtttgttctagtattttttctagtttagcttgatcttgcttggtcattttcgcactgcattcttgcaggatcggtttttccaacttttcccgcgtataacgggctaatgaagcagatcggatatcgatttttgaaacataagtgccggactgtggaatggtttttacaagctcttgattgcgcagttggatcagtgcttctcgaatcggtgtacgcccgatagctagttgttcttctaacactttatcggagattttacttccaggtgctaactcggaataaatgatttgtttacgtatagattcataagcttgctgttgcaaattattgataaccatttaaccttcctttctatgcagatataatctattataacataaatcgcttacaaatcgtgtgggcataaaaacacagtctgcaaaaaaagccctgataggcatgcctattagagcctcgaaaagaaaaatattgaatcaatctggtcgtacctcttgtatcggtttgacacgaccgccgattcttttagcaaaagcttcggattcttttttgtctttgaaaatgagcagattgtctaagtttttttcccgagtgcgacagccagttttatcgatgtaaccgtgcattactttaacgacatacatggggatcacctgcttttttcttttcattatacgaactactcgacacaatacaagaaaaatgcttagacggtctttattaagaatttacatcatccaaagaagcgtacgcttggaataactgatctaactccggattgactttgctcagcttcactaatcgttgcgaatcagaaagtaaaaaacagtgtttactactgccagtagtttttaattttttgtcttcagttcccacaatttcgtagctaaaatccaaccgtgtccccgtatacttttggatagttggatggatgctcactttttctccgtaatggatcatttctttatagctgcaatttacttccagaacggggatgatgatcccagattcttcgatttttttatagggaaaccctagatgtaccaataaggctacccgagcctcttcaaaccagcggatataattgctgtgatgaataatccccatttgatctgtttcataataaaaaggttctcgcacataacctgtaaatttctccatgactcatgcctcgttttccattgattttttacaaaaataattcatccatttcggaagtgcttcgctgatttgtgtcggcaaaacaatatattgttcttttgccagctggtctccaatgaaactatgaagataaatagctgctgcaatcgtttggtcattttgaggaaactgggctaaaaatcctgtgatcatcccagctaaagtgtcacccatgccgcccgttgccatagcagcagaacctaaaggattggtgtagaagtgctggtgaccataaatttttgtctcatgacttttcaaaacgagcacagcaccgatttcctgttgcttctttttgttttctttatcccgttgttcttgtatcggtagagaactcaaccgttgccactccatttgatgaggtgtaagtacagtttgttcgggatagggtagcaaaagatgattagcagcaagtaaacttaaagcagagccatcaatcaccagccattgttcttttgattggttttctagtacttgtttgaaacgttccaaactcttagaagaagtacccaatccgggaccaatcaagagtacatctgcttgctttattacggaaagaaactggtcagtatccgtccaaactacaatcattgcttctggcagatgactgtgaagagcactccgatttttttcatcagttactacagtcgtgagacccgctccgctgtgtacggcagctaaagcactcataatgattgctccgccatattgttcattgccgccaatcaaaacgatacgtccaaatgttcctttatgtgaaatttttggacgaggtgtgatgactcttttcactagttgttcgtttatcagcatctaaaaacctccttttactcattatagcgtatattttttttagagaaaaacagataagaaaaggaattgtcagattttttgaactatttttttctgtaatttgtggtatcatgaacacgaagacttaaataagtggaggattaactttatgacaattgattggcaaaaagaagtagaagcacgtaaagaagacttgcttgaagacttgaaaaatcttttacgtgtcaacagcgagcgcgatgactcaaaagtaacaccagatgcaccatttggacctggacctcgcgacgcattgaaacatatgttagcttatggcgaacgtgatggatttaaagtaaaaaatgtcgataactatgcagggcatattgatcttggcgaaggagacgaaacgctagggatatttggacacatggatgtcgttcctgcaggagatggctgggacacagatccttatgaaccagtaatcaaggatggaaagatctttgcacgcggatcaagcgatgacaaaggtccaagtatggcagcttactatgcgatgaagatcattaaagaacttgacttgaaactatcaaaaaaagttcgcttcgtagtcggcagcgatgaagaaagcggctggggcgatatggcttattatttcgaacatgaagaagaaccagattttggtttctcaccagatgctgaattcccaatcatcaatggtgaaaaaggaaatgtttctttagctttacgcttcaaaggcgacaatgcaggagattatgtcttgaaatcttttgtttccggacttcgcgaaaatatggtgccaggaacagcaactgcagcacttcaagtaccaagtgcagatgcagctatcgcgatggaagaagcattttaccaattcatcgaagcaaatccagtaagcggaacgattgaagcggacaatacgtatgtaaaaatcgaattagttggtaaaggcgcacatggtgcaagcccacaatctggtatcaatgcaggttctttcttggcattgttcttagataactatgaattcctaggatctgctaaacaatttatccatgtagcagctgcttatgtccatgaagatttttatggagaaaaactaggagtcgcttatgaagatgaaaaaatgggcaaattgacaatgaatgctggactatttgcttttgaagaaaatggtacagaggaagcgaacttcatcaatatgaatttccgttttccaaaaggtgtaacagtagacggattgcaaagtgacatcgaacaaacagtggggcaagaaggcgcaacagttactcgaggtgctcgcgtaatggaaccacattacgtaccaatggatgatccattggtggctacattattgcaagtctatgaagaccacactggagaaaaaggctacgaacaaatcatcggtggcggaacttacggacgtttgttgaaacgtggcgttgcttatggagcgatgttcccaggatatactgatacaatgcatcaagcaaacgaatttatgagtcttgatgacttgttcagagcaacagcaatctatgcagatgccatctatcgtttggcgaaataattaattaaaaagaggatcaagaattgcaaattatttttgcagtcttgatcctttttttactttctactgtggtattcatgataaacatgatatagattcaattcatattctttcttagcgttcgtgacgactgtatccaaaatcaaccctgttactaatgaaagaagtgctaaagtcatcaatccagtacttaaaatcgcagaagggatgcgtgtaataaagcttgtcagcatatattcgcgaatcacaggaatccccgtgaccaatccaaataaaaagaagaagatggtccaaatcccaaagaaaagcaaaggcttataatctttaaacattttaataatcatcatgatcactttgaatccgtcagagaatgtattcaattttgattcgctgccttcaggacgatcacgataatcgattgggatttcaacgaacttgaattttttatctaaagcatggatcgtcaattccgtttcgatttgaaaaccagaactcataataggaaaacttttgacaaagatacgattgaatcctcgatagccggtcatgacatcaagaatttttgttttatacattctagtaattgtatttctaacaaggttatttccaaaatcgtggaaaggtctcttattctcatcaaagtaggttccatttgataggcgatcaccaatgaccatatctgcttcaccagaacgtaatttctcgagcaaaccatgtacagcttctgcaggataagtatcatcgccatctaccattaaataatagtcggcatcgatatcaaagaacatttggcggatcacatttccttttccttgacgaggttctttttttacgattgctccaccttgaacggccaattcgtatgttcgatcggtcgaattattatcatagacataaatatctgcttctggtaattctcgtttaaagtctgcaatgactgttgaaattgttgcttcctcattgtaacaaggaatcagaacagcaattttttcttgttgttccatttttcactctccttaactatagaaaacaaaagctaaattaaaaatacctcataatcaaaggaaatgctagtttttcccgctaaatatcatttatttaaaaagaaaatactggaatatatgtttggaaagctctatctaaaaaaccacccactacaaaagaaggacatgatacctctcttttgaatagtgggtgcgtattcgttctctcacttttttgacgtattaatctgttgcacctttttttcttgaaatttctaatacggttcctgtatgagcatctgctaaaaattcataataaacagtttcgccatcttctattcgagaaagacctccccgataagcactcgaccgaacggcgaatttcctaataggttccttttcaaaagagatccaagaaccttcgattgcaccttcttttagaaaagatgacttgatattttcaagtacttggtctgctgacaatacttttttgcgatgataccaaatcgttgaagctaccccgctcaataatcctagaccgattccaactgctaacccgcctttaaaatagcttagttcgctttcttcatacatgtggacatacctccttcttctcacttgttactccttgtgcttattttaccacactctcatattttctttgaaataaataaccgctaccagaaaaaataagctataataaatacgatcggtctgcagaaaaaatcatattttatccgcagatcaatataagtctgagaggagtttagtctgaaatttagacgaatagcatatggaagaaaaaacatttcaacgaatcaaagagttaacagaattacaaggaacaagcggttttgaacaagatgttcgcgcttatatggaaagtcatatggaaccgctggtagatgagttacagttagatggtttgggcggcatttttggtctgcgccatcatgaagaagcggatgcaccccgtgtaatggtcgcagcacatatggatgaagtcggattcatgctgacacaaatccaagaaaacgggctttttaaagtcgtacctctaggcggctggaatccttacgttgtttctgctcagcgttttacacttaaaacctctactggtaagaattatccatgtatttcttcttccgttcccccacatttattgcgaggaacaagcggacaaaaatcagtagaagtaaccgatattttgttcgatgctgggtttgaatcaagagaagaggcaatgagttacggtgtccttccaggagacacaatcgttccttacgctgaaacgatcaaaacagccaacggaaagaatattatcagtaaatcatgggacaaccgctatggctgtacaatggtattagaagctttagaagcgttgcaaaatgaaacattaggtcatacattgattgcaggcgcgaatgtccaggaagaagtaggcttgcgtggttctaaagcttctgtcaataaattcaagccagatctgttctttgcagtagactgctctgcagcagatgatacagtgacgaaaaatggcacattcggacatttaggagaaggtacattgatgcgtatccaagatccaggtttgatcatgcttcctcgtttgcgcgagtacttgctggatatcgctgaaacaaacaatatcccttatcaatactttgtttcaaaaggcggtacagatgcaggtgctgctcatacacaaaacgaaggaatcccaagtacagtgattggcgtagtgggacgttatatccatacgcatcaaacgatgttcagtattcgcgattttgaagctgcacgagaaatgttgattcaaacactgaaaggtttggataaatcaacagtgaatacgatcgtatacggaaaataatgcgatagtgaaactataaaatctggcaaaagattgctttttgccagattttttttataaaaagaggatcaatgtttgttagttcgaaagaaaggtgtataatttaattgaaaaatacataaacagaaagtagaggacaaagaatgattatcccaaatagtttagaagaattagcaggctacgtagaaactggaaagagtgtatttttctttactgccggctggtgcggagactgccgttttatcaaaccgcaaatgcctgaaattgaaaatgacttttctgattggcaatttattgaagtagaccgtgacaagtacatagatgtagccgctgaatggaacatttttggtatcccaagttttgtcgtgatccaagacggaaaagaattaggtcgtctagtgaataaagatcgtaaaacaaaacaggaaatcgaatcgttcctagaaagtgtaacaaaaggctgacatctgttaggaggggtcaagatgaatcaagaatataagaatattttagtaggtatcgacggtagtgaacaagcacttgctgctttcaaaaaagcggtagaagtggctcgccgtaataatgggaaagtatatgtagcaaacgtaatcgatcagcaattttataactttatgggctatgcacctattgatcaaaatctagtcgatcagcaaactgaaacagccaaggaaatgatcgaagaatgtaaagaatatgggaaatctgttgattacacaaatatagaaggaattattgcatatggttctgttcgtgaatccatggcagtcaaattgccaaaaaaatatgagatcgatctaatcatggttgggcagtcaggtctaaatgcagtcgaacgctttatgacaggaagtgtagccagctacgtgatacgtcattcaccttgtgatgtcttgatcgtttctgacgaagaagaacagccaagtaattaagcaagtggaacttgtacgacctttttaatcaattaactaaaacagtaaagggactgtgacaaaagtcttgtcacagtcccttgttacgaataaatggtgttccagaagaggcttcttcggaaataaagcatgaaaaaaatttcatgcagtgaatgcaattttttgttaagataaatctcagcaaaggataatggaggaaagaacatgatttttgcttataacaaagcacacgtcggagacaccttgatggttattatagccgacgataaaggaacagaaaacactgttgaacgcaaatggaatgttgctcggatcaaagatgaacaaggtcaagttgttgcttggaactttttccatatctccgatcatctaacaatcgaagggaacggccaagtaagcttaacagatgaggaattagcgaaattgaatcgattgatcaaagaagcaggattcgaagaacagcttgaagctgatcatgaaccgaagatcgttgtcgggtacgtaaaaacatgcgtcccacatcctgattctgaccatttatcgattactgagacagaagtagacaatggtacagtattgcaaatcgtttgcggtgcacccaatatcgaagctggacaaaaagttgtcgttgcaaaaccaggagctatgatgccagatggaatgatgatctggccaggaactttgcgaggggtagatagctatggaatgatctgttccgctcgtgaattgcatttgccaaatgctccagcaaaaaaaggaatcttagtattgcctgaggatgccgtactcggagaagcatttccaaaataaagaggttgtgacaagtctttgtcacaacctcttttttattaattttcactattttgattttgttttaatgccgattgatcgatcgtcaattcaacagtagttgttttttctttcgagccttcatagtaagtgattttgacagaatctcccacttttttcttatacaaagcagattgaagttctacaccagaagaaacttctttgtcatcgatcttagtaatgacgtcgtatgtttcaatccagctttttcagccggtgtagctgtttggacatttgtcacgatgacaccgttagttacagatgaaggaatcttcaagatttgttcttgttgctgagtagaaacggcagataagtcgaccattgtgatacctagagctggacgtgtcacttttccgtctttttccagttgattgatgatattcactacatcgttacttggaatagcaaatcccattccttctacgcttacattagaagtagattcagaagtacttgcgatcttacttgagttgataccgataacttgtccttcgatattaactaaaggaccaccagaatttccagggttgattgctgcatctgtttggatcgcattgatattgactgtttcgttcgattcattcgtacttgtcacttgtcggttcaaggaagaaatgattcctgaagtgacagaatttgcatattcagatcctagtggggaaccaatcgcaatcgcaggctcaccaaccttcagagcacttgagtcaccaaaagaggcaactgtttcgactttgtctgaattgatcttcaacaccgctaaatctgaataagcatctgttccaactaattcagcttttaccttcgtaccgtctttcatcaagacttcaagaccttgctggccatctactacgtgattattcgtgactacataagcagtattcccgtcttttttgtagatcacgccgcttccttcactataagcttccaaattactatcatctgagctgctactttcttcttgctgcccgaatagtccgccaaaaccgcttgattggttttgactttgtaagttgataacagaaacgacagcgtcttgaactttatctaccgctttggtgatatcagaatctacattgactttgacattttccacaactgtttcaccggcagaattctgattgccgcttgtagcagtagaactattgttgccagtgcccatcgctgcataaaaaatgccagctgtcagtagtcctccaacgatccctccaacaagccccagacctaacttacgccagaggctattatttttactttttttcatctttggtgtcacattttttctatccatgtgttcctcctccaattacattcatttatctactgttagtatagtcttatttgttgactttagtctactttgagactgtgaactttttatgaaaaactttaggaaaaatcattgttttcagatgaaaatatttgattttctttttccacagatactgtgtaaaactacgcggataggattggaaaaataagggataaaacatatccacagcctgtgtataaagtggataaattcttataaaacgtatgtttgcctaatgaatgtgatgaaataaggtaaaataacactgttttctgtggataaacctgtggatgttgtgcataactgttggggaaatctttttaacaaaaatagccaaaataaacatatagacgaaaaaattgattataataaacaaagtgagcatgaagaccaaaggagagaaaacatgaatatcaaaattatctcagtaggaaaattaaaagaaaaatacctgatccaaggtatcaatgagtatgtcaaacggctgaatgcctatgcaaaaatcgaattgatcgaagttcctgacgaaaaagccccggagaatttaagcgaagcgcaaatgagacaagtaaaagaaaaagaaggggaacggatcttagcgaaaatcaaagaacaagaatacgtctatgccttagcaattgaagggaaaaatcctacaagtgaatcttttgctaaacaaatcgaccaattaggtatccaaggaaaaagccaccttgtttttgttatcggcggctctttaggactcagcgaagccgtcatgaaaagaagcaatgctcagatctcttttggaaaaatgacgtatccacatcaattgatgcgtctgatccttgtcgagcaaatctaccgtgccttccggatcaatgcgggggctccataccacaaataatgatattttttaagagaaaaaattatccctattttaaataatagcaataggtagtggtagggagaaatttataaataacttttttatttgctttggtagccaagtaagttgcaaaagaaaaatagatactgttaaaaagataatgtagacatagaaacaaatacgtaaaattttagttagaataatggcaaggagaaaaaatatgatagatgaaaaaaagtgtttaaaaaatctattggaggatatggatgatattgaagaaaggctatctaaatggactgggaaagcaaatatatttcagatacttaagctatctaaaaatgaaataagacatagtaattttttagcttttttgtttgctccaaatgaaatccacaatttatctgatgagttttttaaaatgtttttgaaaaggtatatagattctaatgatgataccaaagctgctatcaattattttgatgctttacttaatagctatgaagatttaattgtttacagagaaaataagaatattgatattttattggtatcggaaaaaaataaaatagtggtgtgcatcgaaaataaaattctgtcttcggagtctggagggcaacttaataaataccaaatatatatagaacgcaattattctaactataaaaaaatttttgtttttttaactccagatggaaatgaacccacaaatcctagttggggcataattacttacaagaatatcgttgaagagagtgtaaaatattttgtgtaaatagaaaaaaggaagtcccttctgtagaatagagttaccacaacacattcacagaaaagaggacttccatatgaacgattttactacagaaattatggaaatactaatcaataaaggtgatttggatgatttgtttcgtcgtcacctagaattggctattaacgctttattacaagctgaattaacggtatttcttgactatgaaaagtatgatagagctggatttaattcaggtaattcccgtaatgggaattattcgcgctcttttaaaacagagtacggtgaattgaatttagtaatacctagagataggaatggagacttttctcaacaaactttacctgcttataaaagaaccaatgactctttagaaaccactattattcagctagttcaaaaaggaattactatgtccgaaatctctgatctaatcgaaaaaatgtatggtcattattacaaaccacaaactatttcaaatatgagtaaaattgtgtctgaagatgtttcggcatttaaagaaagaactttagaagctaaatactcagtcatttttatggatgctactcatattcccttaaaaagacaaaccgtatcaaaagaagctgtctatatagtaattggtatcaggttggatggaactaaagaggttctaggatttactatagctccaactgaatctgcttatgtttggaaagagattcttcaagatctaaaagaccgtggtttagaagaggttttgttagtcgtaacagatggtttaagtggtattgacgatagtattcatagtgtttatccaaatgctcaatttcaacaatgttgtgtccatatatctagaaatatcgctcataaggttcgtgttagtgatcgacaagaaatctgtagcgatttcaaattagtttaccaagcaagttcaaaagaagaagcaaataatcaaataaggtttatgatagataaatggaaaaagcagtatccacgagtggttaaattgctcatgaatcctgctatattaaccttttataatttccctccgtcaatcagaagaactatttattcaactaatttgattgaaggttttaacaaacaattaaagaaatataccaaaagaaaagagcaatttcctaatgaagaatctctggagagatttctagtatctcaattcaacaactataatcaaaagtttctatgccgagttcataaaggttttaaagaaatacatgatacattagaatcaatgttttaacttgatcaacagaatgggcttttccatttacacataattattgacacaacctattctggaaacttacaaataaaagcttattcttcagccaccttcgggtggttattttttataaaaaaatgtaaaaaaatattgatacataaataaattagttgtagtaaatagttttagaattgaatttctctatcctttttaaataattttttagacaaaaaacagaaagtgtctaaagaaagcttgacgaagaaaataatttttaataacttatttaaggaaattttttgaaggagaagataaaagtgagaaaaaagattattattaatgctggagtaattataggattgatgttagtaattttctccggaaagcaatatgctgataatattttattatggggaggggaagataatattgaaaagatcaacaacaatttaactatattagacacagctctagaaaataaagagcaaaaaattagtattttaaattcacaattgtcttcaaacaaccaaactcttgaacaactaagaactaatattgaagtttccaaacaaaaagtggcatctttagaaaacgacaagaatcaattagtatcagagaaaactaatttagaaaatcaattgtcagcaaaagactctgaattgcaaggaaaacaaaatgaaattaatgcgaaaatagacgaaattaaccaaaaagtagctgaaataaatcgattaaatagcgattggaataatcgtttacaaaatgaaaagaacaaatttaatgaagaacaatctactattaatagtttaaaccagcaaattaatcaaatgttgagtgaaaaaaataacattcaaaatcaactgcaagctactcagcaaaagctagaagaagaaaagtcaaaaaatagtagtttgaataattacattgaaaagcttcaaaaagctaaaaatgatgtagaggataccgcaaataaagcacaacaaattgtaaatgaacatacaatccaatagatatagttttaatttaacaaatggtatgtttggagataatgagatagaatataaatgtcataatattatacaatctaaacaccgtttccttttctatttttgatgacatcagtatatagctactcgaaagagtagtctttttattattctcgcttattattgatatgaaaatttcgatttgacaaaaggtaccgaataattttgtaatatgaattattatcaagaagtaattatgatgataacatatggaaactagttagtaataataacaggtgattaaacttttgaacgacttgtaattctatattttttcttttaagtaaaaaatataggtgattttttttgacttcatatttataataaagacacgtaaatcaattatttttcattttactttaactaataatgtttatttggagggattattatgttagatgatagattgacgtgttctaattgtggtacattattttactatgaggaagttagaaatattgtaaaacatagaaaaaaagaaatgcctatacgttgtccaaattgcaatgaagttattaagcgaaagttgtctcatggttattttgtcagctacgaactatatgaagaaagtaaaataaatctgaaaaaaaaaccaaaatactataaaaatttgaaaactggagctattataactgaaaaagaatttaaaaatttagtgactgaagaagaaagcaggttttataatttgtctggtaatatttgccctggatttatggatcagattattgaaaatgagtcaattgaatcaattgaaaactatgttcctgttgacttaccaaaatagaaaaaataatcctgtttttacagtgaattattttaattttgattttcaataaaaatatattacaataataatcgtaatagctaatgaaacaatttctcaatctttttaccactccaaacagggagcgtcaataattttgtgtaaataactcgtccttctgcaaaataatgggttactcagtaaacattgaagctaatgtatccgtcacttgttggaagcctttatggcttctatttaagaatttttgattgtatgtatcaaagatggatactaggaaacgctctagtgattcttcattttgaaactgctcttttctgcggctgtatttcttgatttgtttattgaaagattcgattgtagaaccagaaggaatggagaacacttttgaactttacaacaaaactactgttgataaattaattccaattttagttccaactgatttaaatggtcatgatgttttacttcgttttaacggatttttaggtgaggattatagatacctaaaaatttctgatcctcaacctttaacagaataataaaaaacgtgtaatcaattatttgattacacgttttttatttcaatcttcgttgtagtagtggttgcgacataccgaaaggtaatcttcattacctcctactacaatctgttcacctgaataaactggaataccatcaacaatacgagcattcattacagcctttttattgcaaaaatggcaaatagttttaatttcctcaattttatcagcaaatgtcaataatgcttcggatcccttgaagagattattttgaaaatcattcttcaatccatagcaaattactggtacttcctcattcattacgataagtgatagatcaataatattctctctacttaaaaattgagactcatcgaccaaaatacaatcaacttttccgtactgatcaataatctccactaattctccgtacacatccatttcagaagtaattgcaatagctggtttcgaaacacctatacgactctcaacttttccaaatcctgatcgagtatctattgcgcttgtcattatgataactctcttcccttgttcttcataattatgagccactttcagtagctcaatactctttccactattcattgttccatatctgtaaaataattgtgccattaaatttattcccttcttttacaattcaattattccttaattccatctgcttttatgcagctgctcgtttattccttgatatgtctataacatctactatccctaaaaccaatttataagccattagagatggtattcctgaacatctctcatattgttttttgagtggtatatcatctgaaaaactgaaggaatcatgaaaatagcgacatacttatcatttagagttctaactttaaatgcatttacttcttcagtcagcactttagtcatgttggacatggtttggggcgtgtagtgatgcccatacattttctcaatcaagtctgcgatttccgacatggtaataccttttcggaagaggtgaatgacggtctcctctaatgtgtcattcgtccgtctataagcaggaacagtctgttgcttgaactcgccattgcggtcgcgcggaatctggagatgaagttccccatactcggtcttgaccgtacggtcataggagccgttacgagaattacccgtgttaaaaccaatgcgatcgtacttttcgtaatcgaggaaagccgttaactccgttttgagaagcgtattgacagctttttccaaatggacacggaataatccattcaaatcgcctttgttcgctagagtctttaggatttctgtagtaaaatcgttcatatggaagtcctcttttctgtgaatgtgttgtggtaactctattctacagaagggacttccttttttctatttacacaaaatattttacactctcaacaaaagtatcttcgattaatacttgctcaagttatgtgcagctacgaaaaagtaggtaccgaggtactttctttttcgcagctttttttggacttatgagaagtacattcgctggaagaatacgatataaaacgagctttttcactaaagatattaatagagtgaaagaaacaagcttttgttgtcagttttttcacttttctaaaaatgaaaataaaaaattctggaagtggagaagaattttgcttgctatactttgtcttgtagaaaagaggtggacaaaataatgcaagctcaaataagcgattttccataaccttggtaggaatgacaaattaaataggaaagggaagtaataatatgaataaaaaaaagttatctctattcggtttttttgccctgacagcttccatggttttgactgtttatgagtatccgacctttgcaacatcacaattacatttggttttctttcttcttttgggaggtattttatggtttctaccagttgctttatgtgctgcagaaatggcaacagttgaaggatggaaagatggtgggattttcagttgggttagtcaaactttaggagaacgttttggttttgcagctatttttttccaatggtttcaaattacagtaggttttattacaatgatctacttcatactaggagcgctgtcgtatgtaattaattttccagagcttaatacagatccatttatcaagtttattggtgtattagtcattttctgggtactgactttttcacagttgggcgggaccaatcgtaccgctaaaattgctaaagcaggatttgtcattggaattgttattccttcgatcattctctttggtttagcagcagcctactttatcggcggtaatccgattcaaatggctattaatgcgaaagcttttattcctgacttttctcagctttcaactttagtagtatttgtatcttttatattggcttatatgggcgtagaagcttcagcatcacatattaatgagctggaaaatccccaaagaaactacccattggcaatgtttttactagtgattttggccatcgccttagatgcaatcggcggtttctcagtagcagcggttattccacaacatgacttgtctctcagtgctggtgtaatccaaacatttgaaacgcttattttacattttaacagtcatttacattggttggtaaaagtgattgctctcatgattgcctgtggcgttatgggtgaagttagttcttgggtagttggtccatcacgagggatgtttgcagctgctcagcgaggtctgttaccagttttcttccggaaaactaataaacaagacgttccagttccgttgattatgatacaaggaattatcgttactatttgggcagcagtcttaacttttggtggaggaggcaacaatttatcattcttagtagcaatctccttaactgttgtcatttatctcgtaggatatttactatttttcctaggttactttgtattagtttttaagaaaaaagacttaaaacgaacttacaatgtaccaggaaaaactgttggcaaaacgattatcggtggaattggttttattttatcagtgttcgcattgcttatctcttttgtaccaccagcttcaattgcagctagtgagcaccgaacataccaaatcatactacttattagctttgtagtgactgttcttttaccttttatcatttatgaagtacatgataaaagtgctcacacaactattgaggaacctactcacgtgaaagctgaagacgttaatcccgctgtttatccagctgctagaggagagcaccacgttacaaaaaatgatgaacatattttaaaacattaggaggaattcattatgttatacggaaaagataatcaagaagaaaaaaactatttggaaccaatttttggctctgcaagtgaggatgttgacttgcctaaatataagttaaacaaagaatccattgaaccacgaattgcttatcaattagtacaagacgagatgttggatgaaggaaatgcgcgattaaacttagctactttttgtcaaacgtatatggaacctgaagcagtgaaattgatgacccaaacgttagaaaaaaatgcaattgataaatcagaatacccacgaacaacggaaattgaaaaccgctgtgtaaatatgattgctgatttatggcatgctccaaataatgaaaaattcatgggaacttcaacgatcggctcttcagaagcctgcatgctgggtggtatggccatgaaatttgcttggcgtaaacgtgctgaaaaattaggtcttgatattcaagcaaaaaaacctaacctggtgatctcttctggttaccaagtttgttgggaaaaattctgtgtatattgggatgtggaactgagagaagtcccaatggatgaaaaacatatgtcaattaatctagatactgtcatggattatgtggatgagtacacaattggtattgtaggtattatgggtattacttacactggtcgttatgatgatatcaagggtctgaatgatttagttgaagctcacaataaacaaactgactataaagtatacattcatgttgacgctgcatcgggtggcttttatgcaccatttactgaacctgatctagtttgggattttcaattgaaaaatgttatctcaattaattcttcaggtcacaaatatggtttggtatatccaggtgtgggttgggtcttatggcgtgaccaacaatacttaccagaagaattagtatttaaagttagttacttaggtggagaaatgccaactatggctatcaacttctctcatagtgcagcacaactaattgggcaatactacaactttgtacgctatggctttgatggttatcgtgatattcaccaaagaactcatgatgttgctgtttatttagccaaagagatcgaaaaaactggtatttttgaaatcattaatgatggatcagaattgccagttgtgtgctataagctgaaagaagatcccaatcgcgaatggacactatatgatttatctgatcgtctgttaatgaagggatggcaagtcccagcctacccattacctaaagacttggatcaattaattattcaacgcttagttgttcgagcagactttggaatgaacatggctggtgattatgtacaagatatgaaccaagcaattgaagagttgaataaagctcatattgtttatcataaaaaacaggatgtgaaaacgtacggctttactcactaaaattcttcagagaaatataaaagaagttaattaactaataaaaggagttgtgattaccacacagctccttaaatctatttgaataaatatatgatattcatttgttacactctcaatcttagctgttgttctattcatcattactcttattgtaagtagttcagtcaaatttgcttgttcaattgatcgataacagtatgaattgtttgaaaagtaatcggatatataattgttttctcactacctaagccttcttggtataaagaactatcgcaaagtataatccgctgagtacaaaagaaagtgtcgtctactatttctctaagttgtttacaaatgatattactaatagaaaagtgttctcccaaaatgtcttctaactgttgtcgatagtataaatacctaaagtctgacggagctactatgaacacttcaattggagatttccgtttatgctcatttaaaagacttaaactaatggttagtttacgaatagaattctcattccaacgcagaaataaattgttttgttttcgccattgttcaagaatttcatgaacttctaagtacaaagcgcgttgctcttcatttaacaagtaagtcttatcaggttgaaatatctgaatatcagcccaaagtgagcggataaacgggagaagtgctttatcaaaaagtatctgattttcttcagatatattcagagataagataagtttttgactgagctcaatcaccaaagggttatctgctacatggttttgataaacaacgttcaagtctttttgtaacaattcaaagttatcgcatagataatttctagagttgaatagaaagtagatataaaggcattcatcttcgtcatgacataaagagaaagaaagttgctctaatcctttctgtattagctgaaacaagggagtatgtcgggcaactcttttttcttcctgactaaaatatattgggttagtcttagatctctgcaaaccgatagcgatacctaataaaataaattgtttttcaactgtagggtaacttcttgaaaaaaaatgtttttctacataatcaatcaattgttgaccgctttgaataattgatttatttagctggatcaactctgtccgatttgtctcatagattatcgttagtaacaaacttcgataatccttttcaggaatttcaaaatggccatcagcatttaagtactgcatttgtttaaaaaaattaatcaactcatttcgtaagttgtaaactttgcttaacgaaatgaaggtagtatcagctatattactccaattgtgttcccctgataaataatgtcctagtacattgaaaaagtcagagcgctgatagatgagttgagtgagtgccaacctcgaaaacgaagagtcgaatgcgactgtaaagctacttctagatttctccactgaaataatttgctgatggagtatgtcggtaatgcattccaagtcgttagtgacagtgagtgggcaaacgttcaattgatctgctatttcgcgaatctgaatggtccctttttcgtgtaattgctcacaaatgtaaacttgacgaaaaatacttttctccagataggtttccaacatagtactcctcctagtcattttatacataactattataactctaccaatcggaatagtcctgtaatatattgaatcaaaaatataaattataaaataattagatggggtatttggtttaagtatcccttatatagtaataaatttataggtgtgattctcgaattaatacccgaaaatgtgagagaatttttatggattttttaggatacaaattaattatttttgcttttatcctgattaccagtccagtactgtcggtatcccattttgcagcaaaatcatgttgataaagtgacaagaagactgatgagatatattatccaaattgagaagataattaatcggattcttgagtataccctactttttaagaaagtagggtatacaagcgtatgaataaagacataactttccctgtgatggacgttcggcttgttccaattaccaaaatacaggcgaacgattataatcccaatcgagtagcgtctccggaaatgaacttattggagctttctatcattgaagatggctttactcaaccattagtttgttattacaaggaaaaagaagagaagtatatcttggttgatgtgcttcataggtatcgtgttgctaaggaaagactcaacttaaaagttgtaccggtaacagttattgataaacccatagaagaacgtatggcttcaacaattcgacacaatcgtgcaagagggacccatgaaataagaggaatggaaattgtcatccaaagattagtaaaaaatggatggtcagacaagagaatatccaaagaattaggcatggacattgaagaaatttttcgctttaagcaagtgtctggtggaatggcaacagtttttttgacaaattttataaggtgcagaacttctttccgtatgctattccgattgtccttgacaatgagcctcctcggatgtgacgatcttcggcaggagctaacagttaaagttagactgcctcgctagcgttagcacatccgagctcattatcaaggattcgctgcgccaatctctggttacggtaaccaaccggtgtctcgtagccaagtgtaccgtgcaaccgaaggtggttccaccaatttacatagtcaaataactccaaatccaattgttgtaaggtttcaaatgtgtattgatagacaaattctactttcaacgacttataagttgattcagctacggcattatcaaaaggacagcctttatgactcaatgatcgattgatgtcaaaagttgttaataattcatcaatagcttggttatcaaactcttttccacgatcagtatgaaaaatctcaacctctgtcagaggttgtttgatacggctaaatgcttttttactagaacggcatctttatgttctccacaagaatagccgagaatttctcgattgaacagatccaaaatgaaacaggcataattccattttttcccgactcgtacataagtcaagtctgttacgatcgcttctaatgggttgtctcttaagaatttacgaattcaatacgtttgtcgttttggcttcattgcaagtagaatgatgtactttaaaataagcaacagtatagctcgattttaatcctctatttttcatgattctactaatttttcgtcggctgatctgaatgcctcgttttgataaggctttttttatttttcttgagccgtaggcctttcggctgcggataaattcttcagcgactacttcttcaagttctgattcgtctttctttggttttgattgataataataggactgacgtgatagacctaatattctgcacatcgctgatatagggtaaagatgcttattcgcatcgattacttgtctcttcgtccgaatatcagcgctgcttgctttaaaatatcattttccatttctaattgctggtttcttttacgtagttctaacaattctttttgttcaggcgtaagattatctttttctttgaatgaaccactcgttttagattgctttacccatttgtcaaatgctgaagccgttagttcatattctcaaatgatttctacacgtggctttccagctaagtaaagattgacgatttgttgcttgaattcttgtgaaaaagttcttcgtgttctcttagacataaaaattcctcctggtatgttttcttctagtctacacaccttaatttttctgtctagttaattgtagcctatccagcatttcttatgtttagttgtgatgtctattcagttaattgaaacaaataatatagcaatgaaatagagataaattcaaatatatattatatccatgaagcccaatcttctttaatagaagattgggctatttttatggcaaaggagggaaaagaaatgtttcaaaataaaggataacgttatgtcacaaagggagtaatggacagtttgccggtggaattacaagctttatgttggaatctaatcgatcaaaacgttcaggagccatttcctttagactatctttaaatttttgaattttctacggaaaaaggaaatcaaaagttggttcatcgtctagaagaaccggaagaaagaaaagagtatctgatttcacctaagcttcgtttgaaatcagtgtctcaaaaaatatgggtcattgattcgggtgagtatcaaacgatgttattaccagaagaatactaatatctaaaagaaaggagagaaatgacttgttagaaacgtctatcgaagtactggaaaagtgtgcacagctagtcactactcctgaagagtggggctatgaatccgttacgatggaaaaagaggaaattgaaatgggtatgcttcctgaagatgttactctaccacgtttagtaatgacacatctttatatttattgcgcaccagaagatggaaaagactatgtagtttatttcattacagatattaccagccagcgagaatttgttcgcgggttactggtagaaggacgtttggtttggagtcagattggaggaaccaatgaataagatcgattatttgagaatgattgcgaaatgtttagaagatatccttacagcgattcatcaaattctgaagaaaaaaggagaaagaatatgaaatattttcaactagtattgacacttataacagcaatggtaattgaagtgcttgaacaaaaattagcataggagaaaaagagatgattgaaaaagaattagtgaccacacaaacagaagtttggcgagatcctcatcatacccatcgctatgttttcaaacgacaatgggcgatcaaaggaaaagaagcggaagataaattagcagtagtcattactattcgtccaacagatacagaaccatttacgaatgatttgagtatgttattaatcgaaaagaatatccgacaattaggatttactggttttattgctgtgaatcttttttcgtacacaaaagcgaaaagtcctcgggtatttcttcgaggaaatgatgaacaatctttggaaatattaacgactgtttttacagaaaagaaaatcaacaccattatttttgcttgtggttcgattacggcaacgagtcaagtggcttatgaacaagcaaagaccatttacgatcaattgagtgcgaaacaaaagaagatgaccaaagtattgataaatgcagaaggtaagttatcccacccactaagtattcatgttcgtaatgaatggcaattggcggatcattctttgttatttcaataaacgaaaataagtattcaatgtatatgtttctttttctgttattttacttgttcttttacagactaaacaacttgtaaaacctcttgttatatgcattatcaatgaaggaatcaatatgatatttttaaaatgtcagaggaaatggaggtgagcaagtgaaagtagatggggaatgtttgacgagttcgtataaaagtatctatgaattttttgaggaaaaagggctaaacacggatttactttatcagttttatattgcttttcgtgggcaacagttatcgtttccaatgaaaatgtatgaccgagaattagtcgctcaaaaaattgaaacaatggtacaagaaaaccattccattgattctaggaaattaacggataggtatggtttttcaacgagatggattcaaagtattatcagacaacaacaaaaggagcaacatgtacatggctaatgaagaaacagtaggtttgagaatcatagaagaagcattcaaattaccaatggtcaaagttgatcgtcgagcatttttgattcaaacatttcaaggaaaagtttctgatattgaaggactcatagaaaagggaccacaagcatttttatccaaagaaatgctagatcgtgaagcacaaaaatgtattcaatcgattaccttgaaatcaagtgcggtatcgttagcaactggactgccaggaggtatcgctatggcagcaactattccagcggatctccttcagttctttggttattcattacgattagcacaggaaatttcgtacatttatggatttaaggatttaatgggagagaatggagagctcagtgaagaagcaaagaatacgttgatattgtatttgggaattatgcttggagtaacttctgcaggttctgctgtacgagcgatgtctggaaagttatctacacaagcattgaaaaagattcctcaaaaagcattgacacaaacgttgtattatccagtaatcaaacgagtactaggtatttttggtacaaagttaactaaaaataccttcgcgaaaggtatttctaaagcagtaccagttgtgggaggcgttgtttcaggaggcatcaattacttgtctatgaaaccaatggcaacaaagcttcaaacagagttagggaaaaatgtagcatatacagaagaaagtctccaacaagatttagatattttagaaggtgaatttgaagaagtatcttctgacatcgcgtcttctgatacagttctttctcaattagaaagactttctcacttgttggaaacgaatatgattacagaagaagagtttcaacaattgaagcaagagctgttaaagaaataattatttagaaaaagcaaccacttatacgggtggttctttttcttgaatgaattcaaatttattattaggagaagaaaaaggatgaaagcaaaacaattattcctattaggcacgattcttttacttggaggatgttctactgtctctcaacatgaacaaaagaaacaagtggattcaacaactcatgaaattgaaacaacaagaaaggaatcttctacaaaagaaatagaaaaaactactcaagaaactaacacaacagagtctagtaaggcaacgagttcagatacgagtgattctcaaataaaacaagaattatgggatacaaataaatcttctcaagtagcaacttttgtcacacaatggggaaagacattaggacaagaatataaaagctacaatcctcagaataatgtaagtctgtatggaactcctttaccccaagccgtgattaatggcaattggaaaatggcaatcaatgaagcaccagttaccgtacaatggtcagaagatggaactggtcatgcagattttaaattagtagcagtttattctgatgtagaaactggagaatatttagggcagcatgtttacttttttggttttcaaaatggacaacctaaagtttatttaacgcaacaaaatcaaggtaatgaaaataattatctgtactttaacgaaactcaaaatcaacagttaaaacaaggtttcagtgatattgtgaatggacaaactcctcaaacaccagtagtagaagaatctactcaacaagcaacaactacaacgacgcaatctacaagtagctcagcaatttcaagttgggaagctgctaaagaaactgtactaaataataaagcgttatggatttatgagtcttcagataaaaatgcatcaaatactaatattattgaatccacccaatatagaaaagatttaatgcaagatgaaaatggagaattttatccagttgatatttctactgacgatattggaaatacggtaatgaatggaggaaagcaattccgagtttatacagatggaagaatttctcaacggattggaatgactaacaattttcaaatgattaaataatattatagactgagaatagtagttatttgatagttttaaagaaatatgtactgaatattaggaacatttctgatgaagttactagtatagaaaataatttcgtacttacagggattgaagcgtgtatcaatgtattggtatgcatggatataataaattttatccttagaaaaagtaattaagatgccctgctaaatataacttagcagggcatctattaattttattgggaacattaaagtagctgaacaaacgcattataagtcccctgataccttaatgtaatactaggtatatcagtaaagtatcagctaagatagtcaattaattattactcggtttcaagttcaaatagatgcctatctaagtctatttctggcgataagagctgccatttccatgaaggtaaaaaatcgttaaaaattgtttgttcttctagtgttgaggcttcgtagccaataatcttattttgatgtgcgagtgttgataattttgatttaacagaacgaactttattttcaaaggagctccagaattcgatattcgaatgaatgatgcttatattttccttattaacaacgatatacaagtttctttcttgtgaaatttcttgattttttctaatcttttctatttcttgatatagatccccttttacttttttaaatatcccttttttttccttagcaacgtgtttgagcccatcccattcgccataatatagagagttacgcttattttttatatagagtgtgtaataatttccattaggaaaaggaacatcttccggataatctaagtttacttctatatacagattggaatgcttattgtccttttcttgtttttccactttctcttttttcttctctttctcttttattttagtggggtctagtggacaaggagcaatttttttagtactccataattcgaataaaatagaggcaatattgattggtgaaagagtctctttctctttttttagaagaggaattaaacgcttttgtgatttccatccaatttgtccaagcttaaagatcccattatcatcagtaatcaattctattttctctaatacaaattgtgcatcgttagttaatttataaggcttagattgtgtcatcatgaaattaactaactctgaaattaagtccctagagaattcttcatattgaaaaaatttcttgatagtgacgtcatcaaaggttatggcgtatttcataaatttattaagaagtttaatataacctacctcggaaaaaatttcattgtttgctggtacatactctggagaatttgtaatcctgaagaaatcaaattcttgcttcgccacgctagtaaaatttcgttttttattttttattttattccattctggtttcgcgcagttttgaaaagctgaatcaaaacttaggctattgtcacttttataaggtaattcaaaaaattctttaacgatttcaacgaattgaaattcataaaatacatgaaacataataaacatcctttcaaaatatatattgcccaccaattgcccaccagctgcctgatgattcaatacgatggttgtgattaaattaaattgttcaaaatataaggtatattgttattttaacagatactttttcatatttgaatactctgaaaagaaaggaggtttattttatgaaagaacaagctaggagtacaaaatatccaacgcttgtaattgattatgtaatgatttcatttgttgaagcaaatgtgattgaagttggtagatatttatttgactattccattatcgaagaatttgaactattggaaagtagtatacgtggctttaataaagttcttacaaatggctttttatttctccattatgaaaacaagggagaaaaagcagttgtcttgctagagattcgttcaaaaggatgtcgatatctagaatgccaagtggatcatcaatggacacagttcttttttaaactaatgaaagtaggagaaaatatttcaatcaaaagctacaacatcaaaagactggatatagcaattgatgggtttacttcagatactttaagcacaaagcgagttcaacgatatctcaatcagaggttagttacgtcgcgctttcgtacatgcagaacaattcaagaaactagaatttcctcgtctgacataatcggtgatagtatctattttggaaaacgagcgagtgatatctcggtagtcgtctatgataaaaaattagagacgaaaacacaagatatttggttcagaacagagttaaggtttcgacatgactgggcaaatcgtgttattgcaacgttggttgaaaattcatctgagttttcctcttatatatcaagcattttaaaacgtaatttgcaatttcgctctcatacggagaattattcagaagtgagacgtagaaatttagcaacttggtatgaaagatatcttgaatatatatgccaacaagaacttcattgtggaaaaatgaaatttctagcttcatgaaagtggtagttagccagtgacgttacagaaagaagaggattaaatgaatgatttgaatttcgattctttagtagcagagctattaaaagaagaaaatggtcagtttgtggtggacttaagtatctatttttcagaaaatacccaaggaaacaagggtgatttattagaacaggaggaagagaatgagaagaaatacaaagaaggctaaattttttatagcattagtcaaaaaatatcaaatgagtcctttttattcgtttgagatacttaaggagatttatttgtataaggtaactgatagagaaatttctggtctattaaatgctcttaaaaatgatgagctactggaaacaaaccagaaaagaataacaagaagcggacgtgttcaatatatatggaagcttacggaaaaaggtatgattgaatatcatcgtctcatggaattataacgattggaggactatttttatggaggattttatttttgaattagctattgggcttgttttttatttcaaccaaaatggaaaagaggcagtaaataagaaagaagaataaacttggtttaggaattggaactgattgaacgttttgcatattttaagtatttaggaaagaaaacgattcttagtcgattttctttcctttttgatcagtgaatattttactgtaagtacttaaagttatagaaatggctaggaggaggaatcaagcatgcgtgtggcttgttatgatcgaacgtctgtttatgaagaagcgaaaatcagtaatgacgctcaatatgatgcagtgaaagagtatgttttagagaaatatgaacaaattccccaacgattttcagacaaaggagaatcagggggaaaagcggaacgtccagcttttcgacagcttagagcttgggtttgtgcgtcagaagaagagggggtgatctatgtttggcgttatgatcgattggcacgtcaagccaaaatagccttagaatttattgagttgtgccaacaacatcaggttcaagtgtattcgatttctgaacctcttcctgcttctttctcacacgcgtcaacgaataaactatttgtgcaattattgttcacttttgcagaacaacaacgaaacgtcattattgaaaatgttcgtgccggacttgcctataaaaagcaacaacggcaatacctatcttctgcggttccatatgggtatcgtttagtgaatgggaaaatccaacaagaagtacacgaagcaaggattgttcgctatatttttcaactttatttgactaaaaaatatggctacaaaaagctttgtcaacgattgacgcaacaaaagcttttcttccgcgaacgtccttttcagccctatcatatttatagtatcctaaaaaatccattgtactatggcgaaatcaaaggaggatctttggggaagtatctaggaacctttgaaccgattctctcgaaaacaatctttttacaagcccaagagattcgccaatcaaggtgtacagctaaaaaagatacgtatccgtacttattacgtcaaaaaattcggtgtcccttctgtggtcgtcatctgagttcgaagtatcaatggaatacaaagaagacaaagacgcttcattattatcattgtaccgaccgaagctgccaaggaatctttcttcgggcagaaagggttgagtcagaagtattggaaaagatacaggctttttttcaatacgaaggcgtctatcaagccttgattgcccaattgacgcaacaattatccgaaaagcgaaaagatgaaaaacacaaagtaatccaacaaaagaaacaagaagcacaatggctcaaggcatttgaagagggcaattgttcactggaagaactcaagcaacagctgcaagctcttcaaaagccgaggtctacttcttcgtttctttcactccaacagtgtgaagcaaaagtgaaagaatggcttcaactaaaagacctctctagtcgacaattgttatgtgaccatgtttgtcggatcgaggtaacaaaggaaaaaacagtctgtgggatttacttccggcaaatgacacaaaatattttagaagggaacgaatgatctatggaaacgacaccaaccaaacgagtcgcattgtatattcgggtgagtacccaagaacaagctttagaaggacatagtattcaagcacaagaacaaaatggacgacagtttgccgaacggatgggctatgaagtggtagaagtttatgccgatgaagggattagtgggaaatccacaaaaaatcggttcgcctatcaacgaatgatgaacgatgctcggaaccatcgttttgatctactagtgatttggaaattgacccgtctcggacgcaatatgttagatgtcttacaaaccgtcgaggaactgttgcgatatgatgtggggttacattcgatctcggaacaatttgacgtgactacttcgacaggaaaactaatgttacaactccttgggagtttcggtgaatttgaacgcaaccaaattgcggagaatgttcagatgtcaatgcaaagcttagtgaaagataaaaagcgttatgcaggtggacgacgtttaggctatgtcagtggtattgacacgaatggtcaaaaacaattggtcattgaaccagaagaagcgaaaattgttcgtctgatctatgcaaaatatttaggtggagcagggtatcgagcgattgccaattttttgaatcgtcaaggatatcaaacagtcaaaaagaatgctttttctaccacggcagtcaaagatatcttacgcaataaaatttatgcagggtatttagaatatgcgcgctacatcaattgggaaaccaaacgacggaaaggaaaaaatccgaaaccgattttagtgaaaggaacccatgaaccgattatttcggaagaagattatcaaaaagtacaagaacgccttgctttagaaggaaaacaacccaaatggaaccatacaggtgaaaatgtattgacggggttgttacgttgtccagaatgtggggcaccgatggcagcgagtaatgtcacaaatactctaaaggatggcacaaagaaacgaattcggtattattcttgttcagtctttcggaataaaggagcaagtgtgtgtcatgccaattcgattcgtgccgagcaagcggaaacatttgtcgccgaccgattaaaggagatcgttcagctaccagaagttctttccagattggtggcagcgttaaatgaagaaatagtgcgacaaagccaaccattggaacaagaactcgtggtgttactggaacgaaaggaagaattgaagactaaaattgaaaaatgggaagctgctttggaagatagccccgagttgtttccgatgttaaaagaccgcttagacgaattgactgaaaaacgacgacagttacacattcgagagaatgaaatcttagggatctttcaacaacaaggagagccgattcaagtcaaagatgtccaacggatattgactagtttggatcgttttcttacccagagtgagaagaagcaagtcaaagccttgtatcgtacttttattgagaaaatcacctttgatcctaaacaaaaggagatattggagattacaatgaaattcacgcctgccgtggtacaacaattaaatgagcaatatcaaatagccgtatccaaaacaaaggatacggctatttttgtgttaaagacgccttttacgctaacgatctagtctaggttatatcaaacaacatgagaggggcgctaacgcttctctagcgatttgaaatcgttagaggagtcgttagggaggtccttatcataaatagggatatttacccgtggtgctagttaattttttcctagaggaaaatgtctaaacatgttggtaaatcaacaaaaaaacgcatatagtagtctcaaattttatgaaaagatgttataattaactaaaaaataatagggagaaaacacatgtactcaaagaattggaaaaaaaagttagtgatgggtgttatggtagggtctatttttgtttttgcaggttgttcagcttcgacagacaaaagtaaaacggctacttcagaaacaaaaactgctgaagtagtaaaaagtaaaatgaaacaaatagaaaaaaatgtagagaaaattttagccgaaaaagataaagatacaaaactgtcggagtacaaaaaatttgttactgaatccagtgcttactctaagtcagataaaacggagaaaaaaattactaatacctatacagaatctattaagaagatcaaaacaaattttaaagaacaagacgataaagacttaaaagagaatacactagataatcttgaagaagcaactgaaaatgatctttctcaaaaagtaaatacattagatgaactcaaaaaatgggtacaaaaagagagtactgatgtatatagccaagcggaagtagattcattaatcaaaaaaattgacgatacaattaccacatataaaaaccaactagagaaaataaaaattgataatcaggaggctacatcaacagagactacaacagaaagtagtgaggtagctactttacaagaaaatgtttccgaagaaccacaagtggtctacacgaatttattaaattctattgaagaagcagctcaatatctgggacaaaaacttccacaatcgggcggttcagatgcatttgaaaatgggcaacaaaattctgatggctcgtttacttttcattatcaactacatggaggtccagaaggtatcacttggaatatcattacagtgaataataatggtgagattatccaagatgattatttcaaaactgtacccaatgaagcaacaaacaataatgtctctacacttagtcaagcagctatttcagagttagaagctgctcaacttgcaatagctaaacacaatgagttaggtagacctaatgcaactgatgccggaagagaaactacagcagacggatattatttttattatatggccgatggaactgatcagatgtataaatattttgtaagtaattctggtcaagttcaagcagaataacattgagttataatgatattatcagatgaactgtatcataaatttttaacgtgaaatgtttgtaatatcaattggaaaaattggagaatggtatatggatttactaaaagataataactgttattttttagtaaattcatactatttagaaacgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaaaacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccttagaaaatcactaaattaccaaacaccattagaagtttttttgagttacgtaaatggaaagttttgtctcgcttaatttgacaaataatagagcaaaaacaggaagctgctttggaagatagtcccgaactatttccgatgttaaaagatcgtttaaatgaattgactgaaaaacgaagacagttacaaattcgagagaatgaaatcttagggatctttcaacaacaaggggaaccgattcaagtcaaagatgtccaacagatattgactagtttggattgctttcttatccagagtgagaagaagcaagttaaagctttgtatcacacctttattgagaaaatcacctttgatcctaatcagaagtagatattgccgatcccgatgagattcacacctactgtgatttgacaattgaatgagtaatatcaaatagccgtatccaaaccaaaggatatggctatttttgtgttagggatatacgtcacgcagcttgttatcaagaataagtttctttatttttttgctttttctaaaactgagtatgctaaaataagagggtatatagcaactttaaataagagataggagtgtatctttttgggtgcagaattaaatcaaaaattatttagtgcggcagataatctccgtagcaaaatggatgcgtcagaatataaaaattatttattggggctgattttctataaatatttatccgaccgtttgctggaacaagtggttcttttagcagatgaatccttagaggaatatgacacagtaagcaaacaaacgatgttgtatcgtgaattactttcagatgaagaatcaaaagaagacctgattgcaacaatcgttgatattttggggtatgcgatttcgccagagtatcttttcaacgtcttagcggatcaagcaaaacaagcaacgttccaattgaatgatctaaacaaagcctttttagcaagtcatatttatggaaaaatactgtcggtaaaattcgaatagtgtcgaggaggtgctgtgatggaagaattaaaagaacgcattgtcaattatgtcatagagaactctgagattaaaaataaatgggggaacaatacagcacagaaaatatctgaaaaattaaatgttagtcgtaatattgtctctcaatatttgaatgaattcgtaaaagatggagaatttggaaaaatcaatactcgtccagtaatcttcttttctttaccggagaaagttccaaatcaacaaatttttagctcttcagaggaagcggaaaaatggtatgatagctcttttagggttggaatagaaagggttatcggaagtcaaggaagtctgcgaaatgtaattgctcaaattaaagcagcaatctactatccgccaaatggcttacccattttacttcatggcgagactggaactggaaaaagctatttagcaaattatgtgtataaggatttgttggccaataattatatagaagagaaggcatctttcatttcagttaattgtagtgaatatgccaataatccagaacttttcttgtccaatttttttgggcatgtaaaaggtgcatatacaggagccgaagatggaagaaagggtttagcagaattagctaataatggagtcttatttttagatgaaattcatgcattgagcaatgaatgtcaggagaaactttttcagtttatggatacgaggaaatttcatcggatgggtgataatgaaaactggtacacatcaagttgctggattatatttgcaacatcagaaccacctgaggataaactattatcaactttgttgagaagaatacctgtaaagctaacacttccaacattagacagtcgttctctttatgaaagaaaacagttaatcaagatattttttaaatcagaagaagaaagactagcaaagaaaatactgatatctcaacaattattagattttttattaaactatcgctttagtgaaaatgttggcaatttgaaaaatatcattcaattgacctgtgccaatgccttttatttcttagatgatttggaagaactttatattcagatgtatcatttaccacaatgggtgaatttcaacggcatgaaggttatgaaaagacagaatgaattaaaatatattcaaatggatgatttggaaaaagtagacgaagtttttaatatcaacgaacttatagagtatctttatcaaacgtggaagaaagacactgataagcagcagctttttgagaaatatgatagatattttagacaaaagaatgttgatatccaaaataattcagctttaacatatcccacctatcaagagattcgatttagacagtatgttaaggaaatagagagagattttcaaatagaatttgactattattatcttcaaataacgtctatctttttgaattcttggatttatcaaatccaattaacatcggacgataaattatattccttcatcaatgatattaatagttggtgtagtcgagaagttcaattagtcaatcgttttattcaaataggggatatttatttaacaaaaattcaaaaaaatgttttggttattttatttaagttaatgtgtagtaaagaatttcagcaaaaacgtttagcactgattttggctcatggagatctaacggcaacctgtatagcaagtactgctaataggatcgttgagagatatatatacgacgccattgatatgccactaatgacttcaagtagtgagattgcagacaaaattaatagatacttacaagagtgtaccggatatgaagaaattattttacttgttgatatgggttcactggagaaaatttatctaaatttggaactagacgctcaaaaaaaattcggactactaaacaatgtttcaacaagaatggctattgatgttgcaaatcagatattattagatttaccgcttaaacagattcttgaacaagtaaaagaaaatcaaaatgtggattatatttatgaatcatcaaatattaagaaggatatgattgtctgttcttgtgcaagcggattaggaacttcgtttaaattaaaaaagatacttgaagatagctttccaagggatactgatcttgtcatagaaacgtgtgactattactctttagtgaatgaaaactatttatcggagcttcgtaaagagaacaatattctttttattgttggaacactaaatccacatctagaagatgtagaattcttttcaattgaagatatgattttaggaatgaatataagtaaattctccaatcaattgaatagacactttaatgataatgaactgaaagttttgaacaataatattctgaagaattttagtctaacgaatttaatggagcaattgaccatattaaatccgactaaattattagaacgggtttcagatgctatatacatcttacaaaatgatctaggaatttcatttgataataatacgtgtttcggattatatgttcacattagttgcttaattgaacgattagtaaaacaaaatactttggaagatgaaatttatttcaatgaaacgagtgaggaatttcaaaaatttcagacacattttaagcaatctttcagtgtcgttgaacattattatagtgtcgacatcccgattcatgaggttaaatacgtttatgattatgtaaaaagagcttgatttatcaagttctttttgttttggcatggtaattgcttgtaagaaaatgaaagataaaggaggaagtatttatgagtattgttatgtcgagagttgataaccgtttattgcatgggattattgtcacgcaatgggcaccaatgtctaaagcaaacagagtgatggtgatcgatgattctgtcgcaaataacgacatccaaaaatcaagtatgcgtttagctagacctgctggaatggctgtatcaattatcactgaagaaacagcgattgcgaattttaaaaaggggaaatacgatcaggaaaaagtatttgtcatcgtgaaagagccggaaacaatccttcatttagtagataacggtattagaattgaccgactaattgttggcggtactgttgttaaagataatgcattacagctatcttctagagcctatgcatcagatgaaaatatcagcacgtataaaaaattgttggattctggtgtagaaattgttacacaatttgttccggcggataaggcacaggaaattcaatcaaaattaggataaaggagtaaggataatgcattttactatttttcaaattattatgctgactatattagcatttattaaacatgttgattattatgggattccgatgatctttgtaaattacgcagttttttggggattattcacaggaattttgatgggtgatataaaaacaggtttgatagttggcggtacagttcaattgatgtcattaggagttgccggttttggtggctcatctgtaccggactatggaacgtgcgcaattattgcaacggcatttggtagccagcttggagtagaagccggattagcaataggactacctgtaggtatgttaggggtgcaactagatgtaattgtcaaaatcttaaatggttttgttgttcgcaaatcacaggaatatgcgaataaacgagaatttaagaaaatgaatagtgttttgtggttggggccaattttctttggtttatctgcagcaattccagtatttattgccgttactttaggacagtctgctgttaattacgttttggatgttttacctaattggtttatggatgggctaacattagccggaaaaatgttgcctgctgttggtattgcgatgttgttacgctttatgcctacaggtcgatacattagttatttacttgttggatttttcttagccgcttttttgaaggtacctattattggagcggcgatcataggattcgctttagcatttaatgtgtatcatagagctgaaaaagatgcacaaatcactgcttctgcgggagcttctgatgttgggtttattggggaggatgaataaaatgagcgaaaaatatcaagtaacgaaaaaggatcttaggaaagcgaactatcgttggttgatgtcagtttgtacctttaattatcaaacacagcaaggtgcatctgtaacttacgcattgtcacctattttaagaaaattatacaaagatgatgatgaatacatcgaagctttaaataatcactttcagtattacaatacacagccttggctggcagccattattttaggtgcttgtgttgcaatggaggaaaagcaaggattagaagcaaaagatgcgattaatgactttaaagttggtacgatgggtccaattgctggtattggggactctcttttgatgacgatgatcccaaccatcatgggatcaattgcggcttatatggctttagaaaataatcctgtaggaatctttttatggttcattttaatcatggtaatcttctttttccgaatgagaggctttgaatttggttataagcagggaatgaagattgttactgaatacggtgaaaagattaattatttaactgaagctgcttcagtattggggctaacagtagttggatcattaattgcttcagttatcagtgtttcaacgccacttaaattcacttttggtgaagttagtatgaaaatccaaccaatgttggacaaaattttaccaacattaattccagtaattattactgctgcagcatattatctactcagtaagaaaaaaatcagtatgaccattttgattctactcgttattgtttttgcgatggttatggctgcatttggaatattagcgtaaaggaaaaggatttgaattatgagaagattgatcattgctagccattcaatactagctgagggttttaaagagacactagagtttttaacaggtatgcataatcaaattagtagcttatgtgcatatgtcgaagaaattgatgatatagatgaacaaattaaagagttagtggatactacagacgaaataattgttttaactgacatggctggaggaagtgtaaatcaaaagttttttacctatatttctgacagagtgcacgtaattgcaggaatgaatcttcccttggcaatgtcaatcgctttgcagttaggaaatgataatttagatattggagcaattattgcggaggcacaacaacaaatcatctatatgaataatcaaaaaagtgaagaaaggatagaggacgaataaaatgaattgtttaaataatatatggctccacaagggagaggaaagtagaactatttcaccagaaaataaaaatggtgaaaaagggaaagcggcaatgacagcgagtcatctaggaattgggagaaaagggtcaccttctgttccgataaatgctggagagacaattactttagcagaaatggaaggccctggaattttacgtcatttttggatgacagtgacagacaaaacaatcgctgggagtttcgtcttacgtgatttaattttgcgtatttattgggatgatgaatccactccttctgtagaaagtccattaggagattttttttgtaatgggtttgggacaagatgcgaagtgaattccttaccaatcgtagtgaatccaacatcagggatgaattgctattttgagatgccatttcgaaaaaaagctaagattactttaacgaatgaacatcctgagtttattaagcacattttttatacatttaattatgcattgactgaagtaccggatgatgcgatgtattttcatgctaaatggaaccgtgaacccatcacgacaaaaggaaaagattacacccttattgatggaatcaaaggcactgggtattatgtaggaacctactttgctttgtgcgcattggaaagatactggtggggggaaggagaatttaagttttatatagatggagatgaagatttccctacaataacatctacaggagcagaagattattttggcggcgcttgggctttccataaaaagaactttggagaaagggcatatgctcaaaattttaatacgctatttatgggctatccttttcaatctaaaagagatcacacccgggattattttagtgctggaaaacctaatccaaatccagttcatggttttggcgatgatgctttaccgatgcatgggttgtaccgctggcatttacccgaccccattagtttcaaagaaaatttacgtgttactttccaaaccctaggaaatgatgacatcaagctttatgagcgtcaagacgatatttcttctgttgcctattggtaccaaaaggaaccacatgagtttttcgaaaaactattagacagggaagaacgaattcctagataaaaggacggtggagtaagaaatgtatggctcaatagaagcaggtgggactaaatttgtttgtgccattggcaatgatgatttaaaggttttagaaagagtgagttttcctacaactacaccgaatgaaacaatgagtttggtaattgatttctttaatcactataaagaacaattagaaagcattggagtagggtcatttggaccgattgatatccatcgtgaatcaaagacctatggacatatcacctctactccaaaaactgcctggaaaaattttgattttgttggaacgttgaataagcatttcgaaattccaattgcctggacaaccgatgtgaatgctgcttgttacggggagtatgtttcaggtcatggaaaaggtttatccagtgttgtttattacactgttggaactggaattggtggaggagctatacaagatgggatttttgttgaagggtttagccatccagaaatggggcatacgttagttaagagacattcaggagatactttctctggtacttgtccttttcatcatgattgtctcgaagggttggcatctggacccgctatcgagatgcgtacgggaaccaagggacaagatctttctatagaagatccgttctgggaaatcgaggcggattatattgcacaatgtgcctgtaatacgaccctgatgctttcaccagatattataatttttggtggtggtgtcatgcaacaagaacatctgaaaaagaaagtacaaagacgttttttagaactaattaacggctatgtcgatacgccaaatatcgaagaatacattgtcacacctaagttagcagataatgcaggaactataggatgcttaactttagcaaaagatgttagaatcaattcttaagcaaaaaagtattagtcaataaaatgcttatgaagtccgatcaacttaatgtggtcggactatttgtattcagcaatatcattcactcatgatacccagcgccttatcataagtgatgcggtttttatcattgatcctaaaaatcttagcaagacaaaaagtacgtaagaaagtaaagactaaatacttcggaggaacaaatgaataacaatgataggttattgcgattgcgttatgcgattgatttgaaagatacggatttgattaaagcttttgagctaggcggtgtaccactgactaaagaagaagctcaggcggtactgaccaaagtacaggataagaacaaagataatgcagaaaataatgtgtatgaaaaaaccatcaacaaccaagtttttgacgcattcctaaatggcctgattctcttggcgcgtggtccgcaaaaagataagccgatagtagacacgccgcaaaaaagcaaggaaatcaaatatatcaacaatgtgttgctaaaaaaattaaaaatcgccttgtctatgaccactgatgatattttagacgtttttgctgaggcagaaatctatccatcaaaaggcgaaatcggggcatttttgagaaaagaaggccaacgaaattttaagccttgcggagataaatatatgcgtaattttctcaaggggttaggaatttataatcggagaaaagtataaagaaatttcatgagaaatcaaaacaatggttgttttgatgagagctagtttttgtatgagattaaaatattatcttaatcgaggagctggattggttttatgaatgatgaatataagaatgatgaagataagatgctttttgaagagatagagaatcgatgtaggctcaattttgagcttcggggaaagatgtctttaatacaacaaaaaaagtatttagcgaataaatcagagtttactctgggacatgttgaaaaattaatctcggattggattagtagtagaagcgaatttacaaaaataaaacagccgattaaatttgacatgaaaaaacttttgttaaataagagtgagataggtaatagagatcaatatattagagctaaagggcaagaaataattgattcattaggtgaaatgaggtcatacaattatttgtatgtaacacatagagctgatggaatggtcattactgtggggaaatcttcttctaatgatatttttttagatggagatcttttttatcaactcaatacaaatcacttgtctggcactgaaaatataattttaaggacggaatatggcaatgaaatatttgcaaaatatgatgagattttaaaaaattatttggactgggcttggataattccggttgagtcaggagatgctaagaaactggagagattattgggcgatgaactaattaataaaaaagtaccaattttaaattattattcccatagacaataaaaggctatttttcatgataatactagttataactgtaaaaatggaagaaaatctgggaaagaagtttttaaataagtgtattgttcgattttaataaataataagcaataccatccgtctgtgttgcgcaacatcgtactacaatgaatattttttcacaaaaagaaaatcatccatcgaatgaatggaaggttttagtatacacgaggttaatgccccctcttttataatcagaggagtgaggttttttctatgaatgtttctattttcttattgctagtctagtttctcttacgatgaaattgggattctattccagtttttattgatttgctgataaaataacttgaatggtggatataaacatgataaataagagaagaataacaaaacaaggttgtgaaatgattctcaaatgaatataatagaaagaaaaaggaggaagaatcaatgaaaatagcaattgcaggcgctggcgcaatgggaagtcgctttgggttaatgcttcaccaaagtgggaacgaagtattattaatcgatggctgggcagaacatgtccaacaaatcaaagagcatggattacaagcaaattttaatggtaaagaggtagaagcaaaactaccaatcgttcttcaatccgaagtagaaaaagaagatcaagttgatctgattattctatttaccaaagcgatgcagctggaaaaaatgctgcaggatatccaatcattaatcaaaaaagatacagaggtcttatgtctattaaatggtatcgggcatgaagatattattgagaaatttgtaccaatggaaaatatctatattggaaataccatgtggacggcaggtcttgaaggtcctggtcaggtcaaattatttggaagtggttcagtagaattacaaaatttaggtgatggaaaagaagcagctgcaaaaaaattagcagacaaattgtctgaatcaggattaaatgctcatttttctgacaatattcactattctatttatcgcaaagcatgtgtgaacggaacaatgaacggactatgcacaatcttagacgttaatatggctgagctaggaaaaacatcgactgctcataaaatggtggcgacgattgtcaatgagtttgccaaagtagcagcagtagagaagattgaactagatgtcccagaagtcattgcacattgtgaatcttgttttgacccggaaacaattgggttacattatccttcaatgtatcaagacttgattaagaaccatcgattaacagaaatcgattatatcaatggcgcaatttctagaaaagggaagaaatatggtgttgcgacgccttattgtgatttcttgactgagcttgtccatgcaaaagaagatagtttgaacgtaaaataaaggagagattgaatggaaacttcacaaaaaatatcaccgaaaatttttctgaataaagtcctcgctggtacagcaacaggaatcattattggattgattcctaatgcagtattaggtgccattttaaaatattttagtgcgtatccctttgcggtaacgatcgcacagttagcagttatttttcaactagcaacacctttgatcattggtggtttgattgccttacaatttggatttgatccgatgagaatgatggttgtagccggagcttcttttgttggttctggtgtagtcaaattcacacctgatttgggtgaaacgggtgtttacgttggtgctggtacaggcgatattattaatacgatgctgacagcatcgattgctgtcgggctgattttactgattggaaatagttttgggtcagtgtcgattgtgttaacaccgattgttgtaggtgtaggtgcaggtttacttggtttttatttattcccttttgtaacagcaattacttctgcaattggatcattgattaataacttcactaccttacaaccgctgttaatgtctatcttgattggttgttcctttgcctttttgattatctctcctatttcaacagtagcaatcggaatggcaatccaactagatggtgtttctgctggtgcggctgcgatgggcgtagctgcaaccacttttgttttagtagtgaactcttggaaggttaataagtcaggtgtgacaattgcgattgctttaggcgctatgaagatgatgatgcctaatctatttagaaaacctgtgattcttattccttgtttagttagtgcagtgattacagctattcctgtcgctctattttctatttcaggtacgcctgcttctgctggtttcggcgtggtcggacttgttggtccgttggcttctttagatgcagggctaaatggctttcttgttgttctttgttggttagtcatccctgtttttgcggcactaattactcaatttttatgcgagaaagtatttaaactgtatgatcgagaagaagtcttcaaatttttaggctagtagattttactaagaaattttcaatcaatggatgcgtaagtgagatgtcaacaacatctgacttacgtttttttgcctttttgagtaggagattgatgctgacaactgaactcttcagtgccattcgattttttaaaatgtagaagaaactcacctttatgttattgattgttcaaaaggcaactagaataaaaatatgtgttaaaatgagaaaaaatttgattgttggatgtatcgaataatcactaaaaagtaggagaagaaaatgatttttttgcaaaaatatggtttttattttttattattaggtgtgattagtgatttatcgacaccgtatatccttggccttttttatcccaaactgaatcaaatgactaccgtaattagtgtgtttggtgacgtagatagtccagtcagacgtgctttcttggtctggtcagttgtatctggacttttttttgttctttcgttgcctgcgttgtatcacctatttattggaacatcaaaaacacttgcaatacttgctgttgcaacagttggtttatatgggataggtgattgtatttttactgggttattcagtatcaatacgaatgaaagctcttggaatctatcgacttggatccataatataggttctgggctaggctatgcaggctttctacttttcccattgttacttgttctgctttatcgtcaaagtggtcaaggtacgcttagccatttttatcttgttttaacagttattagtttactaattgcaggtctttacggattagcacggattccgtcgattagtcagtttgccttctttaagcaattgggcttctttcaacgcttaagttttttctttaactatttgccgatgatttgtttaagtttttttcaactacgaaagtagaaaaagcagtgtgaagctgattaagtaaaagaatttctctatgggtaaccattcgtgtggatgtgttcgactaagaatagagatgaggagagcgaaaagcaagttagtcttaacttgttatgcgttgtgctaaatttcaggtagtcattttttgaatgaataagaagaaaacttgaaagagggtgacttcatgttagatgtggagcagatggaaatagacctttataatattattttaaatcgaaatacaagagaatgggaaagaacacaatttgaagaggcaaaagaagacctagcaaaaatgtcgataaagcaggtgatagaaaaactagaggtcaacttgcgtccgctagcactacgagataatttgacaccagatgcgatggatttttatttaagaatcacaggggagtcagcgagtgcaaaggcttatgattatgccaaacataagataacttcacccttataccaagaacgggcgatttttgccggtggctgtttctggtgtatggttgagccttttgaaacaaaaccaggtgtaatctcagtgttatctggttatacaggtggagagaccaaaaaaccaaattacgatcaagtcagtggtggatatactgggcatgttgaagctgttgagatcatatttgatacacgtcaaataacctatgaagagctgttggagatttattggcaaatttcagaccctacagatgcctttggtcaatttcaagatcgggggaaacaatatcgttcaattctatttgttgttaatgaaaagcaaaggcaattggctgaaaaatcaagagaacaactgattcaatctaaccgatttagccgtcctatcgttacagagattcgccaagcaaagactttttggccagctgaaaatcatcatcaacaattttatcagaagcaacctaaaagatataaaaagatcaagcattcgcatcagcttcatttattttttcagcgacatagatagaggaaggttgtggcgcaaagcgttcagctccgacaaaataatgagcaactgacaaaaatagcttttcatatttttggacagttatgaattatttcgaggagttgctttgagaacaccgaggaaaaggttgtggcgcaaagcattcagcttcaagtcgcaaggaaacaggaggtatgacaagtcttttgtcacaactcctgtttttttactagcctttatttccatgtgaaagagaattcgaattgtagaatcttgatttttctatggaattttgtagagaatcatcttgataattaatagacacctaatcgaattccacattaatgatgaactaaattccgtataaaagcgcaaacaataactataaaacccgtggtgctagttaattttttcctagaggaaaatgtctaaacatgttggtaaatcaacaaaaaaacgcatatagtagtctcaaaactcccaagaaatgaggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtgatttatagtatactatgtcaaaaggaggagttagatgaacaatcaaatcacactagcgtatttagattatgatgatctagatgctttacaagttgtaagtgttgtcagtttttatgaatcgtttatcgatggcgcagatccacttgatatgcaaggatatttacagacacaattgacaactgaaatattggcagtagaattggcacagtcaaccagtaaatttattggtattaaggatcatcaaatactcattggttatatgaaagtcaatgatgaaaaagatgctatagagattcaacggctctatctgctcaaagattatcaaaacaaagggttagggcaacggttactcgatgaagcgaatcgttatgctaaaacgaacaaaaacgttatttacgtttgactgtttatgaaaaaaatcatgcaggtattcgtttttatgaacgtcatggatttaaaaaaatcgggatcaaacattttcctttaggaaaacaagatcgtatttgtccgattttagaaaaagaaatctaaaaaaacgtcctcacttttgatgctgaggacgtttttttggactggtaatggaaccataattcgctttccttttgataaatcgctaattccgtcacaccttttgcttttaacagagcaaaaaagatcatcgaaatggaaacggaaatgttcaaggtaatgcccatctgatccaacactaaaacaaggtaccaccacgtgaaagacataaatcgatgacatattcatataacgctaaattgtcatacaagtaagcgctcttagcatttaattcgaatgccaatttatttttgattacttgatctagaatcggtaaaaactgcgcttcatattgtttaaattcagcaacggatagaccaaatacccgaaaaccatagtcaaaatgagcaaagacatctgcttctataacaactagtgcttctgaaagttgtgcaaaatactgaggaatcacaatagcaggatccatatctttgacttcgtcatctaaataatcaaattgcccattatgatgcacactgagtaattttaaatcgtaatctttatcggctaaatagtcgatgatccgatccttttcagaagcgatgtaaccgattttgatgccttttaaaacacgattgccaaaacgcttatttaagctatcgattgtttgactgtacatttcataatcggggatatcatcgactttagtaacaggattggctaagtcaaaatgttcagttgtcacgacgtaaccatcgtagtttgttaaatagtcctcatttcttgggagttttgagactactatatgcgtttttttgttgatttaccaacatgtttagacattttcctctaggaaaaaattaactagcaccacgggttaagatttagaaaaacttactaaacaaagagatatgaaaaactttaataattgtgtagttttgataattataactgaattaactttatttacaaatatatattatatccatgaagcccaatcttctttaatagaagattgggctatttttatggcaaaggagggaaaagaaatgtttcaaaataaaggataacgttatgtcacaaagggagtaatggacagtttgccggtggaattacaagctttatgttggaatctaatcgatcaaaacgttcaaaagcaatttcctttagactatcttcaaatttttgaattttctacggaaaaaggaaatcaaaagttggttcatcgtcaagaagaaccggaagaaagaaaagagtatctgatttcacctaagcttcgtttgaaatcagtgtctcaaaaaatatgggccattgattcgggtgagtatcaaacgatgttattaccagaagaatactagtatctaaaagaaaggaacgaaaggacttgttagaaacggctatcgaagtactggaaaagtgtgcacagctggtcactgcttctgaagagtggggctatgaatccgttacgatggaaaaagaggaaattgaaatgggtatgcttcctgaagatgttactctaccacgtttagtaatgacacatctttatatttattgcgcaccagaagatggaaaagactatgtagtttatttcattacagatattaccagccagcgagaatttgttcgtgggttactggtagaaggacgattggtttggagtcagattggaggaaccaatgaataagatcgattatttgagaatgattgcgaaatgtttagaagatatccttaccgcgattcatcaaattctgaagaaaaaaggagaaagaatatgaaatattttcaactagtattgacacttataacagcaatggtaattgaagtgcttgaacaaaaattagcataggagaaaaagagatgattgaaaaagaattagtgaccacacaaacagaagtttggcgagatcctcatcatacccatcgctatgttttcaaacgacaatgggcgatcaaaggaaaagaagcggaagataaattagcagtagtcattactattcgtccaacagatacagaaccatttacgaatgatttgagtatgttattaatcgaaaagaatatccgacaattaggatttactggttttattgctgtgaatcttttttcgtacacaaaagcgaaaagtcctcgggtatttcttcgaggaaatgatgaacaatctttggaaatattaacgactgtttttacagaaaagaaaatcaataccattatttttgcttgtggttcgattacagcgacgagtcaagtggcttatgaacaagcaaagactatttacgatcaattgagtgcgaaacaaaagaagatgaccaaagtattgataaatgcagaaggtaagttatcccacccactaagtattcatgttcgtaatgaatggcaattggcagatagtcaattattatttcaagaaaaataacattttattttctcatgttacttataagtagttttacatgctttttgactttaaaaatacatgtgatgatacatgttatatgaattatcaatgtacccagtaatatgctattttcattatgtaaaaaataacagggggtgtgtagatggagattgatgaaacttgtttgagtaactcttataaaagtatgaatgacttttttgaggaaatggaactggattcagaattgctctatcaattttatcttgcttttcgagggcaacagatttcttttccaatgaaaatgtacgatcgtgagttagttagaaaaagaatcgaaaacatgatagaacaggaaaaaactgtagatatccgtcaattgacagaagtttatggtttctctgcaagatggattcaaaaagtaattaaacaaaaagaaaggagacgagtacatggctaagctgattgtattaggtggtttaatttacggtggatattggttatataaatatatgcttgcgcatccgaatatagataaaggaaaagtaattaagacagttggggtaatcatagttggactcatagctctaactaagaaaaataatactaatagcccaaaaataatgagaacttatcgctgtagaggatgtggaagggaaatttctactagttttaatccatctgagagtcctcaaggaagagaccgctgccatacgggctatcgacattattgggaaagaatcgattaaaagattaccatttagatcaattaattgtctgatagaataagtacgtgagggagaaattgaaagggggaaatataatgaaaaaatggctgttattactaataggaatgggaattttattcactggttgtacatctgagaatacgaggactaaagcgactatagaaactgatacaacaattgagactaaaaaaagtaaaacgcaatcaactgaacaaactacaacagaaatgaagcaatctgtggaaacaagtgcaagttcaatcactgaatcttcttctgaagaggttaagaatactttgtgggatacgaataaagcttccaaattagaaacttttgtcacacaatggggaaagacattaggtcaagaatataaaagctacaatcttcagaataatgtaagtctgtatggcactcctttaccacaagccgtgattaatggcgattggaaaatggcaatcaatgaagcaccagttaccgtacaatggtcagaagatggaactggtcatgcagatttcaatttagtagcagtttattctgatgtagaaactggagaatatttagggcagcatgtttactttttcggttttcaaaatggacaacctaaagtttatttaacgcaacaaaatcaaggtaatgaaaataattatctgtactttaacgaaactcaaaatcaacagttaaaacaaggtttcagtgatattgtgaatggacaaactcctcaaacaccagtagtagaagaatctactcaacaagcaacaactacaacgacacaatctacaagtagttcaggaatttcaagttgggaagctgctaaagaatctgtgctaaataataaagctttatggttgtatgattctcctgataaaaatgtatcaaatactaatttaattagcacaaatgaatatatgaaagatctaatgcaagatgaaaatggaagctactattcaattaatattgtaacggatgatgatggaaacacgaccatggctggtggaaaacaatttcgtgtttatacagatggaagaatttctcaacgtattggaatgactaacaattttcaaatgattaaataattgaaaatattatttatcaaagaaaaactgattttgagaaaaattatttaattttcttagaatcagtttttttataatattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaattccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatcttttttcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgaattgaaaaaaaggattttagtaacaattggtctagcttttttgttagctggttgtaccaacgggaatgaatcgaaaaaagaatcaacaaaagaaacagcgaaagcaacagttgcaactactacaacaactagcacagagagcaagtcaactgcagcaagtacagaaacagcagatacctctacttcgtcagagtcttccaaaacgactgaaacaactcaaacatctacttcaagttcttctgtagaggcttcatcttcctcttcagaaagcagcgaacaagttgaacaaacactgtggaatgcagacaaatccgcacaattagaggcatttatgaccaaatggggccaaacaatgggacaacaatacaaaagttatacgaatcaaatgagtgtggacttatatggtcttaaagtccctcaagctattttgaacggggagtggaagatggctattggtggagtgcctgtttctgcagaatggtcagaaagtgggacaggtcaagcagactatcaaatcacagccgtctattccgatgcagagacagaaccatatctgaaaaagcacgtctatctattcgggtttcagcaaaatcagccaaaagtattggtgacacaacaaaatcaggggaatcccgataattatctttacttcaacgagacagcgaataatgaattgaaaaatggctttaatcaaatcgtttatggacaagcaaattaatgagataaacaaggggttgtgacatgtcttttatcacaaccccttgctcagtttatttgttagtcttttattttttggctctatactttttgatgttggtgaacttcaccaacatcttttttgtataaaaaaatatagaaaagacaccctgaaatcctttagaattaatttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataaacagaacagaaagaggttttcttctttctgttctgtccaaattattctaagatttctctttaccaacatcatttgacaaagagcctattttttgtgtcgcccatgttgcactgtactggttacctgcaacaagatcatattgtatcagacgataatcttctagaatttctttttgtttctcagttaaatttttttcttggataatttgactatcctctgtaacaaagacctgttttccattaaaacgattagacaagctttctgtaggatcaattgttaatgcaggtagatgattagatacttctgtcaacaacgcatagtaaggagttactttgatattcgcatgctcaagagccatagcaccaaagttattaggagcaacaacttctttatttaacgtagctgcttgttcacgactatacttgttgttataaatgaaataatctgtctggtgctgttctaatccatattttttcgaatcattcccactatagattgcgggtaaatggtcaccataaaaaacaaaggtaatcggtttatcgattttgtcgatttcttggatgaatttttttactgctgtatcggtatagtgaaggccttgcatataagtttgtaattcttttcttctattaggaatgacagcagttccttcagcagtgtagttcaattcactatagtaatcatcataaggcatatggttttgcatagtggataattggatgaattgtgacgtttctgtattgctttgtaaagctttcaaggtttctttgtatgctgaatcatccgatatgcgtgggctttgttctattttatccgtataagttaatttatccggactgtctaaataatagaacctgtcaaaaccaaatttatcaaacacttgttttctgcgataaagagcagctgtaaaaggatggatggctattttttcatcgaatagatcggtaatatttggacttattttctgacgctccactagctgggtataaggtgtaactaacgaagcagacaggttactgatactcaagcctgtcagtccttcccattccatgttagctgttccgccaccataaccgacggataacatcaatcctcctgttccttctgttataatgcttttgatgtaaggaatagggtctgtaggtactgtcagattagggacacgtgcaggatcactgaagctttcacttaaattgagaacgatcgtctgattgtttaaccagtcacttcttgtttggttgatttcatctgcctttgtgttgtactttttcattattccattaattttttctttcgaatagccagcaggttcttccatgattttaatgtcgatattgtttaggaattgaatgactggtccgttatcttttacggcgccttgctggttaaagaaagtcttgtttactttaaataaattaaacagcaagaaagaaggcgaatttttgtgattaatgaaaaagacacccgaaaaacatcctaataatacagcgatactgataaatcgacgtttccaatgaatcttcaaggaatactgtttttgtagtctacgttgtacaataatactagtaatcaataataggagaaggatcaatccgcccacgattaataagactgggctaaccatcgataatagttctgacaatccggtcagtatttttaaatctgaaggaaagacaggctcttcccgcatttccattttgattactgtcgaaatagtgagcagtaagttaatgatcaaggtagcagtcaaggcgtaccaaaaacgattggaaatcaacaatagtaagaagaaaaatcccataataatgatgattgtcaggatcatgggtgcttgtcgctgagtaaatatttttaaggcaacctggatagtttctttccaaccttcttttggttctaaaacgaaaatctgcacgaaggtaaagcagtaaaaaaatgctgcaactaaaaaataacttttatgaacaaaaagccaatgaattctttttttccaacgctgagttaattgttcaatcgaatcaaaagcgaagtattcgatgaaacgatgaatgaaacggattttttgtatataaaataaaaagataactaggagggacactgctaataaatagcaaataaaaaactgcccgatatttatcagccatgccttccctgagtttggaaattcacgtttcataaatgtagatacgcgataagaaactaaagggaaattacatataacttgagtgacaatcaaaaatacagcaagaaaatttcctcttccttttatacctaatttatcagatagcatttctaaaaataaaaacgaagagaaagtataatacattgcgaagagagaatatggtttagaaaacctcagcgctgtatctgtatttcctctgatgatgagtgaaatttgtgtcatcaaaataatcaaaccgaataaaacaatcaagctgataaatacttgaggaagcttatagcggaccttttctttccagttccattctttcaaaccataacccattaaaaataaataaaaaatccataaaatactctgtccattctgtaatgcaaacgggtctttattaaatagagtagagcagccaactaatccaattgttaaaaataatagtagatatttaattgttgttttcgataatttatttaaaaatccaactgtataaggaatactacaaaaaagcaaagtacaagaaacagcataagtaaagtaattctgactgataggtgttaggataagccaataatcacgaatattcaagctgccagcttgtacgtaaaaaaaagatattgcaaactagtgtggctattaggaatataaaggcaaaacgacttaaataatgtaaaacttttaaacgggcgattttttgatattggtaacccatgtaaagtgggatcaaatttgcaccaataacaacggaagtttgtaaaaatgtatagatgtagaatcgaccagggtttgttgcatatgtaggaatagtgactgctgaaatcaatatacgctgtaaaaccatcattatacaagcgacaaagattgtcaggaagccataactctccttctttatttttttcaagaataaacacctcacaaaaaaattggacaaaaacataagaaaacgtttcctgataagttgcccattaataacatcctaacttagaatatctcaaaaaacaacgtgtagacagaaaaagtacaaaattagcaagaaatggttgtttgtattgttagaatttttagaaaattatacctttagtttctttgcataaaatgatacaatgattgttaaaattgtgaaagggtggtcatttgttagagaagtttttggatatgtcgttagttcaacgtattgttgttggtattttagtcggaatattgtttggtatctttttccccacatggacatttatttcaatattgggaacgttgtttgtcagttgcttgaaggcaatcgcacctattctggtttttttcttgacgatggcgtcaattgccaagcataaaattgggaataagacattcgtgaagcctattttgatcttatatttagtgggaacattgctttctgcacttgtagcagttattgtaagttcaatttttactgttcctattactttacaagaaacagtatctgaaaaagcaccgcaaagtttggaaagtgttttatctactatgttgacgaatgtcacacaaaatcctgttcaatctcttattgatgcgaattaccttggcgtcttattctgggctgtattgttgggactagcttttcgagcacgttcagaatcgacaaaagagttggtggatcagatatctatagcgttgtcacaagtcgtacaagtgattattgcatttgctccgatagggattttaggattggtttatcaatcaattgctacgactggaatagctggattggcagagtatctgcagcttttacttgttttgatcggtacgatgctgtttgtcgcattagttgtgtacccattcctcacgtttttgtttattaaagaaaatccctatccattgattttcttttgtttgaaagaaagcgcacttcccgctttctttacccgaagttctgccgcaaatatcccgataaacatgatgttggctgaaagattgaaattgacaaaagagtcttattccatatcgatcccgttaggtgctacgatcaatatgggcggtgccgcgattaccatttccttgatgacgttgactgctgtacattctttagggattgaagcaccttttgttttgaaagtccttttatgtattttgtctgctttagctgcttgtggagcttcaggtgttgcgggcggttcactgttattgattccattagcatgtagtttgtttggtatctctaatgatgtcgcgatgcaaatcgtcggtattggatttattatcggtgttatccaggattcaatggaaactgccttaaattcgtcaagtgatctgttgtttactgcaataggagagctaggcgcgcgtaaaagaagtggggaaaaaatcaaattgaaagattgtttagatggattaagtgaacgttgaacgttagatatttagtatttttaaaatgattcgagtttttaatgagttatatagatgttcgtgtaaatagaggtttctgttaaatcaagataaagtcgcttataataacaattaaaagcataggtaattgttattggaggcgtatcatggattttttacgtaaatttggttttttctttttattattaggcgtgctgagtgattttttgactccgtacgtattaggattgtattatcctgaattagatcaaatgaagagcgtgatcagtgtatttggagaggtttccagtcctgtaagaaaagcgtttcttatttggtctgtggtttcagggatctttttcatcctgtcattgcctgcattgtatgctgcatttgtaagtacatctcgtgtgttagctaccctagttacagcagccatcgcgttctatggtataggtgattgtatctttacaggtttgttcagtatcaatacccatgaatcttcgtggaatgtctcgacatgggtccataatatcggatcaggtttaggttacagtggttttttattgtttccagttcttcttttcttgatctatcgaaaaaatgggcaaatggacgtaagccacttataccttggactgtctgtgatcagtttgctttttgcggcgatttatggactggcaagaattccttctataaattcttggccattactgaataaaataggtttttgccaaagaatcagttttttctttaattatgtgcccattgcctggttgagtatcttgcatctcaaacagtaaaacttgagccgtcaaattgaacagtcagcggatacttcatccggtggctgttttttgtttttctgaaatatatatttccacagttttcttgtatagcttctgttttagagaagaaaggagctatattttgtgctacaatcttaaaaaggtagagagaagaccaaatggaagacagaggagccactaaaatatgagaaacatcaagttgacaatcgaatatgacggaaaaagatattcaggatggcaaagacttggagatgacgataaaaccattcaaggaaaaatcgaaaaagtattgcatcagatgacaaatgaagagatagaaattattggatcaggaagaacagatgctggcacccatgcgcgaggacaagtagcaaattttaaaacaaacacagaaattggactggcagaaatgatcgactttatgaatcgttaccttccgcgggatattgtcatcaaaagaatcgaagaaatgcctgagcgcttccattcaagatataatgcggtgggcaaaaaatacagctattatgtttggaacaacgtgattccttcagcatttgagcgaaaccacagcttttatttccctcaagagttggatatggacaagctgaatgcagcttgcgaaaaattagtgggtacacatgatttcattggtttttctgcattgaaaaaatcaaaaaaatccacagtgcgtacgattgatgaattatctatcgaacgaaagggagaaatgcttcattttacttttgtcggagacggattcttatataaaatggtgcggattatcatggggacattactagaaatcggcacaggtgccatgccgatagaaacaatcgatgaaatatttgaaagcaaagtgcggcaacatgcaggagaaaccgtccctgcacaaggtctgtttttggatgaagtttattatcgataaaaatactttgataatggatgaaacgcatgtttcacagtataaatatcgatgttaaataatgtatgaagcaaattaaagaaatataaaaaaagactttttagcctgtttatgtgtacagctaaaaagtctttcttaaataaaaatctagtgagaatgttgtacttctcttctcggttgtttttgtttagaaaaagtaaatcgataaagtaaaaataaaatcaaagtaacgatagataaatatcttgaagcaattgctagttttgtgtactgataagtaataacgactttatttatacctggaggaatagttaattcagttgtgccaaacttagataattttgtttgtactagtttgccattaatagaagccacttgccctttataacgataaataggtgtcgtcaagacagtatttttattattcgaattatctaattcaattgtaagtttgttactcataaaatgagttgttggatttatttcctggttacctagtaaatattgatcattattaatcatatcaggatgatagattgactctttgtttgcataatcagtatgattgtaattttcagctatagcaacagcgtcttcaggtgctataagtgttaatgaatctttgttagcatggatagaattgcttactcctgagagatgcaatattagtgcaagaaacgtaaagaccattattttccatgaattatttttagtagaaaaaatataatagatcactatactcatcgtataggctataaataaagaagaaaaaccatttaaccgccagacaaattgtagactcttaactggtgtatggttaaaaagttgccaaggaaataaattggttgaacaaaaaagaacaaatacaccaagaaagaaaataaataaatcatcagcagttaatttttttataaaaataaaagcaccaatcaatccgagaaataagaataatccaatagtatagttgttatagttattatttaaaatgtgtgtcagcatatcactaggagccataccacttaattcttttcccagtgggactttcaattcttgtgctctagattgttgaataaaaggaattaagaatcccgcacttaaaaaaaaggtgaggacggtagcttttaaaagacttaagagtctagcgattttttggtcccaaaaataaaaagaaagaaacaacgttcctccaataaatacagaaaccatagcgacagaaagtaaatgagtatacactactagcgtcatgccaatagacaaccagtaccatttttggtaatctctaatataaatttcgtaacaccccattagtatcaaaggcaaaaatgttaaagcgacagcttctcccaatgaagcacgatggaatatgtcaatggcacgataggcggaaaatgtataaataatcgaaaataacagcgaaatataacgattgttttttatttgtttcatagaaaaataagaaacgaccattgttaaaaaagtgataaaaaaatagtagatattataacttaaaacaagatttcccatcattttataaaataaaaaagctggataaagagtaagccatggataaaaaatattcatcattgttccatgatgatcgaagttattgaagtttactggagaactccatacattatctagtcctatgattcgagataaatgaaagtaagtatcctgattgacactatgatagattcccatagacatgaatagagggatgacgtaagcaaaacttagaaataacataaaaatgatatctattatttggtttttgttttttttcatttttttctcctatttaaaagtaataaaaattgattcttttctagtatatcatactagtgctatgaaaaatttaacgcaaaacttattaaaaaaagacaattctagtatactgaaaatagaattaaaaaaggagaacaacaaatctatgaaaataagtaaaaaagcatttcttttagtagttcttatcttacttagtactttatattcagtaaattttatgagaaatgctcaagaaatttatacaacaggtgatttatcttttcatctttcacgaatcaaagggttatcttctatttttgaagggccaatcaactatacaacatttaacaattatggagatggactgaactatttttatccttttcttacaataattcctgcagtcgttttttatggaatttcaaataacttaatattaagttatgttctatatatttggttattaaatatttgtacgattctgattagtttttgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatgttacgagatacatggatacaacaatgctgatattttgctttaggataaaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacggtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctctagtttttattatggagaaaagttttttaaaaagatagatgctgcttttttatttagttgtttatatacttttgcaacttatcgaacagttgatatctattatcgatccgcaattgcagaagcaatcgctcttacgattatcccagctgttttatattatgcttatggattgatattcaatagagaaaaaaaagtcatcgctttatctgtcagtataagtctacttgtgtatactcatgtcttaactacactattgtgtagtgcattgattgcttgtatgattatagttcgtttgtttttaagcaagcaaataaaaaacgatataaaatttgtggtcgtgaatttagtaaaggctgtttttttgacttgtgcattaactagctatttttggtatcctatgttgcagcagatgaattatcaagaaatacacagtcccttcaaaacagatttgcagctagaagcactttctatttcagatagtatcattcaagcgttaaataacgatattacaacatacactatggggttattaggattggttgcgttgatttttcctttattcatactgaaagaaatggagaaaaaagaaaaaatcatctatgttggcgtagtttctacatgggtatgcgtaactaatttatttccatggtttttgtttcaaaaaacaccgataagcttgctccagtttccttggcgtatcttaggtatccaaatctttttttcttcaatgatcataacgcttgtttttatgaaaaagactatgaataaaaaatattcatggttaatcattggcgctactgtggtgtttctactcgtcacgtctatagcagcaaaagaaaattacgcaaaagttatccaatcaaaacacggtcatattgttatcaatgaagaaacactcccacgttatacaacatcagatatgggaggattatacgattacgccccaacagaagcgataaaagaaaggcctcacttagaaaaacatgaagtaaaagtaggagaatcgtgggaaaaagggaagtataaagctgcagataataacattacttacacagtggcaagcaacaaaaagcaaaaagtgacagtaccagtatatgcttatttaggtacacaggtaaaagtaaacggtaaagtcgtaaatgactcttataaaaaacatggcttagtgaatgtggatgtaaatgctggagaaaataagatagaaattacaacaaaatatactccaactgctctcatggctttatggatcagtattctgacttattgtttagtggtgtattcaagttttaaacgatttgcacctaataagttgaaagattctcgatatgtgactaaaaaggagataaacaagaagaatgaaaataaataaaaaagtagtaatattgagtggattaattatagttagtagtatatattctttcatctttttcaaaaatacacagagtatttataccactggagatctttcttttcacttatctcgaatcaaggggttatcgactatttttaccagtccgattaattatgagacattcaattatactggatatggtgtaaattatttttatccctttctgactttttttccagctgtaatgttatattggatgacaaaaaatttgattgtaagctatattatttacgtttggttattgaacttgtgtacaacactcgtagcttatcattatggcgagcggtttttaaaacaaaaaaaagcggcatttttatttagttgtctctatattttctctgcttatcggacagtagacatctactatcgttccgcaattgccgaagctatcgcaataacacttgttatccctgtattattttatgcttatcaaatcatctctggaaaagaagaaaagtatccgtctgtaaagctagcattgagtatgagtttgctagtgtacagccatgtactatcaacattaatgagtacagcattaattatcatttttatttttattcgtttggtttctaaaggtttcaagaatgcagattttattgctatatttaaaaaattatttagtgcggcaggaatgacattggttctgacgagtgctttttggtatccgatgtttgaacaaatgctctaccaaaaaatcaacaaacctagcgtgacaaatttatatgctcatgcatctaatgtgttcgatagtctgactgaagctatgaacaacgacttaactacttactcaatgggactagttggtctgttatctttatgtattcccctgattttatttaaaaaattaacaaacatagaaaaaaagatttattatggtacgtgtttgacttggctagctacaactagtttggtgccatggtatcttctgcaaaatacgccagccaaattgttacaatttccttggcggatcttaagcttgcaaataatattctcttctctgatattaacgatgatatttttcaaaaatagaagatacaataagacaagagaactattttatttatttatgactgttttgttattaatcactttaactgtttctagtaaaaaaaatttcaatcaaaaaataatttctcagccgggacatattgttgtaaacaaagaaacagtagaggcgtataccactaaaggaatggattattttttatatgattattctcctatcgcttcattggagaataaggagcatataataaaacacgaagcaaagattggcagtcaatgggtaaaccttccttataaaacaactggtagttctatcatatatagagtaactaatgagaagagccaagtaatcacacttcctgtatatgcttatttaggaacgaatgtagaaataaatcatcaacctgtaaaggagcaggtgaatgctaatggattggtacaaataagcggagtcaaaggagttgctgatattaaagtaagcacaagttatacagtaacgactattatttcttatcttgttacattaactgcatatttatgtttattttttaaaatagttttccataaaaggtaaattaacttttcatttataaaataaattgattaaaaaggagaatctgtcgataaggattctctcttttttatacgaaaaatctgtagggggatgaagtaatcgcttatttcctcactttatgataaattacagctaaagtcactagcttgtcttcttcggaaaggaggagaatctatggatgaggaacaaatattcattcaaacactttataatctgattttgaatccgaatacacgagattgggaacgaaaagtattgattcagacaaagaatgacataagagaaaatatatccgttaaagaacagttatcaaaactagaagcaacactacgtccattagctatccgaatgaatctgacgcctgatgtaatggacttttatttattgattacggaaggatttgataaggagcaaaaatatgacttttccaagcatgccatgcaagatgctgactatcaagaacgtgcagtatttgcagggggatgtttctggtgtatggtcgagccgtttgaatcgaaaaaagggatcctatctgttttgtcaggatacacgggcggacatgttgaaaaaccaaattatgatcaagtaagtggtggttacacaggtcatgtggaagctgtggagatcatttatgacacaagagaaataagttatagcgagttgctgacaatctattggcaaattactgatcccacagatacatttggacaatttcaagatagagggaagcaatatcgtccagtgattttttatcaaggcgaacgacaaaaagaattagcggaacaatcaaaacagaaactagacagttcaggaactttccaccaaccaatcgtcacaaaaatcgaaccagccggtacgttttggccagcagaaaactatcatcagcaattttacaaaaaacaaccgaaacgttataaaaaaatccagcaagcacgtaatcaatttctgatctatcaacgagtaaaaaacaaatggcaaaaaaatatacgaaaaaatcattttgattaactccttttctttaaaatgtagtaaactaaaaatagaaaaaagaaagcgttttaaaaagatttgatgaggaggagaaaaattgtatattgcagatagtgcacgttatgaaaaaatggaatatcgtaaatccggtcattcaggtttgaaattaccgattttatctctcggattatggcaaaattttggtgattatgatcctatccataatcaaagagagattttaagaggcgcattcgacatgggaattacccatttcgaccttgcgaataattatggaggccctgctggagctgcagagaaaaactttgggcgtatttttagagaagattttcaagcctaccgtgatgaactgattatttctagcaaagcaggttatcatatgtgggaagggccatatggggaatggggctctcgtaaatccatcatttcaagttgtgaccaaagtctccaaagaatggggctagattatgttgacatcttctatcatcatcgcccagaccctgatacacctttggaagaaacagcagaagctttgatgcaacttgtaagacaaggaaaagcattatatattggtatatccaactataatggagaagatacaaaaaaaatgactgaaattttaaaaagaaaggaagcaccgttcattattcatcagatgcgctacaatatgttttctcgtgcactactagaagacgatctatctccagtattagaagaagaagggctaggggcaatcacgttcagtccgcttgctcaagggttgctgacaaatcgttatctacatggtattcctgaagattctagagcacatcgtaaggaaataccattcctttcagaagaacaagttggatcaactctggaaaaaatcaaagcactgcaaacaatcgccgtatcacgaggacaatcattagcgcaaatggcccttgcatggaatttgcgacaaaaatctgttacaagtgtactggtcggagcaagtcggttaagtcagttacaagaaagtgttcgaatgatggataatttagatttctcaccagaagaagaattgagaatcgaccaaattctagaatagaaacgatgtaatcaaactttttatccatatattaaaaaaaacaaaagatgacatcaagaatcgaatgaagatcgtctgttattgaacatcatattttttgtcgttcaaaataaaaatgatcgaaggctaggagtgaattttatcctagtcttttttatggtaaatatcttcttcgtttgtatgtctatgaacggattaatcaattttgtatacaaaaaatcatcagatgattcaaacgtgttataataattacgaaaaaatacatcagatgaaaaggaggtatgtggtttggaagaaaataaaaccctagtagaagtaactactgacaagatccttagatatttaaaggaaatgcagttgcaagtaggagataaactgccgaatgaatatgaattgtccgattatttagaggtggggcgaagcacggtgcgagaagctgtgcgggctctagcttccaggaatatccttgaagttcggcaaggagcggggacatttgtcagtgataagcgagggattgccaatgacccactcggtttttctttgattgaagatcaggatcggatgatacgagacttatttgaactgagatatttattggagcctaagatggcaggtttggcagcggaatatgcaacgaagaatcaaatcgtccaaatgaaaaaattaacgcaaaagattgaaacttcttttcgagaaggcacacaagaacatgttcaattagacatcgattttcatacgatgattgcagaagctagcggaaacgtagccttgctgcatattatcccaatcattaatgaatcaattgctttgtttaataaaaattatgatatccagcatctgaaaatcgagacgatcgatattcatacagagatcgttcaggccatcgaaaggcggaatgcacttgctgcgtttgatgcaatgactgtccatatggcaataaatcggagagaattacagaaaataataggagaaaaagaaactaattgacagttcatctgatgtattttatgataaatacatcagatgaatttttgttttatatttggtaaaaaagaggagtaaatagtttctgttcatcgaaatgtaagcgctgactaatagacaaaaagagatgacgtcaaggagaagaagcaggaatgaggggatctggaatgagttttatggataaattagccaatgttttagggaacgtggcaacgagaatcaataatttaaggtatatcatggtgataaaaaacgcatttgctgcattgattccggtaattattacgggtgcttttggcacattgttttcagcaatggtctttgactcggaaaatggcttagcacagataagtttcttgcgttttttagaagaattaaagcctatcgcatctgccatcagctatgtcacactaagtttcttgaccatctatgctgtttttctgatagggatcgaattagccaagctgaataaagtggatggtgtattccctggtatcatcgcagtgatgtcttatttatctgttaatccaactgtttatgaattagtgaatgaaaatcagactgttatagtagaaaacgtattggctaaacaatatacagatacgaaagggttatttttgggaatgttggtctccatcctttctattgaactttattgctggttgaggaaacagaagaaactacagctgagaatgcctgataccgtgccaacgaatgtttctgctagtttttctgctttattcccgacgattctgactgtatcgggtatcgcggctgcgggatttatcatcaaagaacttacaggaatgtacctttatgatatcatttacaatgtcgtacaacgcccattagaaggtgtcgtacaagggttaccgggtattttgctattgatgtttattgcgcaagtcttttgggtgattggtatccatggaaatcaaatggtgaagccgatacgggaaccgttgcttttagcggcaattgctgtaaatacggaagcttttgaagctggaaaagaagtaccgaacattattactatgccattttgggatatgtatatgagtatgggcgggtctggagtcacgatcggtttactgattgcagtattgttagttggaaaacgggaagatatgaaacaaatcaccaagttatcccttgctcctgggatcttcaacatcaatgaaccagttatttttggtatgccgatcatgctgaatccaattttagctattccgtttatcttaacgcctcttatcactggaacgattggttattttgcaaccgctttaggatttgcggcgaaagcagttgtaatggtcccttggccaatgccgccgatcgtcaatgcttatctggcaacagcaggaaatatcggtgcagttattacgcaacttgtttgtattattgtttctattttgatctatctgccatttgtaaaagtagcaaatcgtgtggaaaatgatgggatctaaaaaacaggaggaaatcatgaaaattactattccaaaaaattttattcttggtgctgcatcttctgcttggcaaacggaaggttggaaaggaaaaaaagaaggacaggattcgtttatagatagctggtataaaaatgaacattttgtttggcataatgggtatggcccagccgtagcaactaattttatggaacaataccagcaggatgtggatctgatgaaatccatccatctgacacattatcggacttctatcaattgggctcgtttttttactgattatgagaactgtatagtagatgaagaatatgctcagcatataagtgaaatgatcgactctttgatcgaagcagacgtagaaccgatgatttgtttggaacattatgaagtcccagcttttcttttggaaaaatatgatggctggtcttcaagaaaagtagttgatttttatgctaagtatgctcaaattgcctttgatcgttacggtgatagggtaaaaaactggtttacattcaacgaaccaatcgttccccaaacgcgttgctatttggatgctgttcgctggccgcatgaacaaaacacaaaaaagtggatgatgtggaattatcataaagttttagcaacggctaaagcagtagagatttaccgcagcggaaattatggtggaaggattggctgtattttaaatcctgaaatggtctatgctcgatccaattctccagaagaccaaaaagctgcttatatgtatgatttgttttataatcgagtattttttgatccgatggtaaaaggatactacacagaagagttcctggagttgtgtcaaaaacaatcgatttatttcgatcctgcaacagaggatttagaaacgattcagcatcatacagtagatttccttggaatcaatcaatattatcctaaacgcgttcgcgcccctcgttatcaatggaatgaagagacacctttccatcctgaacgatattatgaagtctttgatttacctgggaagaaaatgaataattccaggggatgggaaatctatccgaaaatcatgtatgatatagccatgtatctaaaagaaaattatcataatatcccttggctgataacagaaaacggtatgggaagagaatatgaagaacagtatatggatgagaaaggaatcgtgcaagatgattaccgtatcgaatttatcggacagcatttgcattacttgatcaaagcaacagaagaaggcgcaaattgcgaaggctatatgttatgggcattcactgactgtgtgtcaccaatgaatgcatttaagaatcgatatggattagttcgaatcgaattgaacgatgaacgaagcagaacattgaaaaaatctgcttcgtggtatcagactttgattgataagagagaattggatttgcctgacgaaatctataaataaatagaagttttttgtagatgttcattgtatttactggttatttgaaataaaagaggttgtgaatccagcgttttgagctaatacccagggtcagctgattgaacaccgtttattgagaggttgtgaaaaagctgtcctgcatcaagtaataagaatagcaaagtaaaaacaacatcttatgtttttaacttggttggacttattaccgcagatgcaagcttttgaataccgtttatttgaaaaaagttgtgacaagttttgtgtcacaactttttttgtgcacgttaaaagaaaaaaggtaataaaaattaatttgtgtgtttagtgtgcgctttcttttttagtgtgtatgcaacttggtatagaccttaaatgtgatgatatcaactttttaaagcgcttttaaagttggcacgctacttgcttatatacaagtgtaagtatagaaaggaacgtgtttaaaatggaaaagaaaacaatcatgcttgtatgttcagctggaatgagtacaagtctcctagtcacaaaaatgcaaaaggcagcagaagcaaaaggaatggaagcagacatctttgctgtatctgcttcagatgcggataatcaactagaatctaaaaatgtagacgttttacttttaggaccgcaagtacgctttatgcaaaatcaatttgctgaaaagctagcacctaaaggcattcctttagatgtaatcaatatggctgactatggcatgatgaatggtgaaaaagtactcgaccaagcagaaaaactaataaacaaataataaaaattatcggaggatacaataaatggaagatcaaaaaaatctagaagccatcatgggtctgatcatgtttggcggaaatgcaaaaagcgatgcaatggaagcgattgctgctgcgaaaaaaggtgatttcactttagcagatgaaaaaatcaaagatgcagaggaatctttagtccaagcacatcactctcaaacagagatgctgacacaagaagcacaaggaaatcacgttgaagtcacgcttttgacggtccacagtcaagatcatctgatgacatctatagcttttacagatttagcaaaagagatcattgatctgtatcgtcgattgaacgcgtaatctacagtaaagaaaagagggaagatttatggataaatttgttgcatttatggagaaacattttatacctgtagcatcaaaaattggtgcacaacggcatttagttgcgattcgggactcatttatggtgagtatgccgttaatgatcttaggagcattagcagtaatgatcaataacttaccgattcccgggttccaagaattgatgaactcaatttttggtggtgaatcatggaaaggattcggggctgctgcttggaacggtacatttgccattctttctgtcttgattgctttcttgcttgcttatcatttagctaacggctaccgaaaagacggtgtttccgcaggtgtgatttctttaggctctttcttcgctttaggcggagcattaggtatgagctcaaacggtttgtttattgctattattgttgggattatttcaacagaaatctttgtacgtttaagcggaaatgaaaaattgatcatcaaaatgcctgatggtgtgccaccggcagttgcaaaagcatttgcttcattactaccagcaatgatcactatctctgcgtttgctttagttgctgcaatttttgctgcattcggtgttgatgatatcgtaggttctttctatacagtggtccaagaaccatttatgggacttgcaaactcttatccatctgccttactgcttgcatttatcacaccattcttatggttctttggtttacacggagcgaatatggtcgatcctttgatgcaaacaatcaatgcgccagccattgaagcaaacgttaatgcaatcgcagctgggcatagcgcaccgtttatcgtgaacaaacctttctttgacagctttgtcaacttaggaggaacaggtgcaactttaggtttactgttagctatttatttagtaggacgtaaaaacaaaccatatatggttgtaacaaacttgtcgattgcgccaggtgtcttcaatattaatgaaccaacgatgtttgggttacctatcgtgttgaacccgatcatgttcattccatttattttgacaccaatggtcttagttagtgttgcttactttgcgacttctacaggtttagtgccagcagctaccgttatgcctccatgggtaactccaccaattattggcggtgtattggcaacaaaaagtattgcaggtggtgtactagccgctgtcaatttggttctttctattttgatctatctaccgttcgtcaaggtagctacgatccaagaaagaagaaaagaagctttagatgcttgattaatcaaaaaacggagaacaagtgattgttttccgttttttttttacatcactattgttgtcattgctaattttcataaagacttgtataatttttgtaaacgttttattttagtcggaggtttaaacattggttacatataactggatcaaattaagagaacacccagaattagtaaaacaaagcgcgaattggttttcatcaaaatggggagttcctgctgttgtgtatgaggaaagtattcgtactggaatcgctaataaggaaagtattcctcaatggtatgtggtcttagatgaaaaagaaaccatcgtcggaggagcgggcgtcattgaaaacgacttccataaccgccctgatctgacaccaaatctttgtgccctgtttgttgaaccggaaaagcgtaagcaggggatagccaagcggatattagcggaaatcagaaaagaaatgcatcaacttgggtacgaaaaactttacttaattacagatcataccacgttttatgaacgatacgagtggacatttttgacaatggtcaaggaagaaagtgggacgaccgctcgtctgtatcaaagtgatacgatagggtgaaaaaagaggcatgagatttgaaaaattctcatgcctctttttttttgcttgttctcttcattgcttttttttcgtcgtaaataaaaatgttccttacgattctgagaataggacgaatcgtcaagaaaatagcaccagccaaataaaaataggtgccatatcgatcggggattttagttaaggaagcaaggcttccaaaaatatagaaaatcccggttaataaatcgacagccagtgagatcaatgtgtaacgattttggaaatagaagcggaagcgacgtcctcgtatttcgatatcttcttcttttcctatttcgatctcatgggtatttcgtttgattttgggcataaagaaaatcacctgtattttttactgaattcaaggtttcaaaacaacttttatatttttatcttcttttttgtcaaagatctcatatgcttgtgctgcttctgatagtggcagcgaatgagtaatgatttgtgtaggatcgaatagtccttctgcaatcattgcgtaaatttttggcattagatggataattggtgcctgtccatgcttgacagcgatatcccgcataaaaaattcttgcagcgggtaagaagaagctggagtcatataaacaccagttacttggactgttccaaattttttgacagcttgcgatgccatctgtaatggagagattgtgccgctttgtaagcttactaaatttttcgctttttctttgacaggctctaatccgtccattcctacacaatcgataatgacatctgcgccacctttagccagttcatacaattctgttccagcttgtgccgtgtcttctaagaaataagtttcaaccccattgtaattagccgctttatctagacggtgctgtactggatctactgcgattacgcgctctgctccagccataacagcgaatttttgagcgaatagaccgactggaccagaacctagaatcacaactgtatcgcctttttttactcctgcgttttcaacgctccaataagctgtgggcaaaatatctgatagaaataaaactttttcatcaggaagatcattatctggtacaacaaatgaagtagagtctgcataaggaactcttagatattccgcttgaccaccccaatgattaccgttcaacttgccaaatccgaaaagcccgccatataactgatctggatttgattcatcacattggctttccatgtgattcaggcagaaatgacaatgaccacaactaatattaaaagggataaccacacgttgcccttttttcaatgtttgaacttgagatcccacttcttcaacgattcccattggttcgtgtcctacaacataccctttttccaaaactgcttcaccatgatggtaaagatgcagatcggagccgcaaatggctgttgctgtgatacggatgattgcatctgttggttctaatatttttggatcatctacgtttctgatttccattttctgttttccttgccaagtgactgctttcattggagatgctcctttcagattcataaaattgtctgcattattagtactacagataatttcattttaaaggagatcttacctttttgataatgaaacgctttttttcttaaatgaaacattctatagtcttatgtatttgtgttcggagaggtgtgtttccgattttttagtgtaatggtaatcattgaaatagttgtatccgttagatgatgttggattggcaagagagtaaacgttgaaaaaatagttgttttcaaaaagaaacagacataaataaaaagaggttatgacagaagggatcagtttctcggtattaagtcaaatttatgcaaaaacgtgaggaaccattttcacaaaatttttcttcatactcgaaactaaacgcctttttcataacctcttggtaaacggtgttcaaaagcttgcatctgcggtaataagtctaaccaagtcaaaaacataagaagctgttttagcttggctgctcttattacttgatgcagggcagctttttcataacctcttggtaaatggtgttcaaaagcttgcatctgcggtaataagtccaaccaagtcaaaaacataagaagcagttttagcttgggtgttcttattacttgatgcagggcagctttttcacaacctcttggtaaacggtgttcaaaagcttgcatctgcggtaataagtccaaccaaatcaaaaacataagaagctgttttagcctggttgttcttattacttgatgcagggcagctttttcacaacctcttgattattcaaacattttttttgcggcacgagctagagtaggaatatctttgtcgtaacgcggtgttttgacaagacgggacataggaatacccgcaaaatggaaagcagcgatttctccagaacgtacagcactttgttcagtaaagatcatctgataaggctgctcgacaaattctcctgtaaaggccagattggtcgaatgtttaggaatgacttttggtcgatcgcttttggcacgattattgaacaacgcggaagcataaggcatatagacagggatattatttattacgctgtcgaaaatttctgtttctttttcacgaatattcactggtccaggatctacttttgaaagttgtccaatcagttcttctagcatttcttttccattcattttaatatactgtttatccacaaattcgccacgtcgtcttggataaaggaaataaccccaaataactgtttcatttggtttctgagacgtaaaatgcggttgatgatgcacgacgatagacatattgacatctttttggcctaacggcgtgatcggtgtggttgaaataaatgaattcaaggcatttcctggttcttgagtcgtgatacgggtgatttcattcaacaacaaatggtttttcgtcgtcagggtaaagctgacccattcgcttgcatctcgatcagcaaagaatttgtcaggatttcccaagttgtagaaacgttcactggcttttttccagagactagaagctgcaccataatccatattttctacagctggtgtttcgtaatctcctaaagtagctgaatctgtaatggacccattagtgaaaataactgctgtatcttcatcgaccacaacgtattcttcttcttgagtcagtgtattggtaattttcaaaccagtcacagtgatttcatcttgcatcggtgtttctttgaattcccagtcagtgacacggcggttcaaaatgattttgcatccttgttctttcaagtactcgatcaaaggaagcataatactttcgtattgattgtaacgtgttcgattgacgcccactagatgttcgatttgagtgaattcataaatcatttgatgcatatagcgacgcaattcttgagcagaactacgtgttctgaaagcaaatgttgtttcccacataaaccagaagtttgtttcaaaaaagtgtggatcatctttgaaatattcttcgatagtgatattgtctagtttttcttcttctgaatcaggcatagcaatcagtttagtcagaagaatacggtctttattattgaatcccagttttccgccatcaatgattcctttgccaccttccatcaaacgtgctttgtcaaaggttcggtgttttgcatcaaaatctctcgtatcttcttcagcagtcatccctggctcagtaacagaaggtattcgacttaacagatccatcaaatctacataggtacggtaattaagcatgcgaccgcctcgagcaatatagcctttttggttttctaatggatggtttttattccaatattcatccactacagtgtcggtcggtgcaccatcatttgaaccgtgatcatccaatgaataaaaggtgatctgatcccctttccatttgccttcttgaatcaaataaacagccgctgccatattggcaataccggcaccaatcattattgctttactttttctcattgtgattcctccaatgtcttccaagtatgtccgtagtgattcaactaaataggatgctagattgattcgaattcatcatataaatgactgtcatcttcgaatagtcctgtcttttttcctagatatgcagcgccaagggcaagcaaacctaaaccgatgccgactttgattaattttttactcatgaaaaacgcctccttgttttctctttctatatccaaggatagttcgtttttattagaatgccaaatgataggacgagaagaaaaaggaaattttgacaaaaaagaagaagtgtctgattttcctgtaaataaaaatagggtaggtaagaagaaaagatttgaggaggtgtatggttctatttttagaaatttgggtacaaaaaaagcaccgagacagtgcttctttgaaaagctgatgacggactaagccttattttaacttgctacgttgttttggatacttccacgatttatggatggagggagaaaaatgggagagtgaaaaagaaaaatttaagcgaaccgttatcattagaacaacttttaaatagacgaacaaggtaactttcttttacaataaaagaataggaacaaattaaaagaaagtaggtagcgtatatgtttcgctcaaatttaattgaatttctagaatggatcattgctattttaaatatttgttctatcggtatcttaattgtcgggatcgttcttgttctattcaaactttttgattggtctcatgtcaagaaaaactatgcagaacgtaatactcgtaatgcagatacaagaaaactgctagcaagttatattttgttaagcttggaagtactagtcgttgctgatatcatcgagtcagttatcaagccgacttggacagatattttgaagcttgcacttattattatcattcgaacagtcatttcttatttcttgaatcaggaaatagaagacaaagaaaaacaaagaagaggagaggtaggatgacgacagagttgatgcagtttcttcttccatatttcgaaaaacttgtactgggacttgatatctttgctatctgtttattggtttggggtgtttgtctatcaatcaaggattttttgaaatatttatttgtccatacaaaagtgcaaagcgaccgagtcagcgagaacaatgctattaaaaagatgttgggaggctatatacttctaagtttggaaattcttgtttcagctgggatcatcgaatcgattatcaaacctaccttgcaggatattttccaactagcggcgttggtagttatccgaaccatcatttcttattttttaaataaagagatcggacccgtagatgtccaaaataagtgaggttgtgagcctgacgtgtatcaagagattgttacagaaatgggcatcttcaacaaataagaggctgtgacatgatttttgtcacagccccttatttgttttgcacagctgaaatgatagctcgatcgatcgtattgatcgaaataggaataatattttcatattggaccgcatctggtgtatataatgtacgttcacataatacccggtttgaggactgctgcgcatacttctttatatcagatatacttgaataaattgttggtgcaacttgaaaatcgaaagtagttacagcttccaaggcttcccgataaatcagataatgaacatccgaatttgtgacgatatagatagtcagatgttcttttgtcagacggagaattccgctcaattcgatcacaaaagcccgcatgcaattaggattcaaccgtagatcataaggtaactggctggaccagctggaaaaaattgtctggacttctttatataaatttgtctgttcctcatttaaaagataaaatttttctggcatgaataattgatagttatcccaagccgaacgcatcagatgaatcagcgcacgttcgaacggttggtttccgaataattcttgattgaagtgagattcaaaggtagcaactagttcttttatttcgggagtattgtcaataaacacttggtgtagctgttgaaagtcttccgcaatcaactgataagaatggaaaccataattacaaagattgaatagtgtcaaaataaaggcgaattcttcttttttataataggtttggaaatcagtgttttcccatgctgattcgacataattgtaaataggacgttttttgatttcttcgataaattttgaatctattgtcacagcacacacttgctggcgtaggaaactgatagcaaaaccaatcgataagatttctttattttctttatcataaaatctgccactattttccgttacggattcaatgaaacgatcggcacgttcaaaaaacgattcaggtagctcccaagaattaaaaccgcctaaacgatacgacacattaagaagcagcagacgtctttccatttcagtgaatcgaggggagtagcggtcgatttcgatcccgcagtcattaaaataagctaatacttgtttttttaatgaataagctttgctgacagagatgaattcacattcagttaattgaagataatcaggttcatcttcttccaaataaagcagacaagtttttaaaaacaacgaattttgagacaattgctgcatgatcttgcatcgaggtatatgttctgaaaaatataaagtgtaacggtccttttcccgatgtgtataagcgatctgttcttcaaattctttttttatgttattgatatcattgagtaaagtggttttgcaaacatgcaggagattggagagcttttctagattgacttctttatttacatagaattgcccacataaaaacagctgtcttaaaatatttttctcaatatattcttcaatcatagtagagcctccgccttgtatttttttgcacaatatgggaaatattatgacatgttttctttttgaaatcatcagttaatttctgaaaaagcatataaatgccgttaaaaaaggttttttatgttataaaatttggaaaacagataattctattaaaaaataaattgcgaatttttaacaatataaaaaaataaaaatatgtttagtgaatgaaggacagtcattttatttgtttgttcgctttttttaggttatctattttagaagactgatttattgaaaaattgttcgcttttttgcgttgaattatcagaaaaatccgactttatttatttttgtttgtaaaaatctacgtggatttgatgttataaaaaaaaaattctcatttttggcgctatagtgaagaggtgttacagataaacacatgtatctgcaagacattgaccaacaaaatatggagggaagaaaaatgaaagatatggatatcaaggccgtctttataggcgacaaagctgaaaatggaccagtttataaaatgttgttgaacaagatggtagatgaacatcttggatggagagaaaattatattccttcagatatgcctgcaattagcgaaggagataagctcactccagattatctagccacccgcgaccatatgatagaggtcttggatgaagtcagtcagcgattacgcgcaggatcgatcccatggcattcagcaggccgttactggggacaaatgaatgctgaaacattgatgcctgctttattagcttacaactatgcgatgctgtggaacccaaataatgttgcattggaatcttctatggcaacttcgcaaatggaagcagaagtaggacaggattttgcttcattattcaatatgacagacggatggggacacattgcagcagatggttctattgctaatcttgaaggattatggtacgcccgttgcatcaaatcgattcctttagctgtcaaggaagtgctgcctgaaaaagtgaaaaaaatgtctgagtgggaacttttgaatttatctgttgaagaaattttggaaatgaccgaaagctttacggacgaagaaatggatgaggtcaaagcagcttcttcccgtagcggaaaaaatatccaaagattagggaaatggctggtccctcaaacaaaacactattcttggatgaaggcgttagatatttgcggagtcggcttagatcagatggttgctatcccagttcaagaggattatcgaatggatattaatgctttggaaaaaacaattcgtgaattagctggacaaaaaatcccaattctaggtgtggttgctgtcgtaggaacgacagaagaaggtcaagtagacagtgtagataaaatcgtccaattaagagaaaggttaaaagatgaagggatctatttctatttacatgttgatgccgcatatggcggctatgcgcgttcactgtttctaaacgaagcaggagaatttgtgccgtatgcttccttagctgaattctttgaagaacatcatgttttccaccactgcgtaacgattgacaaagaggtatatgaagggttcagagctatttcagaagcggattctgtcacgatagatcctcataagatgggctatgtcccttatgctgctggaggaatcgtaatcaaacataaaaatatgagaaatatcatttcttatttcgcgccatatgtgtttgaaaaatcagtaaaggctccagatatgttaggagcttatattttggaaggatcaaaagctggagcaaccgccgccgcagtctggacagcacatcgtgtattgccattgaatgtgaccggatatggtcaattgattggggcttcaatcgaggcagctcaaagattcagagaatttctcgatcatctgacttttactgttaaaggaaaaacaatcgaagtctatccattgaatcatcctgattttaatatggtcaattgggtattcaaagaacaaggctgtacagatttgaacgctatcaatgaattaaatgaaaaaatgttcgatcggtcttcttatatggatggcgatgtttatggtgaacggtttattacttctcatactacatttacacaagaagattacggtgattctccgattcgttttgttgaaagaatgggtctaacgaaagaagaatggaaaaaagaacagaaaatcactctgctacgtgcggctatcatgactccttatttgaatgatgatcgaattttcaatttttatacaaaaaaaatcgccaaagcaatggaaaagaaactaaacgaaatcatccaatagaactgatttttgtgtgaaagaataacaagagacatatggagaacagacaattatttgcttcatcaaaacaattgtatttccccctgtttttcatatattcctcgccaagatattcttttttataaaacgttctataagttggatcgttcgtttcatgtatcaaacccagttcactaagatcgttcaatggatgtttcggtgatactgggttttgtactgaatcgatgaaaccttgtcatttctgttcttgaacaaaaataaaagaaaacaaaaacatatgtcgctattgaaagaaggaataaagatgaaagatactggttcatcaaagcaaatcacgaccatgacctttatcggaatgacctgcgcccttgtagcaagtgtacgaaatattccagatgtagcagcaacgagctggacgatgattttttacatgctggttgcagtattattgtacgcttttccaatctcattgatctctggtgaatttgctggaatgtttccccaaaaaggtggtccagaactttgggtatcgaatgctctaggaaaaaaatgggggttcgttgtctcatggctgttatgggtccaaatgtttcctgggatggtgatggtcgcttcagcactcgctccgttgtttggtaatattatcgataatgtgccgcttggtttgaacagcaaatttacattagttgtcattttagtcgtttattggatcatcacttttttgaatttgaaatttgatatggcaaaaatcggcggaaaagtcggtgtttggttaggattgtacgtgcctttgacgatgatgctcttattagggtttgctgcgtggatcaaagttgggatcgtaccaaccggaacattaggcagtttttcatgggacaaattaataccagatactacgactgcatcctcatttgtttattttgcgccgatcatgtttatttttactggtatcgaaatgtcctctgtgtatatcactcgattggaaaatccagttaaaacgtatattcgcggagtatttgccgcgttaatttttatatttttcgtcaatattttgaatgctttagttgtagcaaatgtcgtaccaaaaggacaaatggaattgaataatatcgcgcaatctatttcgatttattgccaaattcttggtttgccacatcttattgtgaatctgtttagtttacttgtcttcattggtgtagcagtccaattatctgcttgggcctcaggaccagcaaagacagtgacagaaagtgctagaaaaggtgcgtatccaccaaaattcaatttttggaagacgaatcaatttgacgtatccaaatccgttattttgactcagtctgtcattatctcaatctttgcacttttttatttgctgattcctggcgtcaatcaagcatttttgatgctcgtaaattcaactactgttatctactgtatcgtctatgtcatcatggggatcgcagttttgagattgcgttatacacatgcaaagttgaatcgaccatttagaattggaaaaaaagagaaaaagagcaatcttggagtttggactgtcgttattgttttatttgcggcaatcggattttctgtcggactgacgatgaaagctggaacatggatcaatctaattgcagtcacagccatcagtgtcattttgtttgtagtaccactctgtattgaaaaaataaagaaaccttcttgggaacaggaagtcgccatgctgcttgaaaaagaaaaaggtgaacttgatggaaaaaccggcaatgaaacggactctaactaatcgaaatatccagttaatcgcattaggtggcgcaattggaacaggattatttttaggttcagcaaaggcaattgcatcagcagggccagctgttattctcgtttatttgatatgcggtttggctatttatggtttgatgcgggccatgggtgatttatttttagcaaatagtacatttaactctatcagtgatttcgttgactattatttaggcaaaaagtgggcattttttgtcaattggacttattggctttgctggcttggagctggacttgcggaattaacagcaataggattgtatatccatttctggtttgtacatgtaccagctttgataagcggaggtagcgcactaatgatcttaatggcagtcaaccttgttgcagtcaagtggtttggtgaattggaatcttttttctcaatcatcaagatcttggggattttcctttttatcttattgggtataggattgagtgtctcagattttcatacccagtctatcggaatcaaagaaaattttggacagatcgatgaattactaccgtttggctttgctggaatggtagtctcatttcctatggttttattcagttttgctggaattgaaatgatcggcttaaccgttggcgagacaagtgatccgcaaaagaatttgaaaaaagcaatcaactgtctgccttggcgtattctctttttctatataggaacgattttgtcgattttatttgttgttccatggcattgtttagatttaaaagaaagtcctttagtgactatgctgcaagtgatccattgccaaggcggagcagcaattgtcaatctaatgattttggttgcttctttgtcctcagcaaatagtgcagtctacagtactagcaggattttatatcaaacagcaaaagaaaaaagtttgccccattggttttgtgcgctttctaagaaaggcgtacctttacacggtattttaattacaggaatgttattttttgccggtctttgtctacatttttttgtagctgatagtcgattgttttttcagcttttggcaggcatgacaacgagttgttttctatttgtgtggtcttcgatcttgtgtgcacatgttcaatttattaaagaaaagaaacggaacactacacaaagatataaagatcttgctttgttggtgttttttacttcaattgctttcagcttgttattcgaaagcacgacacgctttattccttttttattggttatctggtttgtattcttaaattttgtatataaaagaataagcaatagaaatatcagttaggcccagatacattttgcaaaacgaattatttcagacccccctgaaataatcgatacgcctgaaaaaacttccctgcgtataataacagtatcaattaaacaggaggggataggatgaactggtacagattgacggtagaagatgtattgaaaaactatcaaacatcaacagaaggcttgtcgcaagaagaacgacagaaacgcctgactgatcaaggatataatgaaataaaagcaaggcagcagacaaaacgatggaaaaaaatagcaaagcattttactgatctgctgatgatcgtgttgatcattgcctcttttttgaaatttgcttctagtgaatatattgaaggaagtattattttattcgtagtgatcgtcaatggactcgttagttactggcaagaaagaaaagcggaagaatcattgaatggtttgaagcagctgatgggacaagaagcgatagtactatcaaacgggatgcaagaaaaaatccctgcgaaagaactggtaaaaggagatgtcattgtcttacgtgccggagatgtcgttccagcagatatccgattaatcgaagcacatgatttattagtggaagaatcgattttgacgggagaatcagaagcatctgaaaaaagtcatgccgttttgacagaagaagaatcgatcggcgaccagaaaaatatgggtttttcaggaacgcttgtacaatctggttctgcagtcggtgtcgttgtagaaacaggaaacacgacagaaatcggtaaaatcaatcaagcattgcaatcggtcgaacaacaaacgacgcctctgattaaaaaaatcaaccgattaaacaaacaaatttttcaaggcattctttgtttgagcctattcttagttatttttacgacatttcgatatggtatggattggcatatccttctttcggctacgattgctttggtggtgtcaatggtacccgaaggattgccagctgttttgaccatgattctatccgttggagtacatgaaatggcaaaagaaaaggcgatcatcaaaggacttccttcggtagaaacattaggttctatgacagtgatctgttcagataagacaggaacattgacaaaaaatgaaatgacagttgtggatgtagctgcaaaagaagaagcctgcgtgttgtccattatgaaaaactgtcaggaattaaaaacaaaagaagaacagaaaacagaaaatttaagtggcaatccgacagaagttgcgctgattcgacacacagaaacagccaatctacctttgaaaaaaatagaagcaaagattccgttcagttctgaatacaaatatatggcaacgatgcatgcggaggaaaaaggagcggtgatttacgtcaaaggtgcaccagaagtattatttgctaaatcaactctttcttctgcagaacaagaagcatggagtcagacagctgcagaatttgcgagaaaaggtcagcgtgttttaggatttgcttataaaaaagtagattcgaaacaggaactcacgcatgagactttaacccaattaacttttgcagggatcgccggattgatcgatccgccaaaagaaagtgcagtcaaagctgtaaaggaatgccaacaagcagggatctcagtgaaaatgattacaggggatcacaaagacacagcaaaagcgattgcggaacaaattggcttaaaacatactgccaaagttttagaagggatcgatttggatcttatgtctgatgaagagttgattcagcaagtgccaatagtcgatgtctttgctcgaacgacaccagaacataaactgcgaattgttaaagctttgcagaaaaatggagaaatcgtcggaatgaccggagacggcgtaaatgatgcacctgctttgaaaagatccgatgtaggaattgctatgggaatcaaaggtagtgaagtaagcaaacaggcagctgatatggttttaggagatgataatttccatacgattgcaaaagccgtaaaagagggccggcggattttggataatttgcaaaaaaccatcaatttcttcttgccaactgcattagctcaaggattgatcttgatttgggcacttatgctgaatcgcccgctacctttgtccccagtacagattttatgggtcaatatggtaacgacaatcactttatcttatgcactagggttcgagtcgccagatccagaaatcatgaagcgcccaccaagagatccaaagcaaggaatcctatctggttatcatttgtttcggatcatctatgtctccctactgatcatggttcctgcctatttattggctatgcagtttgaagggcaaagcttacagcaaaccattcttctgcaaaatatcgtcttagctcaagctgtttacatgatcaattgcagagagttgtccaagccgtcattgaaccaaggtcttttgcaaaacaaagcgctttttctttcattaggtatccttgctttattgcaagggatggttatttttctaccagtcggccagcagctgatcggtacagtaagtttaacgatgacacaacagttattgattggagcaaatgtgattcttctattcttagttgtagaaatagaaaaagggatcatgaacaaactgtttcgcaaaaaagaaaaaacagctagagaatacagtcgctagccgttactataaaaaagttttgaaagtgagttcagtcaaacgattgagctcatttttcgttggaatagaagaaatgtatacaatagggatatctagagaatctagagggaaattggaaatcaagatatctgttttttcaaaagaaatagtggaaagatcggttagttcgataggtaagaagcagacacgttttcctaagtaatcttttaattcctgctgcaagaacgccttccatgaaggttctccttggaaaataaaatagacattgaacaaattcggtttgatagaaaaaatcgtttgttggatcagtagagacaagagttggagaaagtaatttggttcattgatttctatttctttttttagatcgttcagtaaattctctttctgttgatacaagtgtgcatattgctgatcatatgtttctaaaaaacgatggtattgacggtccaatgcttcaatcaatatcggcgattcatgatattttaatatgaggagagccaagttatcagtcagagatgttttttttagttgatcaagagacagctctgaagctagttcctctacaaacgtttcgaggacctctaaaaatggagaatgatgcaggcagcgagcggtttcttgtccatagttattgttgtaattccaactttccagaaagcagaaagaagcaaaagaaagctcagtgtctttaagataaataccttccgttaaatacaattttttcaatgcagagtcatacagggaggagagtgtgctgttggtatggatagaagaatctaatcggcaattcgcttttatacggatcgtattgataaagaaccaacatgttccgaaaatctcttctgtttcaaccgctagttcagtttgactgaggtttcttaaaaattgaaaataatgggattcatggatcgaataatcctcgaaaaaatagttgttatgagtgaaaggaatcagcaatcgatgataaaaagtacgaatcgcacgctcttttccaagaatacaagctgtatatttcgtcaaatcgatctgcaagtcgtaacttgctaaacgctgattgattttagtcacatgtcttttcaatgtcccataagaaagcccatggtcggctagaaaatcagggacagcaactttttttgtaaaaagcagatttttcagcagttcgacactgactgattgtttgaaaaaaatctcccaaaggtcatttgttaataaattttgctggttttgcaaactgattcctgcttgatcgctgatgatgtcccagccttcgggcagctgagagcgaatagattgaaggtcagaaaaaatcgttcgttcggttgtccctatgatttcagctaattcatttacggttatctttgtatgattcagcaattgttctactaaagaaacatgacgtcgaatatctttttcggtaatgatttttttcattagtgaatacatcaatcagactcccttctattctaagaatacggagaaaataaacggtggtcaagtttcaactgatttttcaatcattgtttatttttctggagcatttactgatgataagaatttcatcatgaacttgaaaaatgataccactaaaatcaaaaaataggtgggcaaacaataataaacattttaatagtagatggtagcaagaccaacacaggcggattgaacatttaagagttgataaaaaagaaaaatatcgaagtatttgattagcaactacttgtattcatttttctattcttacgtggtatctttgaataaagcgaatcaataagaaagagatggaagcagatgctaacgaaaaaagaactaatcgatcacatcaatgaaacatacaatttgtctccagaatatatttttaaaaaatttcctgattattgcgtattcagacatcaaaaaagcaaaaaatggtttggggtcctgatgtctgttccagaagaaaaaatctatgatgatgcaagtgaccataggatcatcaatattcttgatttgaaggtcgatcctgaacttggcggaattttgcgaggaaaagaggggtattttccagcctatcacatgaataaagaacattggatctctattgatctacgtaaaatagaaaagctagatgaactagcagatttgattgatggaagttttaaatcaacgcaatgaatgtctaggacaatagagaagaggttgtgacagaaatgtttagcttcaagaaataagaaggaatttacgaaaattgcttctcaaatttttgggaaatttcggcttattttctaagaaattacttctggaacaccgtttgttcgaaaaaagagctgcgacaagaattttgtcccagctctttttttttattttcctaaataaaattcccgcatcgtttttgcaatcattttgatcaaaggatgatcttctgtgaagctagaagataaataaattgttcgtgtcaagggcaaatctttgatttcccgcaagacgaaaggatcatttttatcgtaagaccaagaaacttttgggaaaaagctaacagctaatccttgcttgacaatagaacgtaatgtcgcaggatcatctgtcgtcgaactgatcgtcaattcgatacttttcgcttcaagtgctgcatccagtgtatgacggaaggcgttgctctttgacagcatcaagatgggggtgcgttggatatcttctaattgcagatgttcttttttagcaagaggatgtttcttaggaatggcgacataaacaggttctttcatgataggaatattggtcatgccaggcttcatctccgaagtgatgtacagtacaggatcggtaatatcatctggtaaatgatgttgcatgatcgttaattggatatcaggatgcttttccataaaaattcggaccaagttcggaatagaaacagaggctacctctaaatacaatatgacggaagtaacgatcttctcattgaccgaagacaataatttgattccttcttctaatgtgtctaatgtcttgactgcatatggataaaattcttctgcataaacggtcgtctcaatgtttctgccgctatggtaaaacaaagggacacctaattcgttttccaaatgtttgatcgcacggctcaaggcaggttgagaaataaataattctttggctgcttgggtaacattttttgtttcgaatacttttttaaaatactgcagatgaagcaatttcataattatccatcccatccatacctttttgttatggttttttctttttttggcattttttattatagcagaaattgactaagatagcagtggaaaaagtaagtgctgaggaggcgaggctcatgagtacaggtttcttatttcctggacaaggcagtcagaagttagggatgttagcggatatccctgaaatgtacatggaacgtttagaaaatgtgacggggtatcggttagttgataaagaagaaaactatcaagatacggtttttatccagctagcattactgacaaaagcagtattttatttagatgaaatggaaaaaaacggtattcagcctgatattgcagcaggacattcgattggtgctttttgtgcagctgttgcttgtcgatctttgagatttgagaatgcagcggaactagtctatcaccgcgcagtcttaatgaaagaagcttatccaagcggttatgcaatgggcgtagtagtaggtgtgacgagaagcgaagctgaggaaattgtagcaaaaacatttgatcctgaccatccagtttatctgtcaaatgaaaattgtccgatgcaacatacgttatctgggagtatcgaaggtttatccgttacgttggcagaagccaaacggcaccaagcgcaaacagcgaagctgctgaaagtccctgtgccatctcactgtctcttgatgaatgatacggtcaagaaattcaagccgtatatgcagtctgtccatctatctgatgctagatgtttgtatataaaaaatacggatggaagagccactcaggacgcagaagagattcgtaaagatttgttggaaaacctagctttccctgtgcagtggaaccaaatgatggacttggcaaaagaattaggaatggatctgacgattgaatttccccccggcaatactttgacaaagctgattcatacaaaatttggtgtagataaagggatccgtacgatcaatctagaccaacatggtattgatgacgccacgtttctatatcaaaaatggagatgactaattatggaaaaaccaaaccgcaactgggcttctaaacgcgaaaaaaaagcgcagcgattggaaaaaatcagcaacttgctcaatggcaagtatgtagaaactgaaaaaatcgtagaagtaatggaaaaactgattgctcccggcgacaaagttgtattagaaggcgacaatcaaaaacaagcaagttttctttcagaaagtcttgaaaaagtagatgcagaaaaagtgaatgatctgcatttgatcatgtctagtatctcacgaccagaacatttgaatatttttgaaaaaggaatcgcaagcaagatcgatttctcttatgctggtgcacaaagcttgcgtgtcgcccaaatgattgaagacggcacaatgaaattaggtgatatccatacttatttggaactttatggacgcttattcatcgatttgattccaaatgttgttttagtagctgcagataaagcagataaagacggcaacttgtacacaggtttcaatacggaagaaacaccaacaatcatcgaagctgcagctttcaaagatggtatcgtgatcgttcaagttaacgaagttgtcgattctttaccacgtgtagatatccctggtgactgggtagacgttgtcgtgaaagcagataaaccttatcaattagaagctttattcacacgagatcctcaaaacatcacagaattgcaaattctaatggcaatgatggcaatcaaaggaatctacgcagaacacggcgtacaatctttgaatcacggtattggattcaatacagcagctatcgaattgttactgccaacttatggtgaatcactagggttaaaagggaaaatcgcgaagaactgggtattgaacccacatccaacgatgattccagccatcgaatcaggttgggttgaaagcatccatagttttggtggcgaagttggtatggaaaaatatattgctgctcgcccagatgtcttttttgtcggtaaagacggcacgatgcgcagtaaccgaacattatcacaagctgcaggacaatatgccatcgatatgtttatcggttcaaccttgcaattagattacgaaggaaactcttctaccgtaacaaaaggacgtttatctggttttggcggtgcgcctaacatgggacataatcctggcggtcgtcgtcattctacaccagcatggcaatcacttcgcgacaatgatgatccattagggaaaggccaaaaattagttgttcaaatggttgaaacatatggttcaaataaaaaaccagtctttgtcgaagaattagatgcactagctgttcaaaaacaagcaggcttagccaatgcaccagtgatgatttatagcgaagatactacacatatcgtgacagaagaaggaattgcttatttgtacaaagcaaaaacaaaagaagaacgacaagcagcaattgcagcaattggcggtgttacacctcttggaatgactagcacgaaagaatcactagatagcttgcgtgcagccggcatcgtgaaattaccagaagatctaggcatcaaacgtagtgaagcgaaacgttcattattagctgcacaaaccatcgatgatttgatcgaatggtcagatggcctgtatgaaccaccaatgaaattcagaacttggtcataaaattggcgagaaaaaccttttgtcgccatttacccagatggaagaagaaagacgaataagcagaacgtgtatgctctgttttacaaaaaggggagagatccatggaacaattagcttataaatatccaacgaaacagccgatcaataagaaaatccatgtaggagtggtcggttcaggagatttggaaatcttgatgtttccaacagaaaaaacagaatctactgtaaaaatttgtacaggaagcgatggcttcggcgaagtatggaacaatgtattaacgagattttttgatcgttatccaatttcagcagatatcgtgatcaatgacttcggtgctacaccaggagttgtgtacctacgattgacgcaagcaatggaggaactttcagatgaaaaatagttttgtagaattaaacgccagagaacgagtgaacgctctacttgacaatggacgtgaattgattgatccattcgatcaaatcatcgcgccaagtttaccagcacaaggaatcgtccctgaaagtgatgacgggatcgttgtcagccgtggcacgatcaatggcaaacaagcagtagtaatcgctatggaaggaaaattccaaggtggcggtatcggtgaagtttccggtgcaaaaatcgttgctgcacttgaacatgtgttagaagaaaataaaaaaggaaatgagatctttccagtcattgtactagatacaggtggtgttcgtttgcaagaagcaaactacggactgttatctatttcagaaatcggaaatgtaatcattgctctaaaacaatatgtaccagtcatcggtttgattccaggacgtgtaggatcatttggcggtatgtcgattacttcagcattaatgagttatttaatcgcaacaaaaaaagcgagagtcggtttgaatggaccagaagttattgaacaagaagcaggcgttcgagaatttgattctagtgacaaagacttgatttggaatacattaggatctcgtcaacgggtagaatcaaaaatcattgatgaattagtgactgatagtgtagaagcaatcaaagctgctgtcatcgcagcaatggacgaacgaaaagacacgcatcgcagtgaaagctcagcattttatttatcattacttgattctttagatctttcaaaaccaatggccattgacgattacaatgaagcaattgctaaccatcaagcaaaatcaattgacttaccagaagtagcagaaggaaatgaaccagctgcagcaagtgttggttacgattggtttgcggcactaactggcatgaaaaatccaacttcttctattagtactgtgtattatggtaaatcaagtaaattcatagaagaagccatcgtgacatcaatcgtacctgatcctaaaaacccgatgtaccgtgtacgaaacggtgaagttggtttagttgaaggtttccgcatgggacaaattttggatcacgtttacgaagaagataaagacaaaaaagtgaaacggccaatcatcgttgtgatcgatgtaccaagccaagcatacggctataacgaagaattgatcggtatccatgtggctttggctaatagtgctgctgcttatgcaaaactccgtcaagctggacatccagttattggattgattgcaggaaatgctatttcaggtgcatttttagcacatggattacaatcaagccgcttgattgctttaaacaataaagaaattaccgtccaagcgatgtctaaagaaagtgctgcacgtgtgacaaaacgttcggttgctgaaatcgaagcagctgctgaaaaagttccagctatcgcttacgatatcaataattatacaaaactaggagcgatctatcatttcctagaagatatcaccgaccaagctgcttcagaacaaaatgtcagcaaagtcatcgaagcaatcaatgaagccattcaagatgtccgcaatacaaatgacacgatgctgacaaatcgatacacaaacgaaacagccaaaacattcggacgtgtcgaaacaaataaagtccgtgccaaaatggacgaagaatgggatgcataaaaaatgattcaagcacatgatattgtcctttttgataaacatgaaatagaagggttcaccttgcctgaatgggtcgttctaactgaaaagatgttcggaacagttcgtcgtgcgtcgacggatcacgcagaaatactaccgattggtttacgtggacctgcccgcaatcagagatggtcaacagaaatctcaaaacatgccgtcaaacaagtcattcatccgtgggacatcatcgaacaagaatcgtatagacaagagaaaatcatggattatcctgtttatcagcaatttcatgctgctagaaacatattatcaggatgtaaatggggaatcggcggcagcttaggatttgaattatcgactgggattccggcagtaaaagaaaccagtgattttgatttgctgctgtacgcaaattcaccgattgaattgccaattcaggtaattcaatcgcatcctgctttttttgagcaattcgatacccaagtagtgactcggcaaggcggtttttcactaaaagagtatttgagagagccagagaaaaaaattctattgaaaacagtcgaaggacctaaattaaccaaagaactttggtaataaagaaaaagagagagaaagagatgtttgaaaacaaaaaaatcaaaatcaacgtaagtgacttccagaaagtatcagctgtaacggctgttatgatgcaaacgatattgagctttgctttggcaaacagccacagcgcaacaaatacagcttttcttggtaccttttacgtcatcgttaaatacacagcaccaatgtttatttttgcaattgtttataatatggtaaaaacaagtcagcatttgtcttattgggaatttttgaaagaaaagttttttgaactagtcgttccgtatcttctatggacgacggcttatctttggctatttccagcagtccaacaacaaactccgtatacggatactgcaagctttttactgaaatatgtcacaggtgatggagcgcctcatttatggtataccgttatgatgctgcagatccaattgttcatgccgttttttgtttggctcggttacaaagtatttgctaataaaaaatatgtatggccagtattgattggttcaacgattttatatgtcgcatggtatctgttctatcaaacacaagtattgactgggccttatcatgacagctggtacttattagatcggtttgttgctagtttcatgatttatggggtagccgcatttgtttatcacgaaaaagtctatcaatatttggacagagtacgttatcttttcttacctgttgccttagttatcgcgttcttttctgtccgttcattgctcgcacatccaggagacttgagctttgcgaatgcaccttacttgaatacgatccaaagtttatacagtttagtcatcatctttgctgtcttcataggcgcttccaaaatgattgtaaacgattcgccaaaattgccattgttcaaatggttgtctgtttatgcttatcgtacgtatttagccaatgtatttgttttccaagtactgttattattgtttaaagatagttggctgcagttaccttcaggagtcatgattcttgtagcttatctaatgacggcaagttgtgcatttgctttaagctggttacttcatatcatttgggtagctatcaaaaaaggtttcagcaagtaatagtaggaagaaggagtgagtgtcatgataaatgacgaacgaaaaaaagcagtgactcagcaactcgctgcgttggtagaggaagcattgatcgcagaagtaacattaagtccaaaacctggattagtggatgcactggatgcgggtgcacattccgatatggactatgctttatttcttaagtctgctaagacgctaactcctttttttgaagaaatggctcaaatagcatggcatcatgctattgatcaggagttaagagaaagaattgctgagattgggcgaaaagcggaaaaggcaatgctgattgctacaaatggcatcaatacccataaaggagcgatttgggcaatggggctattgatcagtgtcattgcacaaaaaatcagtatggaacagcctttttctttatcgaaaatacttgatgatgtcagcaagcttgctgcttttcctgatacaaaatatcgtcataaaaaaaccactcatggtcatagggtgaagcaaaaatatggcgtaaatggtgcatatgaagaagcgatattagggtatccgcatatcaggcttgcaattcaagcagctaaggagctagataatgattcatatgtacagaaacaaatgcatatgttgttagttttgatgagttcgctagatgacacatgcgtattgcatcgcagtgatcagaaaacgttagtggaaatgcaaaaacttgctcatgctgctagtcaaagtgctttaccaaatcgtccatttacagcactgttgcacttttgtcaggaaaaccaaatctctcctggaggaagcgcagatctcttgtctgcaagcttgttcatgctgaagatagaggaattatggactgccgacacatacatttgtccgatgttactcaatgactaaataagacaaaattgctaaaaaaacagtttatgcatctggttattgactcttccttttagcaaggctatcataaaaatagttttttgtaataaaagataacgaggaagacaatgaaaaaaatcaattatttagcaatcattttgttagtgggcctatgtttgtttgctctgccgacccaaggattcgctgtcgcgggtggtcatggtggaggtacatctagcggtcgaagttcgggcagaggttcatttggtggtcgttcatatgggggcagttattttggcagtcgttcttacggcagagattcttatgggtattatggtccaggtacaggtccttctagttatgagcaaacgggatttcttgcattagctgttttgtcagtaggaggggtttctgctttttctatcgtcaagaataaaagacaaaagaaaaggctgaaagcggagatattgtcccgcatgtcaggaacggctaaagaaaagaaagcacagtttctggaaatccaaaagatattcatgaagatccaatccgcttgggaagaagaaactcctgaaaaagccagaagctgttatacagacaagctgtttgccgaacatcagaaagttctgcaaaaaaacaaagcagacggtgtaagaaatcatactaaaaaaataactattcaggaagtaggaaattatcgacagatccacgaaaatagttttgccatccgaattgatttcagatgctgtgattattcagtcgatcgaaaagatgggcgattgatctcaggaagtaagacacaacgacagtatttttctcagatatggtattttgatttttctgagaaagaaaaaagatggcaagccgattttattcagccgattatgctggattgacaggaaatatttatgaacggagttgtgacaaaagccttgtcgcagctcctttttctgaataaacggtgtgccagagatagcctatcggcaataaggcacgattttgtaaaatatgggaagcgatttttcaaaatcgcttcttatcgctcaaggctgaacatctctgtcacaacctctccactaaatggtgtttaaaagcttgcatctgcgataataagaacaaccaaacgaaaaataggaagcactattttagtttagttgttcttattacttgatgcaggacagctttttcacaacctcttttttgtatagatgggcaaaatttttgtaataataggcgtatgtctttttcgttgaggagatgaaaaagcatatggcttattttttgtttgctttgcttactttctttccacttcaagtggcagaaatatctactttttattatgtaagcggaaccatatacttgaaatcagaaggagatcatttctatgaaaacaagaacaattgaaatacttcacagaatcatgacagcccaatatccagtaaaagcaaaacatctagcaagtgagttcaatgtcagtcagcggacgatccgtcaggaagttcttgaagcgaatatctggttgagcagtaaaaagcttccggagatccgtacaattcgcaacaaaggttttttgttgaagctggaaaaggaaaagcaagctcgattagaaactgaaataaaagatgtgaaagacggctttttgaatcggcgcgaacgtatttttgatctagttttagccgttgcttacagccgaatcccgatccatctaaacaaaaaagaagaagaatttcaaatctctaaaagtacattagatgaagatatgagacggttacgagcaacactggtcagttatgggatagagatcgtcagttatggaaagcaaggactggtttataaaggttcagaacgatctatccgtacgatgatctatgattttatcaatcagaatctgggaatgaccgacttctttatgaatcaagatgcacaattaacaccggctcaaaaaatctttctccattattttcctttggtggaaatcaaaaaaatacaggagatctattccaataagttgttgaaacaagaagatgatatttataaaaaacaaatcctgctttttacattgatctggatccagcgaatcaggaaacatgaatttatctctgccattaattggaaaaatacagaaataaaagacagtagcttttctgcatttattgaccacatgatcgaggaatttcaattggacaatgtcccgcaagtagaaagaaattatcttcgtttcactattgagacgttcaatgctagagatatctccaattcaatcgagtgggtacaagctcaattactaacgatccaattgatccaatttgtagagaacgagacacacgtacctttccatctaaaggaagaagctttattcgaaaatctctataagcacatggctgcactgattgtaagaatcaagaatcatatccaagtcatgaatccattgaaagaaaacatccgaacaaattatttcccaatctaccgcgcagtcactcattttgttcctacgatcgaagaagtaattggtggcaagatactggaggacgagatagcttttcttgtcatccacttttcgacgatcgccagtgtaatcaagcgagacttgaattatgtttataaatcagtcgttgtctgtaaccatgggatggctactggaaatctgttagcagagaatctgaaagaaaagtttcctcagatcgagattactgcagttttaagttcaaaagaaatcgaattagtagataaattggatgtcaatctggttttcagcacctttcaattgaattatcgaaataagccgcttttagttgtcgatccgattttaactgagacgaatatcttggttatagaagactttttgaaaagaaatgaagaactacagcggttagagcctaacagtcatgaatcgacggagttattcactcaaataatagatgtcatgaaagaaagtggtggccgagtagatcgaatcatctatggcaagttagaaaaattattcgaaacaaacaatttagaaatcaacaaaagggagatccagcctatgttaaaagatattttgacggacagcaatatcatgatcaaagaaaaagccactacttgggaggaatcgattgaactagctgctagaccattggttaaagaaaacattgtcgaagagcgctatgtcgaagcgatgattcgtgcagtgaatgattacggaccgtatatcgtgattggcaaacacatggcactagcccatgcccgaccagaagatggggtcaataaattaggagtcagcgtagctacgattgagcaaccaatcgatttcggtaatcctgaaatggatccagtaaagattattttttgtttggcagcagtagactcctactcgcatctgaacatcatgaaagaactaattgaattgatcaacaacgaagagaagttggatcgattgattgaatgcacaaatatcgaagatttcaaacaactgcttttttcagtagttgagaaataataaatgatacgggggagaacaaagatgaacaaattgaacattttattcgtatgcggtgcaggtttaggaagtagttttgcagcacagatgtctgctgaggatgttttgaacaaattaggagtagaagccaaactggaccattgtgatatttcttccgcagtttccatgaaaccagatgtgatcatcacagcagaaaattttcgttcgcagttcgaaaagttcgcagttgatcctaaaacggcgatgatctatttgaaaaatattgtttcaaaaaatgaaattgaagaaaaaatcaccccagttctgcaagataagggagttatctaaatacaaaaagaaaagagggtaaaaactgaactgaaccccaaaagttgaactatttaatggactgtttccgatattctactggagatagtccatttaactttagttttatccttttgttattataccacctaatatactcatttaatttactttgaaatatctcaattgatcggaatttttctcgataaaaaaactctgatttaagcacaccaaaaaaattttctattacagaattatctaagcaatttccttttctagacatgctttgaataatgttattctcttttaattttttttgatattgtggcatctgatactgccatccttgatctgaatgtagaatcagtgaaccctcagttcccttttttttaattgcttgttgaagcatttcttcaatcagtttatatgttggactagttgatatactataactaattatttctccgttaaataaatcaagtataggagatagatagatttttcttccttttatcttgaattcagtgacgtctgtcacccattttttattgggtgtatctactgaaaaatttcgttttaacacattcttggcaatttttcctactgttcctttataagatttatatcgctttattcggatttgacaggtaagtcccatttgggacattaattttctaactgttttatgattgattgtatatcctttcatctttaacgctaaagtgactctacgataaccataagagtttcttgattcttttacaatcgctgtaatttcttgctttatcttgctatatttatctggcttatctaatttttttacccagtaataataagttgacttcgctaattgtgcaattgaaagtaatagattcaatttaaattcttttttgagctgaaggattgttttaaccttgatttcttcttgctcaaatcttgttcttgaatcaaggtttctaacttttttaaatatgcgttctctgctcttaaacgaataacttcttcttcaagagactcatctttaagttttttaggaatgtttagcttggaattcatactaatttttctgccccttttttggctctcaagtgaagaagcaccgccttcttcatattgctctatccatttacttagagttctatttgaaccgatattaaattttttagcagtttcttggatagaaagaccatttgtttccatatattctataacatcaagtttaaattttgtagtgtagcttttgccacctccaaccaagccttcccaaccatgatagttataaatccttacccaatgtctaaccagtgtacgatttatttgatatttatgtgcaagatatttgtagccgccttcgttatttaaatagtctgaaactacttttttcttaaaaacaaatgtatatttccgcaaaaaaagcaccccttttaattagatttctagtctaacttttggggtgcacatcaaaacatgggcgttatcaattttatcatcgaaaatattttgactcaggcatcgatcaccattgcattgattgctatgttgggtctactactgcagaagaaatcagcaggacaagtcatctctggcacgttaaagacactcctaggatttcaagtgttgagtgccggttcgagcatcatcgttggaagtttaacttatttcgggaaaatctttactgaaggatttcatatgcaagggatcatcccttctattgaatctatcaatggtcaagcaatgaatgatttgggtttaggtagagatattgcactgacgttcttagccatttttgtattcaatattattttggctcgtttcacaaaatggaagtacatttttttaactggtcaagcaattttatggatggcaacgatgacgacagtctttggctattttgccggtctgcgagggatcgtattgatcttggtcggtggttttatcggagcttgtttcgccattgctatgccggcagtagcgcaaccgatcattcgtaaaatcactggatcaaatgatattgctttaggtcatttttgtacgatcgggtacttatttgaagccggtgttgctaagctttttggtgagaaaggcgaaaataaaaagtcgatcgaagatatcaagttgccgacacatttcgaatttctgcaagatacttatttgtctgtcatggtcgtgatggtcccgctatatatcatcactgttttatttgcaggcgaaccattcgcttctgaattatcaggagatcaaaactatatcatgtttgcctttttacaagccatccaattcgtagtgggtgtgtatgtattgctagctggtgtacgtctactgttaggtgaaatcgtgccggcatttcgagggatagctatgaaattagttcctgatgcgatccctgccttagattgtccagttttctttccttatagcccaaatgctgtcattttaggtttcattacgacaacgattggtacgattattgccatgtttactttgcccatgttcggcttagcgatgattttacctggtatgctaaccaatttctttgccggagggacagcagggatatttggcaacgcagttggcggacgccgaggagcgatcattggcggtattgctcatggtttctttattacattattgcccgctttgctagtaacgatctttaattcgatgggattcaacaatgctacagcaaccgatgtagatacagtagccgcagcactcttatatgcctggatcttaagcccagttttgaaagcattttaattgaaagtagggaaaatgatgtttggattttttaagaaaaaagaaaaagaaccgaaaaaagttctggcaaaagaagaaaaagccctatcgccagaagcgaccgaaaagattcaatcagagattacacaattgaaacaagagatttccactacccaagataagcataaattagcgaaactttatgaacaagttggacttaaattttctgaattgtatgtgaacgatcaagccatccaatatttagaaaagagtttggaaaataaacagacgatcggagatgggtataaaaaactgatgagcctctataaccagaagcgtgcagatgctgctcgtgctggtgatgatcaagggatcgattactacatgggcaaaatggatgagatgcgacaaattgcaaaacaagtaacgatcaaaggaaacaaataaaaagataaggtggcaataaaagatgtatacaacattgaaagaagtaacaaaaacagcagaagagttgaattttacagttggagcttttaatacgcataacctagaaatgcttcctgctatgctaggcgcagcaaaagaaatgggttcgccgatcattattcaaacaagtgtcgataccgctaaatatatcggcatgcatgtgttagtcaatgtaatgacagctattgcagaagaagaaatggttgatgcagtcttgcacttagaccacgcccgagactttgatgatatcaaagaagcaatcgacagcggatatacttctgtcatgtatgatgggtcccatctgcctttcaaagaaaatatcctgaagacaaaagcagtagtagaatatgcccatgcgcacggtgtttccgtagaaggagaacttggaacaatcggcggtacagaagaaggaatccatgtcgctgaaaatgacaaggtatatacaagaccggaagacgcagtgaaatttgtagaagctacaggcgtggatgcattagctattgctatcggtacgaatcatggacaattcaaatcaaaaacagaagtaaacattcccttgctgaaagaaatcgatgcagtagttgatgtccccctagttatccatggaggaacaggtgtgaaagaagaagattatcctgaattgatcaataacgggatccgcaaattcaatgttggaacggagcttttagtcaactggacgaaagtagctaaagaaacctttagtgaaacagaaatcaacaagtctcttcgccataatgtgattccagcaaatgaagcagtaaaagaaattgtcaagcataagattggactgtttatgaacttggaaagtccaattaacttaggaaataaatgagatgaaaaagtatttcattcttctggctggtagtcctggtacaggaaaaacatatcttatgaataaactacgggaacgatttccagatatgtatgccatcacgctcgatgaaatcaaggaatactatgcagaatccatcgggtttaacaatttggaagaacgggcggaacaagaaaggacgaaagtttatcctttctattacaaagcacttgatttgtatatggaagcaggaaagaaagtgattgtgtccgagtatccttttagtgataagcaaaaagcacgactccaagaattagcagatagatacggatatcaggtgatcacgattcgcctaacagcagactttgaagtgttatggcaacgtcggtacaaacgtgatcgtgaatcagatcgtcatttgagctatatcatggatcattatcactatggtgacgtattggaagatcgaacgaaagggaccaatcatattacgaaagaagcattcaaaaagatcatcgccgaccgaaaatatgacaaattccagttaggaacactatatgaatttgatgtaacagactatactcaagtggattacactccactattggataaattagaaaaagaaatcaatgacaataagtaacaaagaaatggcttaatatcgaaaaattggcttttgaacgctgtttaccgagaggtcgtgagcctgtcgttcagctccgagtcacaaggagcaatttcaaaaaaacagcttctcatgtttgatgaatattgtgacttgtgaccgaggagttggtaggagaacaccgtttagtggggaggttgtgaaaaagctgtcctgcctcaattaataagaacagccagacaagaatagctcgtcatatttttcgtttggtggggcttattaccgcagatgcaagcttttgaacgccatttattcacagccccagagaagtcgaatgtcttttgttctcgagttttttaacattcttttatttattgcagatttcattatatttatttgccgtaattaaaccagtcttctatacttgattacatagtcatacatttgctaaaaaagaagggaagagaatgaacaagaagttggctcaatacaaaagactactcgcactttctcaagctggtctatattatggaaaagatgtatttgataaagagcgttttgaggagatccggacgatttcattggaactgatcagtgaaataggaaaagaaactttcgaagaaataaaagcgctcacaacgattggagaaggacatccaacaccaaaagtagatgttcgtgcctatatcaaaaaagatggcaaggtcctactaatcgaagataaacggacgaaagaatggtcacttcctggtggatttgctgaaataggattgtctcctgaagaaaatgtgcgtaaagaagtctatgaagaaacaggattaacagtagaaactactcagttgcgagcagtttttgatacgaataaacaaaaagatattccacagctttttcagtattataaacttgtttttgcttgtgcgatccacggtgaagaggccaagtttattgagaataatgaaacttccaacatgggattttttagtatagaagagttgccaaagctatcagaaaagcgaacaacgaagaaacagttacttattttagaaaacaaaaaccagatctattgtgattgagctttttcgtaaaagaagaaaagaatatactttactagttattaaaaaagaacttgatttttttattgaaaatagttgcatttgcaacaaaaagaggtgaactagtcttacaaacaaaataaaggtgggatgaaatggctgaaatccttcgagacatcggaatgattgcccgagcgctagattctattagcaatatcgaattcaaagaagtcgatttaacaagaggacagtatctttatttagtacgtatttgcgaaaatcctggaatcatccaagaaaaactagcagaaatgatcaaagtagatcgtacaacgactgcccgagcaatcaagaaattagaatccaatgggatgatcgaacgtttggaagataaagaaaataaaaaaatcaagaaactctatccgactaaaaaaggagcagaaatctatcctttcatcattcgagaaaacaactactccaatgcagtcgcattaaatggtctttctgacgaagaagcaaaacaattggaatatcttttaaataaagtatgcaagaatgttagcgaagattggaattttgtcaaaaaaggcaataaaaggatctattgaaaggaagaagccgtgaataaatacgaaattcgaaaaatgacgccttcagatgtagacttactacaacaaattagtatcgaaacatttacagatacatttggaaaagataattcaccggagcatttagctgattacttgacacaagcttatgcactagaaaaacttacagaagagctaaaagataaagaaaccgattttttcctagtgagtatcgatcaagagcctgcgggttacctgaaactaaatacaggaacgagtcaatctgaggaaatggctgatcattttttagaaatcgagcgaatctatgtacgaaaaaaatttaaacatcaaggtatcggtacatttttactagatacagctattgaaaaagcaaaagaaaagcaaaaaacagccatttggctcggtgtttgggaacacaacgatgttgcgctcgctttttatcgtaaaaaaggatttatcaaatacagcgaacatgttttttatatgggagatgatccccaaacagactatctattcatcaagcaattattctaatcaagaggtgtgaacagatgaaaaaagtaatagtggataccaatttctgggaagtatttcctgaagcaaccatcgaaatcttatccgtaaatggtatcgataaccacgtaacaaaagaaagtgaagaaacgtatcatcaattattgaatgaggcagcaaaagaagcaagaaattaccttacagaagaaacattcagccaaaacgaagtcattgctcagtggcgtcaggcatttaccacattcaagactaaaaaaggtgcacgttcttctattgaagctttactgaaacgtgcaaatcaagaacgggaatttttcccaatcaatccgcttgtagatatctataatagtatttccttgtcttttggcgtaccttgcggcggagaagatatcgaaaagatcgcaggaaatctgcatttaggaaaagcccaaggtggcgaatcattcctgcctttaggtgcagattccgatgctccggcacttccggaagaaatcatctactatgatgaacaaggagcgatctgtcgctgtctcaactggcgtgaagcccaaagaacgatgctgacggaagaaacacaagcagcggtgctggtcattgaatccatcaatgctgaacaagcggcacgtggcgcacaggcaatcgaagcgttgaaggaaaaaatcgatcaaacatttggcgtaactagtgttagacacacactaaccaaagatgaatcagaagcagaattataaaagaatcgaaataagaagagcggcattcattgccgttttttttttgtaaaaaaagtttgtggaggaaagcaatcctagaaactattgctttatttttcttgaatagtatcaaacacaaggtgtttgcgctttcgtgatataatggaatcagtttatagacaggaaagaaaatcaaatagaaagaagggtcaaatgatgatacaaaaaacacgtgtgatgctttatgtcaatgacgtagagatgatttgccgattctttgtagaaaaaattggtgcagaaatttctgaaacaatcgaattgccagaagaatttaagagtattgtactcagcatctcaaaagaattagaattaggcgtattcccaaaagtatttgtgcagaagttttcaccagaggtattaggaccaccgccttctttagtattttttacggatgaatttgaaactatctacgagaacatggaagaaccaggagaaatcacagataacaatggcatcttgactttcaatttttctgaccctgaaggcaattattttgttataggaaaagctgagtcgtctgattgaataaaaaggaggaaaaacagtggatctaatgggaagattagaaggttatttgaagtatcggcgagcaaaacatagtgagaagcttcgagcaaagaatctcaaatcaggaaaaaagaagacaaaaggctggggaaaaatggtcgatacaggttttggcggactaaataatctgaatcctgtcgatacaaaagaattcatcaaagaagaacagaaacgaaatggtaaaatcaaatcacactattgatttttgagactagaatgaagaaactttattaacacaataaagaaattcttgtaatccaaagtgaatgttcatgaactttgagataaagggatttaatcagatggaacgttcggattttgcttaaaatccgaattttttgtttacttatgttttgttttagtatatgataaaacacgttgttttattaataaatcgaaattttaacggactttatttataatgttcggatttagggggatggaagatgaaggaaaaaatactttcctacttcgaaatagaaaaattgaacaccacggtaaaacgtgaggtactggcaggatttacaacatttatctcaatggcttatatcttatttgtaaatccaactgtattaggtgcttctggaatggatgaaggagcagtgtttactgcgactgcattagccagtgcgatcggctgtgttttaatgggggtattagcccgttatccaattggaacggcacctgctcttgggatcaatgctttttttgcttattctgtttgtttaggaatggggattccatgggaaacagcattagccggcgtattcgttgcttctttgatttttattttgatcacaatcttcaagctgcgggaaatgatcattgatgcgatcccagcagatttgaaatatgcgatttctggcggtatcggtctatttatcgctttccttggtctgagcgaaggtgggatcatcgtttcgaatgaatctacattagtaggattaggatcactcaacgttggttctacttggttgacgatttttggattagtcgtaactgctatcttgcttgttcggcgtgtaccaggtggcatcttcatcgggatggcagctacaacgattttaggtctggtcacaggtttgattccaatgccttctgaaattgttgccgcagcaccaagtttgaaaccaacatttttagttgcattaaaacatgtaggggacatcaattctcttcaaatgtgggtcgtagtgctgacattcttgcttgtgactttctttgatacagcaggaactttagttggattagcaaaccaagcaggtttcatgaaagacaacaagatgcctcgtgtagggaaagctttagcttctgattcaacagctatgcttgcgggttccttatttggtacttctcctgttggtgcatttgtagaatcatcagctggtatcgccgttggaggacgttcaggtatcacagctattactacagggattttcttcttgttaggcttgttcttttctccattactatcagttgttacttcacaagtaactgcaccagcattgattatggtaggagtattgatggcacaatctttgcgacaaatcgaatggggaaacttagagattgcgatcccttcattcttgatcttgatcggcatgcctttgacttatagtatttcagatgggattgcattaggttttatcttctatccaattaccatgttagcagctaaaagaggaaaagaagtatctccaatcatgtatggtctgttctttgtatttgtgggattcatgtggatattgaatgtgaaataaagaggttgtgaaatcagcgttctggcctgagtattagagaaaaaaacgaaaaaatagtttcttatattttgccgttttttgagctaataccaagggacagctgagtgaacaccgtttataaagaagttgtgaaatcagcattcttccctgcataaatcaatcctttcaaaaaacagttgagggaatttcctcagctgtttttttgttttattctgttaccgataacaaggtgcaatagctatttgaaagcgttacaatttttagtgagagagactaaaataaatgattaagcaaaaaatagaaacatccatttataggaggaaaatcatggaacaaaaatggtggcaccattcagttgtttatcaaatctatccaagaagttttcaagattcaaatcaagatggtattggagatttgcgggggattatttccaggttggattatctggcgtatttaggtattgatgcaatttggctttctccagtatacgagtctccgaatgatgacaatgggtatgatatcagtaattatcaagcaatcatggcagaattcggtacgatggaagaaatggaagaactgattgaagaagcaaagaaaagaaatatccgtatcatcatggatctggtggtgaatcatacttctgatgaacatccgtggttcattgaggcccgtaaaaataaagaaaatccttatcgggactattatatttggcgtgatccggtcaatggaaaagagcctaatagattgcgctcaatattcagtggttctgcttggcagttggatgaaaaaacggggcaatattttctgcacttgtatagcaagcgtcaacctgatttgaattggaaaaataaacaggttcgccaagagatttatcaaatgatgaatttctggatcgataaaggtattgggggctttcgtatggacgtgatcgatatgattggcaaagaaccggataaagaaatcacaagtaatggacctaaactgcatgagtatcttcaggaaatgaatcaagcaacttttggtgacaaaaatctgatgactgttggcgaaacatggggagcaactaccgaaatcgctaaactttattccaatcctaaaagaaatgaattatccatggtcttccaattcgaacacataggattagatcagcaagaaggcaaagacaaatgggatttgaaacccttgagtatctctgaactgaaaaaagtattatccaaatggcaaacatctttaggtgatgaaggatggaatagtttattttggaataatcacgatcttccgcgaattgtttctcgttggggaaatgacgatgtgtatcgaaaagaaagtgccaagatgtttgctatcttgctccatatgatgaaaggcaccccttatatctatcaaggagaagagttaggcatgacgaattgcccaatcgatgatatcgcggaagcaaaagatattgagacaatcaatatgtataacgaaaggatttcttctggatttacaaaagaggaaatcttggaatcaatcaaggcgaaaggaagagacaatgctaggacgcctatgcaatggaacgcccgtgaacatgctgggtttactactggaattccatggcttcgagtcaatccaaattataaagaaatcaatgcagaagaagcgttagcagatcaagattctgttttttatatgtacaagaaattgatcgatttgcgtagaaaacatgacatcatcgtctggggagactatgaattagtggaaaagacgcctgagcatgtctttgcctattctcgcatatatgaagaccagcaatggctcgttatttgtaatatgtccagtgaaaagcagacgttcactattccacgtgaagctttaagggttattgtgtcaaattatcctctgaaacagttaccagacggcaaagttgatttacgaccttatgaagcatttgtgttggaagtaaaataaatcgtttgcttagatggttaacgagtgttttctttcggggatcgtcttatgtatttgttatatataaatattaaaaatgaagagtagcattcaatttttttcttctcttctgccgaaatagttagaatatcttgttttgatgaatcgagctatacttcaagtaagaaattgttgatagcgaggagagatagttatggatcaggaaatatttccagaaaattttttatggggcggagcagtagctgctaatcaatgtgaaggtgcatggttggaagacggcaaattacctaatgtgacagatacgcttatcgggatcatgaaccagcatcctagtattcagtggaatgaagaaaaaaagatttgggagattgctttagacgaatcactccattatctttctcatgaagcgattgatttttatcatcgatttgaagaggatattcgtttactgaaggagttaggtttaaaagcttttcgaacaagcatctcatgggcacgaatatttccaagaggagacgaacagaagccaaatgaggctggtctcgtattttatgacagactaatcaatacattaaatcgatatgatatcgagccagtaattactcttagtcattatgaaacccccttagcattggtaggagagtatggggggtggcaaaatcgaaaattaatcgacttttttgaattttatgcgcagaccgtctttgaacgctaccaagggaaagtgaaatattggatgacctttaatgagatcaataatgcttttcgtatgccttatgcagctgctggattggttacattccctgctagagataaacttgaacccattgctacactaacaaaaaaagtgatttatcaagcctgtcatcatatgtttctagcgaacgcccgtgctactcaattattaaagaaaatcgatccaaatgctaagatgggtattatgtgtagcttttctgcattagcgacttatgcatatgactgtgatccagagaatgtatttggttcactgcaatttaaacgcaattcatggtttttctccgatgtcatgtgccgagggcattatccagcttatatttacaggacatggaaggaagaagactgtgcaccagtaatgttagatggagacgaacagtgcttgcaagctaacacggcagattatattgcatttagttattatcgtagcgctgtctataaaaaagaagcagaaatgcgcgtagatactggcggagcaaatggtttcgataatccctttttgaaggaaaaatctcccgaaccttggagttggccaattgatcctctagggtttcgttatgtcatgaatgaattgacagaccgttatgaattaccattattcatagttgaaaatggcattggactagatgaagcaccagatgaattgaatcgaatccacgatccaaaacgttgtgagtatctaaaaatacatcttcaggaaattgctgaggcaataaaagatggttgccaaatcattggttacttatggtggggaccaatcgatatcgtatcggcaggaacaggggaaatgaggaagcgatatggctttatttatgtggatagacaaaatgatgggagcggaagctttaggagattgaaaaaagatagttttgaatattataaacaaattatccagtctaatggtaaaaaccttgaatatagatctttcttcaaatgatttttaaacctctgcaagtgactattgtcatttgagaggtttttcctgtatgtttataacaaagaggaggtgtaagcaaatggacttaaataaacgacaactccaaattcttgtagtattaagaaataagaatcattggataacaagcgaagaattagctgaagctttaggtaccaacaagaaaacgatccaaactgaaatcaaaaatatgcttgctatctacgagaagaaaatcattatccagtcaaataaacgttcaggttattttttagaatcaattgaatctgaaactaaacagcaaatcatacaagaggtgacgaaacataaaatctattccagcatggatttccgagcttcaactattgtgacgtacttattgtttcaaaaagggtatgtcagtatgcaaaagatagcagacattttctttctttcaaaaacagccgtatcattacaaataaaaacgattttgcgttggatcgagcgcaatcctaaattagaactggaagtttcgtcgacaaaaggactaaaaatcattgctgaagaaaattcaaaaagaattttcttatctcttgttggaacagaaacggtgatccaacacgcaaggtttcctcaacaaatcagtacaattttttccaatatcatgccgactgtccaaaagacattaaaagaggttcttatatcatataattatattgtttcaggagaggacttcatacgattttctcggtatctcgttttgaccattcttcgaagagaagaacttttagaaaaaacaaacaggtatacattatttattccgatggtagagaccctcacaaaaaagttatcatcagaactaccctattctttttccaatcaagaaaaacaagcaattgaaaatcgactattagagttaaattatttgatgattaatgatgaaaaaaacaaagaaatagagaagaatctaagagcatttgagcaaacgattattcgttttttagatcttcctgtttcgttattgttccatgaaacagaatttttgctaacccatatcaaacaaatgaaaacgaggatggatgccggacataataccatgaatcattttgtacaaaagatcatctcccgttatcctttagaaatttatttaattcggcgtttcttcccaatacattttcaattacgtcccaatttagctgaaagcgcttattttgttttgtatcttgccgaagcgttgaatccttttcgaaaacaaggggagatactgattgttagtaaccagccaattagtattttgaatacactaaaaaaacagattcaacaaagtatgaacatgtggatcaaagaatgccggatagaaccagtgtatcttttcaaaaatcaatcaaacaaaataacggaatatgatgcaattttgactactgagcaagagcttatttttgagtgggatgatttgatttatctacctagtgttctagatgagtttgaatcttgggagatttatcagattttgcgtgaaaagctgaccatagttgaagaaaaaaagaaaacaaaactgcttgatcattactacaaagaagaaaatcaaataaaaatccataaaaagatagattccattcagcaactaatctctcctagttctgacctagttatgcttccgttaaatgccgagactttgttgtgctgtcttatcaaaagccaagtagaaacaaaaatcacagagtatcagcttgagataccacttatacatcagcaaaggaagatcaagcgtgttttttttgtctcctttgactataagagaaacgatatacttgttttctttcaagcagtgagtgatttgctcggctaagtaaaccatacacactattgtacagtttcgttcgctattagaaggggtactaattgaatggagaaaccgttttctaagaactatacttatcttgtaagaaggattgctacggcattaattaacaagggggaagtaaaaatggactattcacaattagcgaaagatattgtccgatttgtcggaggcgaagaaaatgtcagcaatgtttaccattgtgcaacaaggttacgctttaccctaaaagataataagaaggcagataaggagaaggtagagcaactagaaggtgtgatcactgtagtcgaagctggaggaatgtttcaagtcgtagtaggaaatgcagtaaatgaagtgtatgacgtattatccaaacaaatgaaactagaagatgatgcatctagtggaaagagaggaactgagaaaaaaggcattttaaactcttttatagacatgatcgccgctgtttttgccccgactttaggcgtcttggcaggaagtggtttgatcaaaggagtactcgccttatgtacgagtttgaatttattaactactgaatcaggaacttatatcattttgaatgcagcagctgatgcatttttctatttcttgcctatatttttggcatatactgctgcaaaaaagttcaatacagatcgtttcatcgctatggttattgcagcagctctcgtttatcctacgattgtcagtgcatatagtgatagcataaccttgcgatttctagggatgcccgtgattctagcaaggtatacaagtacggttattccagcaattttagctgtatgggttctttcttatattgagcctaagattcgcaaaagcttgcacgaaagtattcgaaatttattgacaccattcatttgtatcatcgtgatggtcccaattattttattagttgtaggtccaattgcagattatgcaagtcagctgattgcagctggatatttagctgtttataactttagccctgttttatctggtgctgttatcggcggattttggcaagtgttagtgatttttgggttacattggggacttgtaccagtaatgaccaacaatctttctttctacggtcgtgatacgctaggtccagcatgtatgactgccgtagctgcgcaagcaggagcagtacttggggtatttttgaaaacgaaaaataagaaagtaaaaagtttatctttatctgcatttatcacagcattatttggaatcactgaacctgctgtttatggtgtgactcttaaatataaacgaccattttacattgcttgtatatgtggagctatatttggtggagtagctggtgccgcaggagccggtgctttggcagttgctacaagaagtattttgtctttcccgatttatattggtgaaggatttgtttggctagttgctagttatttcttagcgatgatcagttcctgtatgctaacttttcttttcggctacaaggatgaaatcgaagaagaatcctcaaaggatatagtgttaagtactcctgcagcaggtgaaataattgatttatctgaagtaaacgatccaacatttgctagtggatctttaggagaagggtttgcgatcattccaacggacggaaaaatctacagttctgtaaacggggaagtttcaacagtttttccaacgaaacatgcaattggggtagtcagtgaagaaggagcagagatactgatccatatcggtattgatacagtgaatttaaatggcaaatactttcaaagtgcagtatctgatggaaaaaaagtacgtaaaggcgatttattgatggaagtagatttgcaagaattaatcaaagagggatatgatccgaccacaatggttattgttacaaatagtagtagattcaaaaatatcattactagtcataagaaaaataatcaaacaagaaaactagcaagtttagggggatcgatatgaaaaaatttccagaaggatttttatggggcggagcgacagcggccaatcaatgtgaaggtgcatgggatgtagatgaaaaaggattatctgtgtctgatgtgtatacattcgacagcgatttacctaaagaaaaatggacagatcaatggcatatgatgacgcatcagcaagtaaaagcggcgcaggatcccaacagcaagtattattatcctaaaagacacggaaatgatttctatcatcactttaaagaagacatccgtttatttgctgaaatgggttttaaatgctatcggatgtctatcgcatggacaagaatttttcctcatggtgatgaagaaacacccaatgaagcgggattatttttttatgatcaagtgtttgacgaatgtctaaaatatgggattgagccagtcgtttctctttcccattatgaaatgccgttatatttggttacagaatatggtggatggcctaatcgaaagcttattcagttttacgttcgtttcgctgaaacagtattcaaacgctataaaaataaagtaaaatattggatgactttcaatgagatcaactgtgtaaaacatcacccttttgttagcgtaggagtaattgaagaaaaccatccccatttggaacaagcgaaataccaaggtgcacaccatcagtttatagcaagtgctttagctacaaaagcttgtcatgaaattatcaaaggttcacaagtcggttgtatgatcagctatcagcttcttgttccgtattcttgtgatccggatgatattcaaaaaacaattgagcagcaaagaacttctttgttctttagtgatgttcaagcaagaggatattatccagcgtatacgcaacgaatgtttgaagaaaaaggtgtcaacttaaaaatagaagtaggtgatgaagaaatcttagcagcctaccctgttgattttgtttcttttagctactacatgtctagtgcagtcagtgctcatccagaaaattgggaaggggtccaaggaaacttaataactggaggaattaaaaatccgtatcttccatcaagtgaatggggctggcagattgatcctaagggtttgagaattgctttgaatcaattatatgataggtatcaaaaaccactgttcatagctgaaaacggactcggagctatagacaaagtagaagaagatggaaccgttcaagacgattaccgcattgactatttgaagcagcatattgagcagatgaaggaagctatcaaagatggagtagatttatttggttatacgtcgtggggctgcattgatatcgtcagcgcttctacttcacaaatgtcaaaacgttatggatatatctatgttgatcaagatgacgaagggaatggcacaaagaaacggttaaagaaaaaatcatttgattggtacagacaagtcatccaatcaaatggcgaaatcctataataaaaggaaataagggactgtgacaaaagtcttgtcacagccccttctttacgaataaacagtattctcctgccaactcctcgatcacaagtcaccatagtcataaaacatgagaagctgttttttgaaattgctccttgtgactcggagttcaacggcaggctcacgacctctcaataaacggtgtacaatcagctgaccatcggcattagctcaaaaaacgacaaaatatgaggaactatttttgtttggctgttcttattacttgatgcaggacggctttttcacaacctctgatataaacggtgttcaaaagccagtttttcggtattaagccaaatttatgcaaaaatgtggaaagccattttcacaaaatttttcttcatactcaaaactaaacgactttttcacaacctctgattcacggtgttccagaaggagttttgtcgaaaacaagccgaaattctttgaagatggctacttctttttttcaaatctagacagaggaggcggacattattccgtgttttttgacaaaaaataaaaatcatactatgatatgtacgccaatggaggggatgaaatggaaaagccaattgaaaaagcgttagatgaatgtcttttctttagcgtgaaaaagctagatcgcatgttgaataaattagctgatgaagcgtttagaaggacaggtctggcaccaacttatggttttattttattgatattaaaagaaaaagatggaataccacaaaaagatattgcacaaatgctctattccgccccatcaacgattgctcgttttgttgaaaaattagaatataaaggatacgtcaaaacagttagcgaaggtcgcttgtcattagtttatcttacagaacaaggacgccaatttgctaaggaagtcgatggtagctgggaagaacttcatcagtcatacaaagcagttttgggaaatgaagcaagtaaagaattagcccagacaatgaatgatgcaacagataagttacaaaaaaaataaaattttttaagcaaattagttgcatgtacaactaatcgagtggtttaatgatagatgattctcgataggttaatcagagcgaattatgggaggaatgacaatgtcacaatttgatcaatcaattactttaccttcaggagttcaattgaagaaccgattgatgctgtcgcctatgacgacacaactcagctttttcaatggagtgatcaccgaagatgagatcacttattataaacaacgttctaaaggtcttggtgctgttattactggtgctgcaaatgtccaagatatcggaaaaggctggccaggtgaactcagcatcgctcatgatgaaatgattcctcgattaagtgagctagcgaaagcaatccaaggagaaggcgcaaaagcgattattcagattttccacggtggacgaatgacaagtcgagcaactttatctggagaacagcctgtatctgcaagtgcagttgcagcaaaacgtcctgatgcggaaacaccacgagcaatgagtgaagaagaaatcgttgaaacaatccaagcatttggcaaagccacacgtagagcgattgaatcaggatttgatggaatcgagttgcatggagcaaatacgtatttgatccaacaatttttctctccgcattcgaatagacgagaggatcaatggggcggtagcttggaaaatcgttatcgttttattgaagaattattaacaacggttttctcagcggttgaacaatatgctaaaaaaccattcatcgtagggtatcgtttctcaccagaagaatatgaaacaccaggtatccgttttgaagacacgatctggcttcttgaacgattacgtgagtcaaaactagattatctgcatgtttcattaaatatgtatgatcgaatagctcgttctgataaatacaacgataaatcgattcttgaagtggtccataacacgattcaaggaaagatccctttagttggtgtcggtgggatccgcaatcgcgaagatgtagagcaggtattgaaatatgcagaacttgcagcaattggacagcaaatgatcgtcgatcctgactgggcagagaaattattggaaaaccgtgaggatgaatttgtaacgaaaccttttgaagaagcatataaagagctttatttgccaagcccattatataatttcttgaaagcacgttatcaataacgcaatttttatagaaagaggatgggaaaatgaaagtattgatcgtattaacaaatgtagaaaagtacgaaaagatcgagcgtcctacaggtttgtggttaagtgaactgactcatttttatgatgtattagtaaaaaatgggatcgatgcagattttgtcagtcctaaaggcggatatgtacctttagaaccgcaaagtgttttgaatatggatgaaatcgattgggcctattatgaagatgaagatttcagaaatcgggccttgggaaataccttacgtcctgatgatgtggatgcaaatgattatgcagcggtttattatgctggtggccacggaacaatgtgggattttccagaagcaatagatcttgggaaagtcgcttcacaaatctatcgaaatgaagggctggtctcagctgtttgtcacggtgttgtaggattgttgccagttacagatgagtctggaaaatctattttagctggacgtacagtgactgggttcagtaatgaagaagaggaagcaaatggtacaacgaatgaagtaccattcttagcagaagatgctttgaaagaaaaaggagcaaactatcagtctggagcagctttttcagaagtggttcaaattgatgggcggcttcttacagggcaaaatcctcaatctgctcatcaattaggcgaagcagttgttgaagcattaaagaattaaaaataaatgatgtgtctattctaactattacattacacacgctaaaactcgtcttttcgttcttttctgtttcctatttggacagaggtacgtaaaaggcgagtttttttcttttataagagtacattttttgaaacatctcttcagaaatgatactcttcaattaggtccactagtacattattgagaagcagacctagaacacggtatgatggagagggttgattctgctgcatcgctatgtatcataaggttgaaagcgagttatgaatactgtgttttctgattgagaagttagcagtagaacaccttataagaaagaggaatgcagatgaacattgtaattgtcggcgggtcgtttgcagggattcatgcggctatttatcttcgccaattgatgccaacaagtgaaatatatttgattgaaaagcaatcgaagttaggatggattcccagcgggttcaatttgatattaaaaggaaaggttaccagtgaaaaacaactttcttggatcacgaaagaagaactgactgaccgctatcgaatccatgtttacacagaaaagacagtaataggattgaaagaaaaaaaagtcgttttagcaggaggaaaaaaattggattttgatcgtttgattctagcgactggttcaaatcaaaagtttcgaaatatttctgcagaatcaacgcttattcacccagttaaaaagatacaaaacgtaacggctcttcagcaaaagatcatgaatgcaaagaaaattgcaattattggtgcaggacaagcaggaatcgaaatagctgaagggttggcatcaagaaaaaaacaaatccatctttacgaaagccgaaagtcaattctttttcgttatctagatcctgaaatgacagaaccgttagtaaaggaaatgaaaaatcaagggctttcactttttttagaagaacaagttgtgtctttgaccgaaaatgaaaccgctattgtagagacggaaaaaagaaaggagaactatgatcttgttttgctggctaatcattctcgtcccgacaatcagatgtgggaagaacaattaacattgaatgatgatggaacgatctgggtagatgactacttgcaaacgtctcaaaaagacgtttatgcgattggcgatgcgatccaagtaacttttcgtccaacaaatgaaaaaatgtatgtttctctagtaaataacgctgtccgtacagcacgaaatgtcagcaagacaattagtggctcacagacaaaggatcagggaacctatcgtccagtcggcaatcagtggtttggctatttcttaggaagcgtaggtttgacagaagaagagagcattttttatccccaaaaaattgaaacaggatacgtagactacaagcttacagcaataaatcaaagcaaagttaaactcaaatttctatttgattctgaaaaaaagattcttggagcacagctccaaagcaaaaaagagatgttccaccttcttgaccaactgacaattgcagtagaagaaggatggacgtttgaacagttagaagaacatgagctatttttccagccagaataccgtgtgccagatatggtgtggtcaaaggtggcgaatactgcctatgaagattgaagcattattagaaagaaaagagcagttacagatcctgattttgcgaaaccttgttctgcaagggggaacagcctctatcaatggtttgagagagcatgtccaactgtcaaaagcctcgtttgatcaatatttggaagatattgaattgattggccgaatgatggaaaaaaaagtagaagtacagcgaaatgagtatcaggcgctgcttgtgttggacgaagatgtaagtttggaaaaaattctattgtttttattgcaggaaagcttgaagtttaagatgctcgtctatttattagaacatcagcaagtatccatcgttcgattagcgacagcgtttaatatcagtgagtcttctgtttttcgaaagatcaaagaattgaaccagctcttagaggaatttggattacaaatcaaaaacggtcaattatacggagaagagctacagatacgatatttttattatgaactattccaatatatcccggaagatcagcgaccgctttttttgcaaaatacaccagaaaaaagaccgttcattctaggattggaccgtgtattagaaacaacgtttacggcatcagcagaagcacagattgcttgctggctcgggattacgaaaaaaagactattgaatgaaaaaagtacgtacgcaactttgaaagaaaagaaattactctatcagtcggaccggctttatcaagcaatcgatccaatcatcgtgatgcatcttagtcgaacagcagcagaactgaatgtatacgaaacaatgatgttttacagcttttttgtttctttttcgatagtagacgaagaaatattttatcagtatgatttgacacggagcaaaaagttaccaaccgctgttttagatacttacattcgggaaacgatgttatggcattatcgtcctcgtcgtttgaaaatcaaagaagaaaaggcagtaggctaccaaatttcccagatcaacaatgaatggtttttctttgttggaaagatcgaagtctatgagcgtgatcggcttttggaacagcagcagaaaatgctcgggcattccttaacacagttactggcgaaattacaggaaacagcggtgcagcaattgccgaggaaaagagctgaagatagtgagcttagttacctgatgatccagtatgccaatgttcttttgatgatcgatttttatattgcaaaaccagtagtgattggaatcgatttagaaagtctgccgatttatcgtattgcttttcaacaatatctgatcagagaactgaggggaatcggcggtattgagattggaagttatgaagaaggtaaagaatatgatttggtgatcacattttgccagagaaacaaaaaacagtgtgaatattatctgtcagaatttgcgtcaccttacgacattattcgattgaaaagaagaatagagacgctgaaaaaagaaaagaattgattaaaaaatagcttcataataaaaaactgtcaaaaaaagaaaaaaagaataaaattttgacagtttctttttttaaaacagtagtatgataagagtagttaaagaaagcgtttgcatataatggagggaatcacaatgacagaatcaacgtatatcatggcgattgaccaaggtacaactagctcacgagcaattatctttgacaagaaaggaagacacatcggcagttctcaaaaagagttcacgcaatatttcccgcaagaaagttgggtggaacatgatgcaaatgaaatctggaattctgtacagtcagttattgccggagcgttcatcgaatcagggatcaaaccaaatcagattgctgggattggcataacgaaccagcgtgaaacaacagtaatatgggaaaaagatacaggacgtccaatctatcatgcagttgtttggcaatccagacagtcagctggaattgcagataacttaaaaaatgaaggctatcaagaatttttccacgaaaaaacagggttagtgatcgatgcctatttctcagcaacgaagatacgctggattcttgatcatgtagaaggcgcgcaagaacgagctgaaaaaggcgaattgatgtttggaacgatcgattcttggttagtatggaaactgaccgatggacaagcacatgttactgattactcgaatgccagtcggacgatgttgttcaatatccatcagctagattgggatcaggagattttagatttactaaatattcctcgagtgatgttaccaaaagtcacttctaactcagaagtttatggttatacgcaaggttatcatttttatggaagcgaagcaccaatttcagggatggcaggagaccagcaagccgcattattcggacaaatggcattcgaaccaggcatggtcaagaatacttatggtacaggttcatttattgtcatgaataccggtgaaaaaccgcaattatccaaaaataatttattgacgacaattggttacggcataaatggaaaggtttactatgctttagaaggaagtatttttgtggctggttcttcgattcaatggctgagagatggacttcaaatgttgcaaaaagctagcgattcagaagacgcagcgaaacgctctacaagcgaagatgaggtttatgttgttcctgcattcgttgggctaggtgctccttattgggatcaggcagcacgaggggctatgtttggcttgacacgtggtacgacaaaagaagatatcattaaagctactttacagtcgattgcttatcaagtgagagatatccatcgatacgatgcaagatgacactggaatcaagattcctgtattgaaagtagatggcggtgcagcaaacaatgaatatctgatgcaattccaaacagatatcttgaatgtaccgatccaacgagcagaaaacttggaaacaacggcgctaggggcagcatttttagcaggattagctgtcggttattggaaagatacagacgagatccgcgaattttatgaagctggcaagctatttgaagttcaaatggaggaagagcgccgagaaaaactttacaacggttggaaaaaagcagtaaaagctacccaagcatttgaataaggaggaaatccatatgttttcaaacaagacaagacaagatagcattcaaaaaatgcagcaagaagaattggatctgttgatcatcggtggcggaatcactggtgccggtgtggcagtccagtcagcagcatcaggaatcaaaacaggattgatcgaaatgcaggattttgcagaagggacttcctctcgctcgaccaaacttgttcatggcggtattcgttatctgaagacatttgatgtggaagtagtagctgacacagttggtgaacgtgcagtcgtacaaagtattgccccacacatcccaaaaccagatccaatgcttttgccaatctatgagggcgaaggagcaacaaccttcaatatgttctcggtcaaagtagcaatggacctttatgacaaactggcaaatgtgacaggaaccaaatatgagaattatacgctgacaccagaagaagtattggaaagagaaccgtttttgaaaaaagaagggctaaaaggcgcgggtgtctatctagatttccgcaacaatgatgcccgtttagtgattgataatatcaaaaaggctgccgaagatggggcttatctagtaagtaaaatgaaagcggttggctttttatatgatggcgatcaaatcgttggcgtcaaagctcgtgacctgctgacagatgaagtgatcgaaatcaaagcaaaattagtgatcaatacgagtggtccttgggtagataaagtacgaaacttgaattttacgcgtccagtctctcctaaaatgcgtccaactaaagggatccatttagttgtagatgcgaaaaaactgcctgtaccgcaacccacatacttcgatacaggaaagcaagatgggcggatggtttttgctattccaagagaaaacaagacttactttggtacgacagatacggattaccaaggagattttacggatccgaaagtcacacaagaagatgtagattatctattggatgtgatcaatcatcgctatccagaagcaaatatcacattgaatgatatcgaagcaagctgggcaggacttcgtccactgttgattggtaattctggttctgattacaatggtggagataatggatcgatttcagacaagagcttcaataaagttgtcgatacagtaagtgaatataaggaaaacaaagtttctcgtgctgaagtagaagacgtgttgaaccatttggaaaacagccgtgatgaaaaagcaccttctacgatttccagaggtagttctttagaaagagaaccagatggtttgctgactttatctggtgggaaaatcaccgattaccgtaagatggcagaaggagctttgcgattgatacgccaattattaaaagaagaatacggaatagagacgaaagaaatcgactctaaaaaatatcagatttcaggtggaaacttcgatccaactaaattagaagaaacagtgacagaattagcaaaagaaggagtagcagccggtttagaggaagaagatgctacttatatcgctgatttttacgggactaatgcccgacgtatctttgaattagcaaaagaaatggcaccttatcctggtttgagtctcgctgagtcagctcggttacgttatggtttagaagaagaaatggttttggccccaggcgattatctcattcgtcgtacaaatcatctgttgtttgaacgagatcagcttgatgagatcaagcaacctgtgatcgatgcaattgctggatattttgaatggacagaagaggagaaggcgcaacagactaaacgtttagaagcattgattgcagaatcagatctgcgggaactaaagggggagaaataaatgaacagtgatatgactcaaatcatgggggagtttattgggacactgatcctagttttgcttggagatggtgtgtgtgcggctgtgaatttaaacaaaagtaaagcacaggcttctggctggattgtcatcgcatttggttggggactcgctgtaacaatggctgtctatatttctggattcatgggcccagctcatttgaatcctgcagtctctctagctatggcgatgacaggggcaattagttggaatcttgtcgttcctttcatcattgcgcaagttttaggagcttttgcaggggccattcttgtttggctttcttatttgccacattggaatgcaacgaaagatgaaagcgcgattttaggaacgtttgcaacaggtcctgctatacggaattatccagcaaatgtgatcacagaattaattggtacatttgtattagttcttgggttgctagcttttggacaaaacgaatttgcacctggaacgaacgtattcgctgtaggtggattgatcttagccatcggtctttcattaggagggccaacaggatatgcaatcaaccctgctcgggactttggtcctcgattagcacatgcggtattgccaatagctaataaaggaacttcagattgggcatattcatgggtaccaatcgcaggtccaatgatcggagcaattatcgcggtaggtgtctattcattaatggtgtaaatctataaaacatactaaagtttgacaaccaaaatgtgtcttgctatagttaagtggaaaataaataagacctagaagaatggggtatgttttgtgagtgtagctggtatctaatcagtaagtcgaatagccaataaacaaagtttatttggtgtgcttatgaaacggtacctgtcaggaaaacaatatctttgtattctaataaggataggacatgacttttttaagctgtgttctatccttttatttatctctaggcccttatttattttgggacaggtatctcttcaagaaaaggagagaatatggacaacgaaatgattagtcaattacaatttgatcggatcaaaaaggaaatccaagcaagagcaattggaaactatagcaaaaaacgaatcagcgatatgacggtctcgacaaacctacaaactgtcttggatcgtcaagaagaaacaagagaagcacgcttgatcttagaaagcagtcagcatgttccatttatggggttgccgaggatcgatgcactgacagaacaagtcaaaaaagggttgattctgcagccaaccgatttgatcgaatatgcggattttcttagaagcagtcggatgatcacaaagttttttgataagaatcaataccagacacccttgttgtttgcttatagcaaacatcttcctgatttgataaatgtagaagagttgattgaccagaaaataaaaaataataaagtcagtgacgacgcgtcacgtaatttgcgtaaagtacgcaaacaattacaactaatcgaaaaagaaatccagtcaaaattactgaaattcttgcgtcatccgaaaaacaaagaaatgatccaagaagcaatgattgttcaaaaaggcgaatactatacgattcctatcaaagccagctataaaaataaaatagatggaacgattatcgatgaatcaaataaaagaacgacggtttttattgaaccaactgtgatttctaaattgaatgaacactatcagttgttaaaagctgaagaaatcagtgaagaatatcaagtcctggcggcattgactggtgctatcgcagaaaacgaagaagtgatcgatttattgatcgaaacgatcacggtgttagatatcatctttgctcgggcaaaatttagccgagaaatcaatggaagcacacctagaatcaataaatcggaacatatcattatcaagcaaggcagacatccatttttacctgagcatgcggtaccattggatgttgaaatcggtaaagactatcgaggcttgattatcaccggagcaaatgccggaggcaaaacagtcgtgttgaagacagtcggtttattgactttgatggcgatgttcggtatgcaagttccggcaaaagaagggacagagcttgctgtctttgatgagattttcgtcgatgtcggtgaccaccaaaatttagaaaatgcgttgagtacattttctggtcatatgcaaaacatcgctgctattttgaaaaagataaaaaggaatacgttggtacttttagatgagattggcagtggaacagagccaaatgaaggggctgcactagcgatcgcaatcatggaatctatgtatgagcaaggggcattgatcattgccacgacccattatggagaaatcaagaaattcgccggagatcatgaagattttgtgccggctgctatggctttcgatcgggaagcacttcgtcctaaatatcagttgcgggttggaagaaacaggagaaagccaagctttgtggattgctcataaaatggatatgtcgatgaaattgatccatcaagcagagcgttacttggcggaaaaagcctatcggacacagaaaaaagaatttcttcctaagacagcagttacaaataggaaggagaataaaaaagaacgtcagctctttgcaaaaggtgatcggatatttgtcaatgaataccaaaaagaagcgttagtttatgaagatataggtgaagatacgattgatgtatatttagacaaaaaaataatccacgtgcctcgtcagcgtgttcgtctggtgcgttcagcagaagatctgtacccgacaggttacgatttagacagtctgtttatcgattataaaacacgtaaacggcagcgtgacctagagcgaggatcaaaaaaagctcataaagtactagtaaaagaaatgcgcaaacgacaggaagaaagaagagtaaacgatgaaaacagcaagtgattatctcaaattagctcataatatcagtgtctgtaaagaaaaataaaaacagtgaaatcattggttttattccccgtgtaagctaaaataaaaagaaaagagtgctgaggaggtagggcgataaaatgaaattaagcacagactggcgtaaagaaatacaaacgattccgaatcttttatcgatattccgtatttttttgctgccgatttatctttattttgtgctgagacagtcattttatatagcaggagcggtcattgttgtctcaggtttgtctgattatctagacggggtcattgctcggagatataatcaggtaacagacttagggaaggtgcttgatccgtttgcagataaattgacacaactttttctgattttgtctatggcatggtatcgaccgtggctttggctgttgtttggtctattcttgataaaagaaggctttatgtttgtagctggattaatcgggctatctaaaaatatcaaattaagtggagcgaagtggtatggcaaagtagcgactgctgtcatctatgttggcatgatccttttgctgcttttcccagaattaccaacgctgtgggtgagagtcatttttgccgtcatcacttacggtcttttacaatcttttgtcttgtatgctgtcgagtaccgaaagatgtttcaaagaaaataaaaaaggggtgtgacctatgtcgcattcctttttttgataaatagactcccagtagctacttctcgataataagccaaccgaaccaaaaacaggagaagttgtttttgaaattatttcttgtgattcggagttaaatggtaggctcacaacctcttggtaaacggtgttcaatcagctgaccttcggtattagctcaaaaaacggcaaaatatgagcagctatttttccgtttgtttctctaatactcaggtcaaaccgctgattttacaacctcttccttaaacggtattcaaaagccagtttctcggtattaagccaaatttatgcaaaaatgtagaaatccattttcacaaaatttttcttaatactcgaaactaagcgactttttcacaatctcttccttaaacggtgttcaatcagctgaccttcggtattagctcaaaaaacggcaaaatatgaggagctattttcccgtttttttctctaatacttaggtcaaaccgctgatttcacaacctcttccttaaacggtgttcaaaagcttgcatctgcggtaataagcccaaccaaacgaaaaatatgagaagctatttttgtttggctgttcttattacttgatgcaggacagcgttttcacaacctttgattcacggttttccagaagtagcttcttcgaaaaataagccgaaatttcttgaagctgatcacttctgtcgcaacctctactgactaaggcttgatataagcataaccttgggattgcagttcaactaaatcaaggacacctgctggtacaacgattacttgttcaggtaaagaactttctgaaatatgattagcacgcatagcattggcgcaagcgtgaaaaacgactccttgcaaatctaagaattctgcattggcagagtctagataaccggtaatcgcgatgccatttacagatacgacaatcgtcgtttctggagaagcttttatcaggttttttacgtttttccctgtttctgaccatttttctaattcatcaatatggaaaacgactttcattgaaatcattcctttactttttaataatcatcttgatcgcttgttctagtttagccgcttgttcttctggattactatcaggtttctcaaagcaatttttcagattatctgcaacgatcatgcccattacgcgatcaatactagaacgaacagcgcttaattgagtgatgacatccatacattctttttcgtcttcgatcattttttggataccacgaatttgtccctctgtacgtttcaaacggttcaggatatttttattatcaatctccataacacattctcctctatttttataattagataataccccttatcggtattttatgcaaatataaaaagtagtgaaaaaaatgaagagtcattctggttgacatattaataaagctcctgtttaatataccccatgaggtatttataaaaatgtaaatgaggtgcagaaaatgaatttgctatttcaatcaataaaatcgataacagtcccagaattaaaggaaaagcttttggaaaatccagcgttacttgatgttagaacacctgcagaataccggggcgggcatataaaaggagctaaaaatgttccattacaaagtataaacagatatgatggagacaaagaaaagaccgtctatgtgatttgtcaatcagggatgaggagtaaacaagcagctaaagaattaaagaaatctggttatgatgtagtgaatgtacgtggtggcatgaatcaatggtttgatcgaacagtaggagggaaataagatgaaaatcgttattgtcggaggtgtagcaggtggaatgtctgctgctacacggcttcgccgattaatggaagatgcagaaatcgttgtttttgaaaaaggaccgtatgtttcttttgcaaattgcggcttgccttattatctttcgggagaaatcagtgaacgggaaaatcttcttgtccaaacgccagaatcattatccgctcgtttttgtttagatgtgcgtccaaatcatgaagtgacagccatctttcccgaaaacaaaacggtagaagtcgtacatgagggtcaaaaacacattgaacagtacgatgcattggttttatctcctggtgcaaaaccagttgttccatcgattccagggataacagaagccgacaatgttttttctattagaaatgtaccagatatcgataaagtgatgcatgcattagaaaaacagccaaagcgtgccgtgatcgttggtgcaggattcatcggattggaaatggcagaaaacctaaaaagaagaggtttagaagtcatggtgatcgaacaagcaccacatattcttccaacactggatgaagaaatggcagcttttatagaaaaagaattgtctcatcaaggagtagaagtgattacttctcatgctgtcgctggatttgaagaccacgggaaacgattgcgactggatgatgggcgtaccatccctgctgatttagttattttatccattggtgttcgtcctgataaccagctagcagtgaccgctggaatcgaattaggcatacgcgggggtatcctagtagacgaacgttatcaaacgaatattcctgatatttatgcggtgggggatgctatcgttgtaaaacagcaaatcactggaaaagatgcacttatttctcttgcttcaccagccaatcgtcaaggtagacaagttgcggacacgatttccggaatttctcgaagaaatcaaggcggtattggaacagcaattatacgaacgtttggaatgactgccgcatccaccggtttaagtgaaagaacagccaaagaaaacgaactgtcttttgaagtcattcatgtatcaggaaaagatcatgcaagctattatccagaagcaacagatattttactgaagttgatcttccatccagagactggcgagatttatggtgcacaaggtgttggggcaaaaggtgtggataaacggatcgatattttagcaacagcaatcaaagggcatttgacgatcttcgatttaccggaattagaattgacgtatgcaccgccatttggctcagccaaagatccagtaaacatgctaggatatgcagcaatgaacattgcagaagggcttagtgaaaccgtacaatggcatgaattgccgacagaactagcaaaaggaaaaattttattagatgtgcgaacagcagaagaattggaaaagggcaaattcaaggaagccaaacatatccctttgaatgaacttcgggaccgattaaatgaattagacagccaacaagaatatatcgtcagctgtcatagcggattacgtagctatctagcggaaagaatcttgaagcagtctggctaccacgtaaaaaaccttgatggtgcattttctttatatcaaactgtccgacctgaagaactgatatatcctaacaaatgatactcgttaaaaagcttgcattcgactcttaaaagaggtaaactaatcggttccaccactttaaaaaaagaggagaatgtgtatggtcaacacacaaaaacagttagaagaagcatatctgaagaacgtgtatcaaaagctaattgataaaaaaaacgaactgcgggaatcgatggatacggcaaaaatagaaggaaaccagtcgttgaaagaaatggctggcgagcttcgattgaattttgacagttacttagataacctggatactttttcgatgattgaaatgaaaaatagagaaatcgatcagatgaatatcaaacagaaaaacgcagaaaatcagctagcaaagatcgaacgtttattgaaaagtccctactttggaaaagtcgttgtagactttctggataatgagccaaaagaatccttttatatcggtacagcaaatttcacagatgatgcagatgaaaatcttgtttatgattggcgttcaccaattgccgaacttttttacaataacatgattggtccatcttcttatacggttcgtcaaaataaaatcgatacggttattaaagaaagacgacaatttcttttggaaagagatcgtttggtcaagttttttgatacgtctgtagctattcaagatgacgtattattagaagtcttaggccaagatgagaccaatgaaatgaaggctatcactgctacgatccaatcggaacaaaacacaatcattcgggatgtgaaaagtcaaaatatcttggtaaatggcgtagcaggaagtggtaaaacctctgctatcatgcagcgtattgcgtatctgctctatttatatcgagatacgatgacatccgatgacttgctgattctatcacctaatcatcggtttatcgactatatttcgaatgtcctaccatcattaggtgaaagaaatccactgaatctaaccatcatacagctggtttcacagctttcagcagaggaaatagaaggtgaagaggcttatttcaaacgtatcacgggagaaaatgtatcggagcagacagaacgtttgcgtagcaaaaagtttatcgataatctaaaacaatcagatcctttgtttttagatcatccgaattttatccgtggacttactaaaaatggaaaaacagtcctttctaaaaaaacgatcgaaaaaatatatgagaaagttcctgctcatcctaaattgatcgataggcttcaagcaacgaaaaaggcactgatgagcgaatggaagaatcatcttttgaaacaagcaaaaagtcctgctgtgcagaatcaggtactctcgttgacagaagataggcagttggaattattcggtaaattgatttctgatgattcggaacaaagtattgtagcttatgcaaggaaacttttacaaaaaaaatatcgaaaaataaccagacaaatcgaagaaatggcatgggtggatgagcatcagttgtttgaaagaatttatgaaaaacgatatggctcagcttatgcttggcaacccacacgtactgttgatgaagcagtcattatattagctattcgtcatttacttgttgaaaaggtaaatgtaccagcatttcgctatctattgattgatgaagtacaagattataccctggcacaattaggtctattgatcgaattatttccaaaaactcactttactttagtaggtgacgagaatcaggcaatctttaattcttccactacttttgctgatattatgcgttgtttcgacgactaccatctgccgatccatcggtatgatcttagaaatagttaccgttctagcggagcaatcacagagcttttcaaaacctatgctgtggatcaagagaagatcgacatcgtatcgatccgaccgcaaggaaaagaacccgaataccgctcttttcgatcctctgaagaattgttgaaaatactagctgagattttggtttctctaaaaggagaaaaagcggcagttatcacccaaacagaagaggaaacccaaacgctacaagaatcgattaaaaaaaattcatatggattagaaaactgccaaatcattcctttgagtctagcaaaaggactggaatttgatcatgtaatcttatatccatttgaaaacgatggagatgagcaaagaagacgcagacaaatgtacacggcgatatctagaggaatgaaaagcattgtcgtattggaaagagcaacataattaagagataaaaaataaaaagaacaactgataaaaagaacaaaatatttttcatttgctgatgagaaatgttttgttctttttcttaggaaaaatttaggaacactttatgtgaaaagaaatgaaatgtatggtaaactcctacgtcgtaacaaaaaaacgtgaggtgaggatatgaaaaaagtaacaagagaagaagttgcatcaattttggtgaaagataagtatttttcaaaaggtaattactggttaagatttggcaaacgttagtggctcttttaggatggatgatcgttgctcttccttttatatgggtctttttcccattaacgagaccagaaagagccaaggatttttccttgtacgcttttttatcagaaaagaaaatgctgtatttcttaatcggcttttttgtattgatttttttcagtttcctgattacctcatttgtattgactaggtggaacaatcgaaatctatacaaaaaagtaaataaatcttttgaatatgaagatgaaaaattgaaaaaaagacaagaattacttgaagaagtgtatacggaacgttttggaacaaaagaagagagagaaacggtccgtttttattctgtctccgaagagaaaaatctagatacgacattcattgcagatttgtataaagaaaatggggtggaactgaaatgatctcaatcacccatacaggtaatttattcttagatacttgtttgtctattatgtatttttttctcgtttcttatccgattttaggcggatttgtatggtttattggtgtctggtgttatgtgtttttatacaaacataagcaaaaagaatgggtagatgttcccttgagtgtcgaaccgttcatcacgatcatggtgccagcccataatgaagaaattgtgatcgaatatacaatcgagtatttgatgacgaaattgaattatcacaactatgaggtattagtgacagacgatggttcaacggaccaaacaccagaaatattagctagactgatgaaaaaatacgctaatcttcgtgtggttcggatcgaaaaaaataaaggaaaagcccacgcgtttaatatcggacttgcctttgcaaaagggaaattgattttaagcaatgatgcagacacggtaccggagccagatgcactgattaggtatgtgaattatttcattcgccctggtgcaagacatattgctgcggtcactgcaaatatggatgtccaaaatcgtaccaaattgattgcaaaatctcaaacggttgaattctcaagtatcgtgggcatcattaaacgaacacagtcagctgttttcggtggtctttatgcgtacagtggagcaaatacgatgtatcgaaaagaagccttgatcgatgtgggcggattcagacaagatcgagcgacagaagacatcagtattgcttgggatcatcagttaaatgactggttatctgtttttgctcctgagattatctttttcatggaagtacctgtgacgttgaagatgctatatcgacacagaaaacgttgggcaaaaggtggaacagaagtctggctgacgaatttcaaaaaagtgatgctccatccttttaaacatattggaagaacgatcatcttcattgatcaaacattgagtattgtctggtcaatattcttttgtatttccgtagttctttttgctggattaatcgggcattatgtatatcaaggaaactacgaacagatttatattacttttacattcagttttgtgttcatctgctttgaaatggtcgcaggatttttccagttgctagcttcgctgattgtagatgatcgacgaagaaaattgaaataccttcttttcgcaccactatatatgcttttgttctggatagtgaacgcgataacgatcgtgacgactttcattccagcagtcaaaacgattttaggttatggaagcgggacatggaaaagcccggaacgtacaaaaaaataaaagatgcaccgttttttagacaaacagcctgttgtgtttatggttcttccaaacatttttgcttataataagaaattagttaaaaagtagtaaggatgggaaaagtgatgaaaaaaagaatgaagccgttaatctggccaattgctgtttccagtattttcttattgggacagacagcttttgcggaaacttctgaacctgctcaaacagaaccttcaacaaccataagctcttctggtgctgaaaacggtgcctcggaaacagaaatgacttccaatgtaccgacagataattcaggagaaacgatttcatcttcagaagatacatcaataaatagttctacctcttctgaccaaatcgatcatttgcaagacttggaaaataaaagaaaagaactcgaagaagcattagaagctgcaaaaaacaaattgaaagaagaccaagcagcaatcgatcaagatttagctgatcttaaaaataaagtgggaaatgaccgtgcacaacttgagaaaaagcttgccgaagcgaaagcaaaagcggaagctgtccaaacagatcttgacgggaagatccaacaagcaaaagaattcaatcagcaattaaatcaggttgctcaaacagcttctggaaagctaagtcaaactcaagcggatatcacagcggccagtcaagcaatccacggaaagatcagcgaagcacaaacagttgctaatgattttgaagcaaaaaaagctgacttagcagctagtttccaacgaataaaagatattttgcattcggcaggagaaaaatcagtgacctctggaagcacgacagaaacagttcagcaaacgacagagccatccaaatcaacaagtcagactttgccaaaaacaaatgaaaaaacagcttctgtcagttattccttagcaggggcgggtgtgttagtcgcagcagcttacggaatcatccgcaaaaagaaataaaaaagagaggatgggaaggtagagtacctcgaagttagactgaaaaatctaattcttgagtgccactacatgtcccatctctctttagttattaaaacagatgtcccctacttatctcgtggagacagctgttccactacatgtgaccatcagcatgccattgtcgctgcctaatacttcatagtccatttttacgccaatgatcgcatcagctcctaatgcttttgcacgttcggccatttcggcaagtgcttcttctcttgcacccattagttcgttttcatagctttttgagcggccgccaaagatatttcgcaaccccgcctccaagtctttaaatgcatggatcccagtaatgacctcaccaaaaacgatccctttataagctactacggcttttccctctacactgttcgttgttgttgtaatcattcgatcactcctctcttttaattaaagtataacaaacttcaagaagcactacacatattttcccaaaattagaaatttattatatacttgaattgttcattaatgaaagcgaaaccaatcgttagcaactatgtaaaagaaaggaagattcttgtgaaaaaaagtattttgcttatttctcatagtcaaaaagtaacagatggtattaaagaaatgattgagcagatgcaaaaatccgaagaggtgcaaattttttctctcggcggaataaatggcgagatcggatcagacccgatgaaaatcgtagaagcagtcaatgaatcaagcgatgcagctagttattttgtttttgcggatatcggtagcgcggtattgaactcggaactggcaaaagacatgttggaagaagagcagcagcaacgttatcatctggtggatgcgcctttagtggaaggagcttttgcagcagccatcactgccggtataacagatgatactcagcaaatcttaacagaagcacaaaatgccggaaagaaaggatgggaataaattgaaaaaaatcatgaatgatccaagcaatattgtcgaagaaatgctggaaggattagtaaaaagctatccagaacttgttcatcgtgtagaatcttcccgtgttgtagccaagaatcagaaagcggaacaagttggtttggtttctggtggaggaagcggacatgaaccatcccatgccgggtttgtaggggaagggatgttaagtgcagcggtgcttggtgatgtgtttacttctccaactccagatcagattcagacggctattaaggaagccgatagtggaaaaggagttttgctgatcgttaagaattatacaggggatgcattgaacttcgatatggcaaaggaattagctgctatggacgatattgaagtagaaagtgtgatcgtagatgatgatatcgccgttgaaaatagtacgtatactgctggaaaacgcggagttgcaggtactgtccttgtacacaaaatcgtgggcgatgcagcaagaaacggtgcttccctagctgagttgaaagaactgggagaaaaggtcgtacaggcaactaagacgatcggtctagcgcttcgagcagcaactgtaccagaagtagggaaaccaggattcgaactaggagaagatgagatcgagtatggtgttggtatccacggtgagccaggctatcgtcgagaaaagatgcagccttctaaagtactggcaaaggaacttgttactaagattttagatgattactcgaatttaccaaaagaagcaggtgtactagtcaacggaatgggcgggacgcctttgatggaacagttcgtgttcatgaatgatgttttagctctgttggaagaaagaggcgtcaatgtagttttccgaaaagtcggtaattttatgacctcactagatatgcaaggtctttctctaacactgatcgacttgacggagacacaatggaaagattctttagaaagcaatgtacagacgatttcatggtaaaaaatctcaagataaaagggtgataatatgaaactaaccgttcaagaaatccaagaatggctcacgcaatttgcagaggcaatcaatcagaacaaacaatatctcagtgatctagataccccgattggcgatggagaccatggaaataacatgggaagaggggtttcagcttatgaagaagcttttcaagccgatcatcctgaaacaatcagcgatacattcaaagtattctctatggcgatgatatcgaaagtcggtggggcttctggtccgttatacggatctgcattcatgaacatgatgaaagcgacaaaagaggtcgattctattgattctcaagaaaaattaggcgaagtgatcgagcagggaacagcgggtattcaaagccgaggaaaggcagaagctgacgataaaacgatgttagatgtttggctgccagtcacagaggcattgaaggcagggaatttaacaaaagaaatcattgaccaggcaaaagaacacaccaaagtcttggtagctaaaaaaggacgagcttcctatctaggagagcgtgcaatcggacatatcgacccaggagctgcttctagtgccattttattttcaacgcttttagatgtgatcaatcaaccttaagttcaataaaactgcggtgatgctcatcgcagttttttgtttggctgttcttatgacttgatgcagaacagctttttcacaacctctatttgtccatatcgcaaaattcaggtagaatacaaaagataacggaaagaggcgaaacaatggaacttggaaaatcagattatcagttgtttgatcgaccaatctacgcattcaaacagctcaaagagagccatccaacagataagattgaacaaatcaagaaagaatataaagaacactggcaaaaatggaaagagattcagctccagacagctgcacttttgcctgatatgtacggcatgagcaaacctaaaatcgaaagctggacgaatggctggaatttacgcagtcatttttggagcgcgtaccgaagcgaatctcgtcaagacgagaatgcctgtctagcagttttgttgaatcaaaaacaataccaaatctatttgatgtaccaacattataaaagcgaagaacgatatggtagcattgcagcgtataaccagttgcttgcgatactgaaagagtggagcaaaacagtcgatatcaaggattattacatatggccgcaaccagaacatgaacttgacgaccacttagctttgtctgactatttgtccgatacaaagaaacaagaagagttgaaaaaagcgatgagagaccgaacctttcaaatgggtaaactattcttctatccgcaagaaatcgaacacgttgagcaaataaccgctgaaaccttacaagaactagcaccactatatcaaaagctaggtgcggaaaaatttcaatagacaacacgaaataagcaatgcgaaaaacaaaccttactctcggcttgcgagtgaaggtttgtttttgattattcaaaaagtaaatatttaaaaaattgataggaatcaattacttaaggtctcaaaagaaggaaaataaagcaagggacaaaaagaaatccactctatttgctggtatctggttcgcttgacgtttatgctatgataaaagaaaattatcagttggaataagggaagttatgtttctttattagaaatagctgtttagaaggaggagagattatgagtcatgatcatttatgtgtttcatttgttcctttgttcaatcacttagtacagcaagatcaagaaaaagtacacgcacttgtcaaacatcactatgtggaaaaaggagaacagattcttgcgccgaatggagaacctcaattagtgatcgtggcctccggcagtatgaaagtgtatcaattatctgctagcggaaaggaacagcttttacgagtaatagagccgggcggatatgagggagagagccagttgctaggcgttccaaatgagtctttatttggcgaagcactagaaaaaacggaaatttgcatattgagacaaaaagatttctcggaactcttactgcattatcccgcccttagtctgaaacttttagcaatcaacgttgagaaattaacaaaagtacagcagcagacaacttttttgatgatggaaaaagtagaagaacgagtcgctgtctatctgcttgacttagctaaagcgacagggaaggatcactttttcctgccaatgaaaatgaaagaacttgctgcatttatcggtacgacccccgaaactttatctagaaaatttaaattattagaggagaatggttatgtaaaaagaaagaatcgagaagtctggatcattgataaagagcagttagaagacttgtaaataaaaaaatgacctccaaatgttggatttttgacccagatttggaggctagcatgaaattgtacatgcttttttattatccttctagtaagtctcttcgcctataaccaatagaaccaaggacgaacagtgcaaggctgatacatgataacgtaaggaacacggaaagatcaaaagaatcgtttggcatccgtggaacccagctagggacagctgttttggaaaaccattctggtaaatccaaaattccgccaaagtaattgagtgcaaaggagtaagctaagtagatataagcaagtttaccgattcgaggaagccatccgaatagaaagccactaattccgataaacactaaaacggcaggcaggaaattgaacccggctttaagaaacatcaatagatccatgtctttcgcatccttcatcgaagccaaagcagaaagccctagtgcaccagaactaatcaggattgccaatatagcaaatagaatagctagtaacatattggtccaataaagttggttcctagaaatttttgttgcgaacagctgattcatacgtccgtgggtttcttctgtaaataaacgattgatgctagcaattggtaaaatagcagctagacaaatcaagactaccatgatcgtgcttgtaaagtttttttcaattgagacgccagattggataaacatctgtttcattaagtcgttactttctaaaaactgttgcatattcccgtagatagagccgtatgccgcccccatcaaaccaaaagtgataagccaactgattgtcatccctttatttagatagaataataaaccacgcaaggataaaagagaacgtttagcatacggttttccttcacgttcggggatatagccggtgttcaaatctcgatgttcctctaaaacaaatgaactgattatcaagattagactgaacaaaaacaaataaagcaaaggaatccagttgttagttgtaaatggataggtcaaataagaccagcctaaaggattccacatcgaaagggaggaatcagctacatctgttattgctcgtagaaggtaaagtccacctaaaaacgctaaagacagaccattcgaactggctgaacttggcatcagttgtgcagcaaacagtgcaacggcactccccaaaatccccatactacctacagatagcccaaaaagccaagcaccttctgcagtgatcgaatccgcttggaaaaaaatcatcgtacagctgatcgatattgctaaaagcaaattgatcagaatactttcagcgatgacagctaaagagtttgcttgacgtccgactcgaaaggaacgaataagttcaatcagaccaagttcttctttttttctcgtttggctcaccacgtgtaaaacagagatcacagcagcaaacaaactgcaaaaaagcaacatttcatttgcatacatcgctcctaaagtatactcagcagcattcgaagctggagttggtccgaccattgcaatcattgccgggttttgcaaggtttcgtataatccagctaatccttgtccggaagtcaattcttcaaacgcagggacaaaaccaccagaaaaagcagtgacaccgactagccatatcaggatctttttccagtcacggctaaggttttgagaaaaaagggtggaccagcgtgaaaatttatcagtcatttcgcttcctcctcatccttcataatgtctcatgaataaatcctcaagagtcggtggaatagattcaaattttttcacacctaatttggacgcttcagctaaaatcacatcgaaagcttcgttatcagcagcaaattgagcgaggtgacctttttgcacaaagtcatggacaccgttcaattgtgctaagtgactattctctgcttctgtttctatagtgatggtcgaacgagtcaaatgacgcaattcatcgagtgttccttcttcatcgagtgttccttcgcgtatgatcacgactttatccgctagtcgctcgacttcactgagaatatgagaagaaagtaggatggatttgccctgttctttcaatttttcaacttcttcttggaaaatcgtttccatcaaaggatctaaaccagaagtaggctcatcaaataaatagagatccgaatcaacagccaaagcagcaatcaagcccactttttggcgatttccttttgaatagttttttgcttttttcttaggatcaagagagaaacgttgaatcagttcatcttttttttgagcactcccttttccatgaagcttcatgaagagatcgatgatcgctcctccagtcaaatttccccacaaagagatatcgcctggaacataagaaagacgttcatggatagataaactatcttcccatacatcttgcccaaaaatcgttgccgttccgccgtctttttttataatccctaaaagtgtccgaatcgtcgtggattttccagaaccatttggtccgataaatccaacgacttcacctgaatgtacggtgaaagagacatcttttaaagcttcgaaacgaccaaagctctttttcaaatgtgtgactttgacgatttctgccataaaaaccccactcctttttctaaaaatatatactaaacaagattaaatagtttaataaaaaggttttatacctttttataaaactttttttattattttagtacataatattctttttataaatttctgtcaatgaattcataaacaaggaattgctagcttgatactttctcaatagatagttataataaacctcagaataaatttgaactatatatattataaaagtttaaaattacgggaggctctacaaatgaacggttttgaaaagagagcacaagagaaaaagaaagagattttacaagcagcttttgacttgatgaacacagacataggaaccgctggagtgacaatggataaggtagctgagaacgctcaggtaagtaaagcgacgatttttaaatattttggcagcaaggaagggctgatttatgaagtattttttgcatttatgaatgatttagggcaagaagcgaaagcgttgattgcggaaaatcttccatttgaagaaacactgattgccatgagtgaaaacaaaatccgttatctcaatcgagtgaacaaacaattttatatcgatttgatgacatactatacaaaaaaagaaaaaaaagaattttctgacgcgatggatgcgtatacgcaagaaagtttcagtatcatgcttgatcttttccatcgagggcggaaagaaggaaaagtggatttgaaatattcggatgagttcttgatcctctattttcaagcaatggtagaaggaatttctaagccggagatatacgcaaaactgcttccatatacagcagaatggacagaagtcctgatcaagggaatcgcaccgaagaagaaataaagcataaaaaagccgaaactgacgataaaatgtcagttcggcttttttggttcataaatgacgtaaaatcaagcagattcgcgtgcttctttgtcatagacatcatggacattgatgaatggatcaagaataggattttttccgtctaaatcagattgaaaacgaatgccatcgatattgatccgagcatttcgatagaaatccgtacctaattgtccccaagctggtgtagaagcatcgacattacagaaaatatcgaaaccttgactcttcaagtaagcaaatttttgattttctgctgaataaggctgccagtcgctgatgtctgcaccaaatggataaatcagaatatttgtttttcctaggataggtgcaacttcttgctgccacaattcattgtctttttttacatcttctagtgaagcttgagtcatattcaagtgaccccatgtatgggaagcaaagctccagccgtctttcttcaactgttccgccacttttttagcttctttaatctctttttttgttttttcattgtctccatattgagattttgatgttcgataacctaaaactccgttgtaacctgtcagggccaaggtaccttttgcgcctcgataagaaaaatcaggatgtttcttgacaaaggcatcgatcagaggaaccatgtcaaagtcaccgatttcttctttatctttctctttatagacatttttgatttcattgttatttgatacgaccaatcggctaggaaaaccggaattatccatatattcataatagctgacatcatcttgtgaaagaaccaatggtttttttccttcaggtagcgcaagcccgttaaaggaaagatttccttgttcgtctttttggatcaaatcattcaaattaactaaaacaaaatcattttgataaagttgttcgatcgaacggttgaattcttcaacagtcaccatataatctttgtatccttgtgcctgttgagagtggaaggctttttgcgggtccacgatcaagctgtggaaaaagacatgagagatctgagtaggatcagaccagtcgatcagttgttctttctccttttttagtgtttgaagaagctgttgtgtttcagtagatccgttcttactatctttttccaataacgcaatcgcttggtcataatcgtagctttgagccagattttttgcttgagtaactagttgttgcttatcatctgtcggttcttttgctttttctgttatttttttttcaggaatgattggttctttttttgtagatgatcggatgacaaaaaacaaacttagaattaaaataacgatagttaaagcagaagtggctcctaaaataattttttgctttttttccatatacctcgtcccttgctttttcatttttttacttgtcccattccttattgtaacgaagaaagaataagaggcaaagtaaagtgacttctcgataaattgcagaaaaaatacagaaaaagttatttcttttaacaataattgaaaataaaatgttcggaattagagcggattcaaaaaagaaaaaatgaggaatttaaaaaaatatcctttttctgttgacaaagaaaaagttgcgctctatgatagacacatattaataataacaagacgaagatcgaaacgaagtagttgttaaagccaatgtttcagaaagctggtggtcgctgcaaaccagtacatgctttaaagcgaattacatttcaggagtctttggcagtgattgccacgcgacagcgttaaatgttcgagaggtatgttggatatctagacatacaaattgggtggtaccgcgagatttcgtcccttggcttatatgccaagggactttttttatttcctatcctatcctgaagaaataattaattacacatgctagcaggttcctgctttcataaaaaaactacacggaggtcagtaaaatgaatattattgatgaattaacttggcgcgacgccattaatcagcaaacaaacgaagaaagacttcgcgagctcgttgaagaaaagagcatttcactttattgcggcgttgatccaactggtgattcgatgcatatcggacatttgattccatttatgatgatgaaaagattccaattggcaggccatcatccatatattctgattggcggcggaacaggaacgatcggcgacccaagcggccgcaaaacagaacgtgtgttgcaaacgatggaacaagtgcaacataacgtggacgcactttccaatcaaatgagaaaattgtttggtaaagatgcaaatatcacatttgtgaacaactacgactggttgtcaaaaatctctttacttgaatttttgagagactacggtaaaaacttcaacatcaacacgatgttagcaaaagatatcgttgccagccgtttggaagtaggaatctcatttacagagtttacttaccaaatcctgcaatctatcgactttttgcatctgcataaaacatacgatgtgcaattgcaaatcggtggagcagaccaatggggaaatatcacagctggattagacctaatccgaaaattagaaggaccagaagcagaagcgttcggtttaacgatcccattgatgctgaaggctgacggaacgaaattcggaaaaactgcaggcggtgccgtttggcttgatccgaagaaaacttcaccatttgagttctaccaattctggttgaatcaagatgatcgcgatgtagtgaaatacttgaaattctttactttcttgtctcaagaagaaatcgaagacttagcgaaaaaagtagagacagaacctgagaaacgtgaagcacaacgccgtttggcagaagaagttacaagatttgtgcatagtgaagaagacttgaaagaagcgcaaaaaataacgcaagcattgttctctggaaatattaaagaactaaatgcggaagaaatcgcgcaaggattcggtaaaatgccgaacgttgaaatttcaagcacacctgaaaatatcgtggaactgcttgtttccacaaaaattgaaccatctaaacgtcaagcacgtgaagatgtttcaaacggagctataagtattaacggtgaccgcgttaccgatttaaattttgtcataaatccatccgatgaattcgatggtaagtttgtggttattcgaaaaggtaagaaaaattactttttggccaaagtaattgattagaatttagtaagtttttaccttgaaaaagggaaatactattacaacattccaattttgaaacccatcctaaaatagaacgctggttgtcgttaatacaatctttgcgagggagtttacatttgtaaattccctcgttttttttaattatttcaaaagtgtgaacaattcggataattgatacatattaaaatatgattaaaaatcaggccaaaacttagtttacagaatagaagaacaggtgtaatgtagggctcgacaaaatttaaatatttttttaggagggtttcactatgagtgaatcattgtcgaaagatctaaacctaaatgccctattcattggggacaaagctgagaacggccaaatctataaagctttgttgaatgaattggtggatgaacatttaggctggcgtcaaaactacatgcctcaagacatgcctattattacgccagaagaaaaaagcagtgctagttttgaacacactgtgaataaaacaaaggatgttctatcagaaatttcagcgcggatgcgtacccattccgttccttggcataatgccggacgttactggggtcatatgaactctgaaacattgatgccatctttactagcgtacaattttgctatgctatggaatggtaataacgttgcctatgaatcttctcctgcaacaagccaaatggaagaagaagtaggaatggaatttgcaaaattaatgagctataaagatggctggggccacatcgttgctgatggttctttagcaaacttagaaggactttggtatgcccgcaacatcaaatcattgccgcttgcaatgaaagaagtgacacctgaactagttgctggaaaaagcgattgggaattaatgaacttgtcaacagaagaaatcatgaatctgttagacagcgtcccagaaaaaatcgacgaaatcaaagctcactcagcacgtagcggaaaacatttagaaaaattaggaaaatggttggttccacaaactaaacactattcatggctaaaagctgccgacatcatcggtatcggtttagaccaagtgattccagtgccagttgaccacaactatcgcatggacatcaacgaacttgaaaaaatcgttcgtggtctagcagctgaaaaaacaccaatcctaggtgtagtcggtgttgtaggatcaacagaagaaggagcaatcgacggtatcgataaaatcgttgcattgcgtcgcgtattagaaaaagacggtatttacttctacttacacgtagatgctgcttatggcggatacggccgtgcgattttcttagacgaagacaacaacttcattccatttgaagatttaaaagatgttcattacaaatacaatgtctttacagaaaacaaagattatatcttagaagaagtacacagtgcatataaagcaatcgaagaagcagaatctgtaacgattgacccacataaaatgggctatgttccatattctgccggtggtatcgtcatcaaagatatccgcatgagagacgttatctcttactttgcgacatatgtatttgaaaaaggcgcagatatcccagcattacttggggcttatatcttggaaggttcaaaagcaggggcaacagcagccagcgtttgggcagcacaccatgtcttacctttgaatgtcacaggatatggtaaattaatgggtgcatcaatcgaaggtgcacatcgtttctacaacttcttgaatgacttgtcatttaaagtaggagacaaagaaatcgaagttcatccattaacttatccagatttcaatatggtagactatgtattcaaagaaaaaggcaacgatgacttagttgcaatgaataaattgaaccatgacgtatatgattattcttcatacgtgaaaggaagcatttacggtaatgagttcttaacttcacatactgactttgctatcccagactatggcaacagcccattacaatttgtgaaccaactaggattctcagatgaagaatggaaccgtgccggaaaagtaactgtattgcgtgccagcgtaatgacaccatacatgaacaaagaagaacactttgaagaatatgctgaaaaaatcaaagcagctcttcaagaaaaattggaaaaaatctacgcagaccaattattggcaagcgaagcaaaataagcaaggtaatcatgttagaaaacagcttgaatactaactgtttctgacgcatgtttggatctgaagagcaaggggagacctaagctcttcgatccctttgttttgaggttgtctttgaagaaacccttcaagcaataaactcaaagaatcccctcaaatattcgctgaattgtttcgtttattgctgaaactacttcaaagacaccgttattttatccaaaaaatcaaggagagtgtcaacggtgagtaaatctgaagtaagtaaaatgggtcttgggacctttatcggtctgacaatggcactgtgtgcaacggttcggagtattcctacgttagccgcagtcggttggacattgattttttattcaatttttgcagttttgttttttgccggtccgatatcaatggtttccggtgagctttccacgatgcttcctcaagaaggcggtcctcagttatgggtaaaaacagcactgggcagcaaatggggatttgtcgttgcatggctattatgggtgcaaatgttcccaggtatggtaatggtcgcttctactttaggaccattgttaggaaacacatttggtaatgtagaacttggcaataatcactggttcgttttaggttgtattttagttatctactggatcatcacgatcttgaacttgaaattcgatatggcaaaagtcggcgggaacatcggtgtatggctaggggtatatatcccagtagtcatcatgttcgttttaggtgttttggcagccttcaaagtcggactagtctcaaacggctatctaggtgacttttcatggtcaaaagctttccctgacttggaacatattgattcattgaaatacttagctggtatcacatttatttttgttgggatcgaaatgagttctgtttacatgcctcgtttgaaagacgcaacaaaaaattatacaaaaggcgtatttatcgctttgatcggattagttttattgaatgtcatcaatgcgatgcttgtagcaaatgtcgtaccagatggaaaaatggaattagcaaatatcacgcagcctatcttgattgactgtcaaatcctaggcttaccagaagtgatcggaaatatcttcagcttcatggtatttattggtgtgcttttacaattatcagcttgggttactggaccatcaaaaacaatcatccaagtagctcgtgaaggattccttccaccaaaattcggattccataaagaaaacaaatacggcgtatctagaaatgtcgttctaacacaatcaatcgttatttcattatttgctttgctttatggtgtaatggatgacgtaagtgctgtattcttgacacttacaaatgctacaactgttatttattgtatcgtgtacattttgattgctgtttcattgcttaaaatgcgtaagaaacatccagaattcgaacgtccttaccgaattggtaaaaacggaaacggattagcttgggtagtcagctgcatgctgatcttctctatcatcgttgtcgtatttgctacattaggtacagcgacattgagtgatgcattattagtagcagctatcacagtggtcatgttcgttattccattgatcatcaatcacttcaagaaagattcttgggggattgaggtagaaaaaagtttagaagaaaaataaaaaaataagtctttcagccgacgttttgtcgctgatttagtaggaggtcctgccaagtgaatagttttttcatggcagggccttttcatttgaaataggagatcgacgatgaataaaaatatttctttaaaagaaagtatcgctgtattgatcgtgttgttggcactcctaggagtactgatcatcggattccagctctcgccacatatcccgatccttgcagctttcatgtgtttgttgttttatggcagatttaaaaagttcacatgggatgagatccatgacgggatcatcaaaggaatcactccagggatcattccaatcctgatttttcttttgattggtgtcttagttgcttcatggattttatctggaaccatccctacgattatggtttatggatttaaacttgtttctgtgcgtttctttttaccgacagcatttcttgtttgtgcaattgtcggagtgactgtcggcagttcatttacaacgatttcgacgattggaattgcttttttggggatcggtcatttacttggattcaatgatgcaatgactacaggcgcagtcgtttccggtgcctttttagggaataactgctcgcctttatcagatacgaccaacttggcagcgggtattggaggagttaatctattcgaacatatcgctggtatgcgttatacggatttcccagcattcgtcctttcgttgattttttatacgatattaggacataacagtcattcagccgatctagctagtatcaatgaaatgatccaaaacatgaaagcgagcttttggatctctccttggacattgattccactagttattttatttgggggggcaatcaaaaaaattccggctatccctacattactagcgggatcgacagctgctctcgttctttcttttatccatgagaaaagtttgacggtcggaaaagcagcagacatcttgatgaatggttatgtcgcaaatacacctgatccaaagctagatgaactgctttctcgaggcgggatcatgagtatgttaggttctgctagtttgattttacttgcattggcattaggtgggttactgatcaaatatctgatcgttgataccatcgttcaagaattaaaagaaaagatggaccgaccttctcgtttagtcgggtttactgccttgagctgtatcggaatcaatctgatcgttggagaacagtatctgtccatcattcttccaggagaaacattcaagcgttcttttgatgacgttggcttatcaaaaacctatttgacacgaacactagcggattcaggtgcgaccgtcaattctctcgtaccgtggggagtcagcggcacattcattatgggaacgatgaaagttagcgcgttgcattacttgccattcgcctttttctcgattcttgcacctgtctttacaatattaggcggttttttattgaatcgtcgacgtgtaaaaaattgaaggaaggaaaaaagaggctgggacagaagcgtttaactccaagaaataagaagaaactcaagaaaattgctttttaaatttttgtgaatttcagcttatttccgaaggagttgcttctgcttccgccgtttatacgtgtttagagcgtgagacaaaagtgttctttacttttgtcccacgctcttttttacagataaacaatgtgttagaagtagtatcttcttttacataaaaagctgaccataggataaatggtcagcgtatttagtgagtcagctatttagtatgggttttctaaaggaacgactgtctctcttttgatcaagcgatgagggatgaccaaacgtacgccactgctcaattcttcatggatcaattcgcgcagcttttgcatagcgacacgtcctaattcggagatatcgatatcgatacttgtaaggtaagggtgtgttaatgttgagaagatcgagttgttgaagctaatgacggagagtgtctctggaatgacatagccatacatttgcgccaactgcatcgtgcgaagggcgaagatatcgtcaatgaccaccaatgctgtggcttcgttttctttcaacgttttctcaaaggacagataatcctccggatgctctagtactacactggataacgcaggaagaccagccatcatcattgctttttgataaccgaaatatcgttcgaaatacaaactttcatgagtcgtgtttgtcacaaacaggatattcttatgtccattctggatcaaaaattctgttgcttgtttacctagaagctggttatcattatctacataaacgatttcgttctcatgatgataaggctgtccgatcaaagtgaaagggatgtggttttggtataaataatcaatgacagtatcttgactatctgaatacactagaataaaaccatctacttgtttttgtaaatgcatacgctggacgttctctaacagcaattcaaaatttttagcagtagcgattgctgtagtcatatcataattccgcgcttcttcgttgattgcttccatgatctcaagataaaatgggttaccgatccgctcttttgaatcaagagggggtaagattacgccgatggcactggaaatgcgttttcctagattgcgggcagtcatgttaggaacataacctagttcatccataatttttcggactttcttctttgttgtctcggaaatactaggatgatcgttgatgacacgagagacggtcgaggtggcaacaccggcttttttcgccacatcttttacggtaatagccatgataaaaacacctttctcttgttattgtgcagagaaccgataaatcgtctgactgatccgttcttgaccaggatggaggttgatcgatccaaatttggggaaatgaacgatatcagggatttcttgcggttcgattgctaatccgtagtttgaatgcatctgttttccattgacagagaaatcagcttcgaatccagtcgtagaaaataataccatacttttattagaagttgctatagtcatttggcgaccagaatgcttctcgaataattgtaaggaagttttggaaagcctaggatgatgcaaaagaaatacatcatctagtccatctggataacatgcaaggatctcttgcagtgttggggattttctaaagtcgattggcagtttttctttttttgtccaatttccagtaggcagtttttcttgatctaattcaagcacaccatctaaaaagaccgttaactgatgttcatagatgtctcttgttccatttcctgaaaggttgaagtaggcatggttggtcggattgcagatggtttcaacaaggctactagcagaggttgtcatctctaattcgttttttgttaaacggtaagtgatcgtagcagtgattggtcctggataggtagaaaattcatcttttaagtaaaagaccacacctattgatgatggagttttgaaaacttctacttcccaaaattggaaagaccagcctttcgtgccaccgtggatatggtgtgatccgcagtttttctccaatctatgctcaccccaagaagcatcccggatccttccggctacaggtccgacagttgctccaaaaaagcttttgtctgttagaacatcttcgaaacgatcgtaagacaataaaacattttctgattttccttctttgtctggtgcgaagatttggtgcaggcgggcaccgtaattgagaagaacgacttctaagtagtcgttcttcaatgtgattttctttatttcagtctctggaactggtacgacggagatctctggattatccatggtcatgccacttttctttcaagtaatcgatcgtaagaaaagtcgtatcagggacaagcgggatctcctctccaaggtcttcagcacgtcccacgccaattggttgagctccacttgagaggatggcttggataccggcttgcgcgtcttcgatcccgatacattcttctgcttttagtccgacagcttttgctgcaaggaggaagatatctggcgcaggttttccgtttgttgcttctgccgggtcggcaatagcatcaaagtaaggtgtaagacccattttttcaagtaggaatggcccgtttttacttgcagaagcaagagcaatcttgattttttcttcttttaaagaatccagtaaaggcacgaccccggggaagacatcttttggttcgatcgtctggatcatctctaaataataatcgttttttcttttcgctaattctgcaaattcttcctttgaaaaagagtgttcttttccgccataagctaaaagcaaagagagtgagtcttctcggctgacgccttttagctgttcgttgaatgtgtggtcgatcgtaatgccgatttcctgaccaagctttcgccaagcacgataatggaattcagcagtatcggtaatgacaccgtctaaatcaaacaatacccctttaaacatttgcttcctcctttcttagcgttatttctagacgatccgctaaagaataagactgttcatagacgtaaatttctagaggagaaccttctaataactcgaaagtaacttgttcatctgtgactgagatgaacaataaacgtccgcgataattgatatggaaagaataagctttccaagtttttggcagaaatggtgcgaatctcaactgatcatgggcagttttcatttgagcaaatccttggacaatcgacaaccagctaccagtcatggaagtgatgtgcaagccgtcttctgtgtcgttattgtaattatccaaatccaagcgagctgttcgctggtacatttctacagctttgctttccattcctaattctgctgctaaaatcgaatggatacttggcgaaagggaagactcatggacagtcattggttcatagaaatcaaagtttttttgcttttcttcttttgtaaaagtatcattgaagaaataaatcccctgtagtacatctgcctgcttgatgaagcaagatctaaggattttgtcccaagaccaatgctgattcagaggaagatcgcttgtgggaatatcggatacaggcatgagatctttatctaagaatgtgtcatgctggacaaagattcctaattcttcgtcaactgggaagtacatgttctctgcgatatctttccatttggctagttcttcttcgctgatagtgatagcagcttctttttgataagttaaataattttctcgcgtgtaacgcaagacccaagctgcgatcgtatttgtataccaattgttattgatattgttctcatattcgtttgggccggtcacaccgtggatcatgtatttatttgctcgttttgaaaaatggacacggtctgcccagaagcgtgcgatttctgctaaaacttccagtccttcatttttcaaatattccgtatcgccggtgtaattcgtataattgtagattgcataggcaatcgcgccatttcggtgaatctcctcgaatgtgatttcccactcgttatggcattcgacaccagtgaaggtgaccataggataaagcgcgccttttaatccttgttgctgagcgttgtggattgcttgcggcagttgattatgccgatatttcagcagattcttagttacttcaggtttggctaaagcaagataaagagggacagcatacgcttctgtatcccagtaagtggctccgccgtatttttctcctgtgaatcctttggggccgatattcaatcgttcatcttcgccgtagtaagtagagaatagttggaacaaattgaatcgaataccttgttgtgcttcttcgtctccttcgatgaccacatcggcaagcttccatcgttctgcccaagccgctgtttgctcttcttttgcttggatataattgtttgtctggttcgttaattctgagacagctttttctgcttgctgcgcttctggaatatctctactagtaagaacgataatttctttttccactgaccatgtctcaccttgagataattctgcagacaagcaaccatgtaatgctaaagtatcttcgtgatagtcagggatgactgattttccattaacgaaatggcgcattgctgcagtaacagtaaattgttcaatcccaaagttgtttggaatagttttagtcgtcaaatagccgatttcttctatagttccacgatcaatctcattccaaaaatgttcatcatagttgctgtcttcgttttgaacatttccatccaattttgatacgagtttgactgttccgctaccttcaagcatttctatagttaaatagatataagctgattcttttttgacaatgctcagaaaacgttcgaaggaaatgcgtactttattagtagaagtagtgattgtgaatgtacgagataatacaccatttttcatatctaattcccagtaaaagtcttctggttccaaagaagccaagtcgatcagctgatcgttgatcgaaatatctatcgcgataaagttcaaggcgttgatcacttttccaaagtattctggataaccatttttccaccagccgacacgtgtcttatcgggataccagacacccgccaaataagtaccttgatggtggtcccctgagtaagtttcttcaaagttcccgcgcatccccatataaccgtttccaatacttgttaaagattcttgcagtcgaagattttttttatctaattgtgtcgtgctgattttccatggatcaatagcaaatagtcgtttgatctgtttcatttttctcctcctaatgagctgttttatacgttcataataaacgcaaccgattgcacaagtcaatagacaaaagaaaatatttcatagaaaaaagcttaaaaaaataaatttttcggagaaaattatagaagggaacacacgtattataggttttatagaatggtatagacagaaaaataaaaaataaagcatttacaaaaaagaaaacgcacgctataatacgtttaacgaaaccgattgcgtaaaggagctaaacggaatgaaaaagatatttagttttgagttttggcaaaaatttggaaaggctttaatggttgtggtagcagttatgccggcagctgggttgatgatcagtatagggaaatcaattcccttgatcaatcctgattggacgccgcttgtcacaacgggcggagtaattgaaaatattggttgggcaattattggtaatcttcatattttatttgctttagcaataggaggaagttgggcaaaagaaagagcaggcggagcatttgcagctgggatctcatttattttaatcaatcggatcactggggctatctttggtgtcacaagtgacatgcttgcgaatgaagatgcatttacccacactctgttcggtacgaagatcatggttaaaggattttttacaagtgtattggaagcaccagctttgaatatgggagtattcgtagggatcatcgctggatttgtcggggcaatggcttataataagtactataattatagaaaattgccggatgctttgtcatttttcaatggaaagcgctttgttccgtttgttgttatcttatggtcaacaatcgtggcattgattcttgctgtggtgtggccaaacgtacaggctggaatcaataattttggtttatggattgcagaatcacaagaaagcgcaccgattctagcaccgtttttatttggaacattagaacgtttactattgccatttggattgcatcatatgctgacgattcctatcaactatacacagcttggcggatcgtatgagattttatcaggcgcacaggcggggacacaagtatttgggcaagatccgttatggttggcttgggccactgatttagtgaatcttaaaggtgcaggggatatgtcgcaatatgagtttgtgttgcataactggacgccggctcgtttcaaagtaggacaaatgattggttcttcaggtatcttgatgggaatggcttttgcgatgtatcgtaatgtcgatcctgataagaaagcaagatataaatcaatgtatttttcagcagcgttggctgtctttctaacaggtgtaacagaaccattggagttcatgtttatgtttgctgctgtgccattatatgtcatttattcagtgatccaaggggctgcatttgcgatggcagatatcttgccattgcgggtccattcatttgggaatatcgaattgctgactcggacaccgttagctatcaaagcgggtctaggtggagatcttatcaacttcgtgttgtgtgtgatcgcttttggtgttgttacgtatttcttagcaaatttcttgatcaaaaaattcaactttgctacaccgggacgtaacggaaattacgacaatgacagtgaagaaaccgttgtatctaacagcggaacaggaacagcagatcagcaagtggtccagatcattcatttgctgggaggaaaagaaaatatcaaagatgtcgatgcttgtatgactcggttacgcgtaagtgtaaatgatcgagaaaaagtagggactgaagaagcctggaaacgagcaggggcgatgggattgatcgtcaaagacaatggagtccaagcagtttatggaccaaaagcagatgtcttgaaatcagatatcgaagatctgctgcaatcaggagcagagattccagagccagaaatggtttctacaggaaatggacaagcaggtagtaagcaatacttaggtatagaacaagaactagtttccgcagcttctggagaagtgattcctttatctgaagtaaaagatccggtattctcacaaaaaatgatgggtgacggctttgctgttattccaacatcaagagaagttgttgcgccgatcgctggaaaagtgacaagtattttccctagcaaacatgcaattgggctggaaacgaaagatggtatcgaagttttgatccatatgggaatcgatacagtccaaatgaatcagccagcttttgagattgctgtcaaagaaggccaagaagtaggaacaggaacgaaattagctgagatggatcttgatgtgatccaaaacgaagaaaaagatccaacgatcatgatcgtatttacaaacgataaagtagaagaagtagtgatcaagcaattaggtacagtgacagctggtaaagtgatcggctccattaaaatgtaaggagaggttgtgaaaaagctgtcctgcatcaagtcataagaacagccaaacaaaaatagctcctcctatttttcgtttggttgggcttattaccgagaagcagcagtttgaatactgtttagtggagaggtcgtgaaaaagctgccctgcaccaagtgataaaaacagccaaacaaaaaatagctcctggtccattgagcttattactgaggagttagcaggagaacactatttgctggagaggttgtgacaaaaattttgtcacaacccttttgtttcgaaatgaagacaaggagaaaaccaatgaaattcatgacactcaacacgcatagctggcttgagccagaaccagagaaaaaattgcaagaattagcagataagatcctgttagaagattatgaagtgattgctttacaagaaatcaaccaattactggaatctgaagaagtagaacctgcgaagctaatgaagttctgtccggtaaagaatcaagtacctatccgtaaagataattttgcctaccgtttagttcagcttttaaaggaacacggaaaagagtatttttggagttgggaaatgagccacatcggttatgataaatatgaagaaggaaatgcactgcttacgaaaaaaacattggaaagtcaggtccttaccgtctcccaatttcaaaagaaagaagattatcagacacgcaagatcttgattgggaaaacaaagatagatgatcaggacatttttgtctcgagctgccacttttcttggtggacagataaaaaaagtggcttttattttgagtggaaaaacttggaaaactactttttggaaactcgcgtaccactttttttcctaggtgatttcaataatccagtagactctcaaggttattatactgtaagagaaagttgccttcttcttcaagattcgtatgttgtcgcgaatgaaaaaggaaaagcagctactgtggaaaagaaaatagatggttgggaacaaaatacagaaaaattgcgtatagattttattttcgtccctgaaggaatgcaggttaaaaaatatcaacggatttttgatgggatcgatagtccaatcatcagtgatcactacggggtggaaatcgaattagatgtgaacgaataaaaaatataacatataacataaaaaaactgattaaaataaaactctccaaacgattataccgtttggagagttttttgatcggatgtatttatcccttttgcctaagcacgtaaaagcttgtatctatgataaataaataaacatagcaaggtaaaccagccaatcaaagtaagagaaagaatgaaatagaaatagattggcgtttgataatgaagcgtgagctcgttgattcctttttgctgcttcacgattggggtcccgatatctgttacttcataatcagtcaatgtttttccattttgctgtagcacagtccgatcgtagacgataacagggatatgaacagttttgtccccagtgtttttccacttgattgtcaaaagaccgcctggatgtgtttttataaaagttgtttcgttttctagtatttcttcgttataccggtcgtatttattgtcttttgtctccttatagattggcagatagtcaggtgtggttttttggaaaacgaacaagctggtagacatatctttgctgaagaatgttttccttgcttcttccggcgtatcgaatagataagtatgtcgactgacaaatgtttcattttcccacttttccagatgctggtataagttctggatcgtctgtgctgaaaaaataagaatgccaaatatacttaaaagacggaaccacttttgttcagaccactggttcagtgaaagggcaaggtaaagtagaagcaatagcgtaaatggcacgaaaaatcgaaatggaaactggatcaaactaataaaaggcacatttttttcgatcaatgtcgtccatggaatcaagctagtagaaagaaaaaagaaaacaagacttgtgtacaacacgattttttggaataaggtgttcttttgttgaaagaaaataaaaagcaaaaaacctgataatatcaatataggaaaggccttagggtaatggagccaataactgccatccagatctatcgccttttgactcatttctctgttaacaaagggaggaagaatcttattcccactgtaaacaatagctaatcctgcccaaatatttgctgtcagaacaaaataaagcaagaccgacttaatcagttgaagcagtgcttttcctttttcagtctggttaaaaaagtaataaagataaaaagggatatacatcaaagctaacatgatcgaagacagtaaatggatctgtgtcataagtcccactgagacagcgactttgataacagggaactttttatgaaggacgaaatcagcaatagggatcatacataaaggataaaaacaagtcccccagctagtgaatccttggttgatagaccagtattgaatagaatacgtactcatgaataaaacggctactggtacacttacccaatttcgaacattgacatatctcagtaaaatcagcatagaaaatcctgaaataagataaagaatgaaatttgaaagaatctgataatgaaaccagctacctgcaagcaacacgatcaatccttgtaaataagcgaaaaatgggccgtaaacggcattcacgatcctgccactttgctggaatccataaagggaaggaaaataatggaaatccccatatttaatttgttgcgcggcatcatagaaccgattgtaatggaatggggcatcagcacccaaaattagtttatgtgtgaataaatgaggcatgagaaatgccaaagcaatgaaaaaaattgctaaaaatgggccatattttttcaattgtcgaactcctttgcaaactttagataaattcatcatatatcctatgcgagaggtaggcaagaaattagaaaattcatgaaaatatttatgaattttacaagaaaaacataagtgaaagttctaaggagagaggatgcgacataagttttgttgcatctccttgttttgaaacagaatttttcttaatactcgaaacaaagtagctttttcatgacctctcggtaaacggtgttcaatcagctgcttctcggtaataagctcactagcctagaaaatatgagaagctattttctgactagcgctcttattactcaaagcataacgcagttttcacaacctcttccttaaacggtgttcaaaagcttgcatctgcggtaataagcccaacccaacaaaaaatatgagtagctatttttttgggctgtacttattacttgatgcaggacagctttttcacaacctcatcggctttcattttctatttttttcctgaacccatataataaaagaaagaacaaaaaaacttgcaagggaggacacatgtgaagcagagtaagcaaaaacagtctcgtcgacttttgtttcgtttgtttttattaatatgtatcgtcgtagggttactgatcgctttatatccattttatgtggattctttaaatagttttattgatcaaaaacgtatcgaacaagtacaaaaacggaccgcagctgaaattgaagtgcagcgaaagaaaatggaggagaaaaaccaacgattaactgaccaaggattcaatcctggtactgatcctttcaatgaaaagaacagaaatgaaagtacaacatccagccaattagaggaatggctgatcggaagtatcaatatacctaagatccaattaaatatttcactttatgatcggctcaatggtaggatccttgaaaatggagcaggcgtcttgcaaggaacctctttcccgcttggtggaaattcgacgcattcagtgatctctgctcacagcggtttacctaatcgacggttatttaccgaattagatcgtttagaaaacggagacacgtttattttgactgttttgggggagaaattggcttatcaagttaaaaatatacaagtggtactgccagatgacacgtctgttctaacgatttcagaaggagaagacttagttaccttgcttacatgtacgccgtatatgatcaacacgcatcgtttgctagtgacaggacatcggattccttataacgaatcggtaaaaaaagaagaaggaaaaggaaatcaggaaagaaccatgcggcaatggtttattcttgcaggaacgataatagctgtagtcatactgttagtgtttatcggacgactaatctatcagtatagattaagtaaaaaagtgcttgatttttcatttattattagtgattcgtcagggaaaccggtaaatggtagttcattcattttgaaacataagaaaaaaacacttactagaaatggtgtgccgttttcagtacaaagcgaccatcatgggaaagtcaagctggatcaattgcctggtggaacttatcgaatcgtttcagctgatgatcctaaagttgctgtttcttttggtattagaaaagtaaaacaagagaagatatacttttttgaggggcgaaaacttgtaaaagagcttcaaaaaaatggtttttattttaaaatcaatgaataagtaaggagagaaaaaatgatccgcacaacaacaaaattgtctgccaaagaactggaatctgttctatcgatttggctgcatgctaacttggattctcatgaattcattccatcaacttattgggagaatcaagtagaatctgttaggaaagctttaccagatgcagtgatttacttagcagaaatagatcaagaaattattggttttgctggggtgattgatcagtttatcgcaggaatctttgtgaaaagggaataccggcaacaaagaatcggtacgcaactaatgaaaaaaataaaagaaaccaataaaacactgactttgacagtctatcaaaaaaatcaatcagctattcatttctatctttcacaaggttttacaattcaaacacagcaaaaagatgaagcagtaaatgaggaggaacttgtgatgaaatggaatcaaaacgctgatttttgatgaacagaataacgaaataatgctcccagcctaattttttgctgggagcattatttcattttgaagtcactaatttaactgtgtgaatatgcagttgttacaatctttgataaacggtgttcaatcagctgaccctcggtattagctcaaaaaacggcaaaatatgaggaactatttttccatttgtttctctaatactcaggtcaaaacgctgatttcacaacctcttgataaacggtgttcaaacggctgcttctcggtaataagcccactagcctagaaaatatgaaaagctattttctaactagcgttcttattactcaaagcataacgctgatttcacaacctcttgataaacggtgttcaatcagctgaccctcggtattagctcaaaaaacggcaaaacatgaggaactatttttccgtttctttctctaatactcaggtcagaacgctgatttcacaacctctctttcacaaccttattttactcgtttataattttcatcgaagtattttccgctacggatatcatctggcattccatcgtatggttcttcgctaataacatcttcattgtctatacctgcatcacccatataagtgatcgtagcaaattcaggaacaagtaattttggataagtttcatatttttcacgagctgcttccatttctgcgatatgttcgttttggaaagtaacagtgatttctggatgttcttcaacccatttagggaaaaagatcattccgtgaagtttcttttcatttggcataaagtccaatgccacgtctgtccctgttggctctgtccaagtgattttgaatacgccgtccgtcaatttaacgatatcagcttcttggtcttttacccaacggcctttgaccattccgccatggatacggtaatcaacagtatggtcatttttggcataccattcatattcccaaccattgtcatacgtatagataaagtgagttccaataaaatcttccaattctttaaattctttcatgtttaagcatctccttataaattaaaacatgtaataaactacatgttttcgattactcatttatgatagaatggatttaaagatttgtcaaggagggaaaactgatggcaagaaaaaatacacttcgatatattttgttagggttattaagtaagaagaagatgacaggatatgaattgaatcaatcgttcaaaaatgaaataggagaattttggcaagcaaaacatagtcagatttatcctgaacttgcaaaaatggaagagcaaggaatcattcagcatcaagtagagatcacaggtgaaaaattggaaaagaaagtttatgaattaacagaagaagggaaggaacaattggcagagtggattcatacacccaccaatgaactaccggttaatcgagacgaatttgttctgaaattgtatttcgtcaaagacgtgaatgatccggcattagtagaaattattcagcagcagcgtgaccttcatgaagaaaaacgacttcatctattagagcgaaaaaaaacgatctttcctactgaaaaagaaaaacatgaaaattacggacactacctgattttagcgcatgcgatcaatcgggaaacagaatatgcaaattggctaacagatgtattagaagaaagtaaccgaaaaaaataaaaaaatatccgaacagtgatggagaattcctttctatatgaaagaaacgcagatcaccgttcggatattcttatgttcaaacaggccttttttcaagtatttatgtagcatctacttattaaaaagcttggtacttaggagattagtggcgtttagagttcttttaacaactgttcgtagtcagctttttcatcgacaggaaggagcttgtaagttaattcgtctgtctcgttgtcatgaatgatgtacatcttagcattctcttctttgaagttaccgatttgtaaaatcgtatagcgttcgtcgatcaattcgatatctttgattgcttttgaaaaaactttacggacatggtgcattttcttttggcggatttctgccttttctgcagcttttgacaaagtaaatccgtcatctaaatattttttgatcagttctacttttatgactgtaggtaaacgatattttctaggacaattcgcatcagcttcgatcgaacgaatgaatcccttttgttcccaataccttaattgacgtggagacacacctacgatatcacttaattcactgatgccaacaaccaattgatcattttccaacaaacgtttaagggaagccccaaccatttttgtcactccttttgtcctcttgcttcccttaattatatccgtattaacttatgtgtcaagtaggttgacaaatagcgaatttaggactaaagtattctagtagtttcagaaaaaattcagaaagaaggagaaatatgagtaacaaccaacccgtagatatttacggaaaaccatataatcggacacttttagttgttgtcttattaattggtacattttgtaccgttttgaatcagaccttattgacgacagcttttcctacattgatgaaagctttcgatatttcagcgtctgatgtgcaatggttaacgactggtttcttgctagtcaacgggatcatgatcccaataacagcatggctgatcaataaattcagttcaagaaatttatatctttctgccatgacgatctttttgatcggaacgattacttgctttacagcacctaattttagtacattactaatcggtcgtttgatccaagcttgcggtgtgggagtatcgatgccattattgcaaaatatcatgctatctattttcccgccagaaaaaagaggatcagcaatggggatgtcagggatcgttattggacttgctcctgctttaggccctacattatctggttatatcattgataactaccattggcgtgacttgtttggtatggtactgccaatcgttgttcttgtcttggttttagcattcttcctaatgaaaagtgttattccattgtcaaatcctagcattgatattttatccgctattttatcaacgattggattcggtagtttactttacggattttctagtgtaggagatgacggctggggaagcttgaaagtaattggtttcttagttgttggtgtgattttcatcgccttgttctcatggcgtcaattacatttggaacatccattcttggaacttcgtgtattcaaatcatctacattcacgattgcagctgttttagctggtgtaacaaatatggcgatggtaggggcagaaatggtcgtaccattgtatattcaaaatattcgtggagaatcagcattccattctggcttgatgttgttgccgggtgcattgatcatgggggctatgatgcctgtgacgggtgcgattttcgataaatacggcgcgaaacgtttagccatcacagggatgttcattttgacagcggcaactgcaccatttgctttcttgacaaaaacgactccagttttatatatcgtgatcctttatgcgatccgtatgtttgggatctccatggtcatgatgccggtaacgacttctggtatgaatgcattgccaaataacttgatcagtcatgggacagcggtaaataatacattccgtcaaatcgcaagctcgattggtacagctattttgatcagtgtgttgacgaatgtgacaaaagcaaatatcccaagcaaatctgtattggataatacgccattagcttataaagatcaggcaatcaatgccacactgtcaggttaccatgccgcgtttatcgtagcgatcatctttgggattcttggctttattattgcctttttattgaagaaaaaagaacctgttctaatgaaagcgggggataatgcatgattattggagttttgattgtcagcttgcttgcttttgctttaacgaacgtgttcgctaaaaaaacatggcaaacctttttatctttgattttcggactaatcttcgtcgcttcactaagtttgatcgtcgctaatttgtccaatcactttggaatggaaaaagtaacggaaacaaaaacagaaaaaattgtttccagtgctgattcccaaggagcagatatgcttttgtataaagctttagggaatggaaaagaaaaagtgtatctttaccgaacaaatgaaaaacaagaaaaaccaaaagcaactggtacggataacgaaacaaataaagtagaaaagacagacggcgatgctgaaaaagtgacgaaaactacttattgggaatacaaaaacgacatgtataaattctggttcaatattgctgataacaatcacgaatatgacagccgagtgaatacattcaaaatcccagagacatgggtagaattaagtacggaccaagcagccaagttagctgaattagtgaagaaacagcaaagtacgatggaaagtgaagcaaaagcttatgttcaagacggtatggtaaaagcaatgactgaaaatccaaaaatgagcaaagcagagcaagaacaacgtacgaaagccttagctgctgaattccaacaacaagcattcgcaaaattagtgaaagaagcaaaaggcgaataatattttgaacaccatgtaggaggttgtgaaaaagctgctctgcatcaagcagtaagaacaatcagataaaaatagcactccatatttttcatctgattgggcttagtgccgtagatgcaagcttttgaacaccgtttaaggaagaggttgtgagcctgccgtttaactctgagtcacaaggagcaatttcaaaaaacagcttctcatgtttgttgactattgtgacttgtgaccgaggagttggcaggagaacaccgtttattcgaaaaaaggaactgcgacaagacttttgtcacagttccttcttttttttgctatgctatactagatgtaaaaaataggagaaataaaatgagggaaatttattcttttgaatcaaaaatctatgcttccgaagtcggcaagggcggggcatatattatttttccgtatgatataagaaaagaattcggtgctggaagagttaaagtccaagcaacttttgacaatgtgccgtatgaaggcagtatcgtgaatatgggcgtgaaaaatccagatggttcagtctgctacatccttggactacgaaaagatattcgtaaaaacatcggaaaagaaatcggtgatattgtagcagttacagtgaagcaaaaataaaagaggttgtgacaaaagacgtgtcacaacctcttgataaacggtgttcaaaagccagtttctcggtagtaagtcaaatttatgcaaaaatgtggaaacccatgtttacaaaatttttcttactactcgaaacgaagcggctttatcacaacctcttgataaacggcgttcaatcagctgtccctcggtattagctcaaaaacggcaaaatatgagaagctatttttccatttttttctctcatactcaggtcataacgctgatttcacaacctcttctttcataatggtttttcaccatctttataataaactggttctttgatatggaaatctattttttccaaccaatctaaaatcttgtaacctaactcttctgacatcggaaaagaggcgttgatttgtgcattggagatatggtcaacatggataccggaagtgatcgtacaacttcccggaacggcagttttgatgatcacagctattttttcggctaagacatcgtctttatggaaccgaccatcgtggctagggaaacgtacagtttgcatctctgtatcacgagaaaatgtagtgactgttccgatatgtggtgtatctccgcctgttaaagtgatcaataagtctttaccgattactttaacagcagcttggatcgtgaaacctagtttggttacttcaactatcgtttctttttccatattaatcaccctgccaacgttttgaatgctcatttacaatttcaaattgatccaaaagtttcattgtatggtgattaacaagatcttggatcgtttgaggctgattataaaaagcaggaattggtggtatgatttgcacacctagtcgtgctaatttagtcaagttttccaagtgaatggcatttaatggcgtttcacgaggaacaatgactaactttcgttgctccttcattgttacatcagcagcacgtgcaatcaggttgtcgcctaaaccaacagagatacctgcgactgttttcatacttgccggtacgatgatcattccatcggtcaaaaatgatccgctggcgacagcagcacctaaatctttgtttgaataatggtaatcaaacaggctttcgaattcagttagtgataagtcggattccagctttaagttctgttttgcccatggactgatgattccgtgtgtttctatcatcggatattcttttagtttcttcactaggttgatggcataaatggtgcctgaagcgccacttacaccaatcacgatttttttcttccgttgtgccaattgttccattttccgcactcctttttatgatgtcaaaacagttgcagatcattcattatttcaaatatttttcccaatcttctacttcttggaattttgcacgtacaaaatgttctttcatatcgaaaggaactgtaccgtcaaagatagtttttgcacttatcccacggaaacgaatagagccaggattatattctggtaattctgatgggtccaatggatggttcctcattcctgggatcacgatgatatctttatctccttggaaacgagtgttgaaagtccaaactacatcgttcatgtcgaaaatatcaacatcttcatcgactaaaatgactgtcttcaattctttgaaggctgataaagcaagaatagctgcttgacgctgaataccttcatccgcttcgttttctttacggatttgcatgatggtcatcaatttaccaccacctgcaggaggattgtagacatttactacttttcctggaatagctttatcgaccaaggcaagaatacttgcttctgtaggaataccggccatagatacgtgttcttcactgggaccaatcgttgtttgcatgattggattgtcttttcggtgagtaactgctttgactttcactacttgtacagctggattagcatccccagtatagccaggaaattctggcattgcttttcctgagttcgtgttgatatcttcttgcattgtttcatttggcatgatttctgcttcaatgatgaattcagcacgagcaatacccacttcatcgactgctataccatcaacgatttgaataggttcgttacgcaaagctcctgcacaccatagttcattgtagccaagtggagtggtaggtggttcgaaagtcgtgccaatggcaattgctggatctaaaccaatattgatagtgataggcattggtttattcaaggcttcgaattgtttttggaagtgaccaatgtggcgtccgccaggcatgatgtacataccgatcgtatctttatcttctagaaccatacgatggatcgttacatcgctcattgttttttctggatctgatcctaagactacacccattgtgatgtatggaccagcatcttcaggagtatttgtaggtgcaggcaaaatgttgcgaatatcgaagtctgcatcggtagctagatgaacgacttcttgtgctggagcgtctgctttgtctactttcacaggtttgattggattttctacagcgtctttcaagaaacgaccaagtgttcgataatcatggtgcaaaatttcacctacacgtttacgactagccattgttccgatgttcacacgtgtgccggggaaacctttgatattgttgaaagtcatagctggtccttcttgagtcggacgttttactgtaccgccagcaccgatataacggtaaacaccagataattctgcttcaggatcgatttcaatatctgtttcgtgatattgacctggaagtgtttttagttcttcgatgacttttcttaaatcatacggttgatctgtcatgagagattcctccttagttgtctttacctatctatagtaaaaggtgaaaaagaggaaaacaattcaacttgttcggtaaagtattctacaatggaatggatgcgtttttttgataatagaataaactatgatatacttatcactaaaagaaagcgcatacttagtgttggaggaaggaaagtgaaaaaaatggaggagtcatttcctaaagcagtaaaagtggaaaatatagcgaatattttgaaagttacatttgaaaacggagaagtaaaatacgtgaaatctcattggacagaagagataaccgatgccttgcaatttggaaaaaaaggaagaggaaaaagaaaaaatcttctcgcactttctcgtaatatgtggattgggactgaagtaacgattgaagcagatggaacagtattcataaatggaaaagacaggtatacgccagaagagttgtggtacaaaggaaagaaaagtataccagaattataaaaaataattaaaaaaaacagcgcgaaacaaggaacatattacttcctcgtttcttgctgttttctactatttcagcgctcttatgactcaaatctaaatgtggttgtcacaaccttattctgcacgcaaagcgatagcggcgtcttttttcgctgccattcgtgcaggaagatgaccgccaagcatcgtcaatatagtagagacgatcactagaataatcgcatggacaggatttagttgagcaacattttttagatccgtcatgttgtataagatgctattgatagggaacgtagctagccatgcaataaacacacctaatatcccagaagaaatacctaaaatacacgtttctgcgtcaaatacgcgagtgatgtcttttttacgtgcacctaaagcttttagtacaccgatttcttttgtccgttcaatcacagatgtataagtaatgatactgatcatgatcatacttgttactaaagagatccctgcaaaagcaataaggacataagtgatagcatccatcaatccgccagtcagttcagtcatcgttccagctaaatcagtataaatgattttatcttcatctgatttgcctttattgtaatcatctagataatccaagatcttttctttgtcttcaaaattgttcggataaatcatgatacttgaaggcaagctgtctccacctaaataactaagcaatgtttgtttggcattttcgtcaactttttcagtagttaagacatttacaccactgtctctttgagctttgacgatttctgattctttgttttcgttgacgatttgagtcgttaattgatcgctataagcgattcctggagataagagattcattgtagaagaagatttcacgcgtaggatccccgagatcttcaattcatcagaagcattctgatacatcgcatcataatctgtattagggataaaattcccagttggaagttttgtatagtaagtattgttgtttactaatttgaatgttgtaccaacgatatcatcaaaatcaagtttttcgtcttctttcacatcaaatccaagattcttcaatgcgttgatattagtattattattgccgtctacgatcagcacgacatctgttgctgaggctggataacttccggcaagtaaagaataattgtcttttaaaaagttttctttgctagtgtcaagctgtgtagggaaacttgacactcccacacctgtcattgctgacatcgtactagataaagaaagagattccgtatcaggattttgattcgagaagctgacaggctgtactttgccatttacatcacgtaaaagattgattcctgtagtacgggtaaatccgatattattacttaagttaggatcgatgtctgttacgtaatcgacgtatgtttgatcaatcttattcgtgtgctgtgctttatcttcttcgctgacttttgcagtaatcgttttgctgtctggataatccgctttgcttgcacccaatccggcatcgtcacgagtctggttagtcgttaccttagaaatagtaatcggaaatttcgccatcgtttcagcttgcgtgttatcgatttgtttttggaatccagaagaaagggacagaacgatcgcgattccgatgatcccaatactggaagcaaaggaggtcaagaaagtacgtcctttttttgttcggatattgttgaaggaaagctttaacgctgtccaaaaactcatctttgttctgcgtaagttaaattgatcatcttttggtcgttcgatgtgaggatgggaatctgttaagatcttaccatcagaaaattcaatgattcgatctgcgtattgatgggccagttcaggattatgtgtgaccatgatcactaatttttctttcgataactcttggatcaattccatgatctggatacttgtttctgtatctaacgctccggttggttcatcgcacaaaaggatatctgggtcattggctagtgctcgagcgatggccactcgctgcatttgtccaccagataactgatttggctttttatgcatatgatttgtcaagccgactcggtgcaatgcatcttctgcccgttttcgtttttcgtctttagaaacaccacttaatgtcatcccaagttcaacgttttcaataatgcctagatgaccaatcaagttgtaactttgaaaaatgaaaccgatagagttgtttcggtaggcatcccagtcactgtccttaaagtctttagtagactttccgttgattaccatatcaccggaatcataattatctagtccaccaatcacattcagcatagtcgttttaccagaaccactaggacctaaaatcgctacgaattctttttgtctgaaagcgacagacacaccatccaatgctttggtggtggtttcgccgactttataatatttttttatatcttttaattgaagcataatcacccttctcccgtattgaaatattcggtatactaataagtatatcagaacaatgatcgtagtatacgaaataaatgttaactgaagatgaactacaagaaaaaatctagaaatttttcaaaaaacagagggagatcaatgaatcgtattttagtagtagaagatgatccgcaattacagttgctttaccgttctgtgttggaacgagcgggcttttcagtcatcaccgcattgaatggagaggatgcgctgaaaaaactagaagcgacacgtatagaattaatcattacagatatcatgatgccgaaaatggatggctatgacttgctagactcattacgtagcaccagatttgacacacctgttctaatgattacggcaaaggccgattttgaggataagaaacgcgggttcaaattaggagcagatgattatatgacaaaacccatcgatgtcaatgagatgatcctacgtgtggaagcattgcttcgacgttcaaagatcaattacagcagtagcttgataatcggacaaacaaaattagagctagatgcttatacagtgttacaagatcagcattcgttgattctgcctcaaaaagaatttctgcttctgtataaattactgtcttatcccaacaagatcttcactcgccaacagttgatggatgatatttggggattagatacgaatacagaagaacgaacgatcgatgtacatatcaaacgtttaaggacccgttttgaaaagacggaagattttcaaatcatcacagtacggggactaggctataaggcggttatttaaagatgaaaaaaaagctattttcacaattatggatctattttgctagtattgtcttcatttcgatcttagtgacactgctgtgttttctcggttttattttcttattgtctcgacattctatctcgcctgctgaatcggctggaaaaccaacgttatacccgttattcgtctttgcggggttcagtatggtcgtgggtacaggaatatcgatttttgttgggcggcgtatcctgcatccaatcagtgcgctagggacaaatatgagtctggtagcaacgggagatttttcgattcgaatggatgaacagcagaaagtagcagaagtacagcaactgtataaagattttcacgttatggtccaagaactcaatagtatcgagacactgaggaatgactttgtgtccagtgtatcccatgaattcaaaacaccactagcaacaatccaaggatatgttcaattgttacaagccccaaatctctctgacgaagaacgccaaatatttttatatcggattatcgaaagtatcacgcagctttcacaattaacagagaacatcttaaaattgaacaaactggaaaaccagcgtatccaactggaaaagaaagagtatcgattagatgaacaaatcagagaagtaatcgttttttttcagcctaaatgggagaaagaacagctagaattggatatcgaacttgctgcagtaaattacacaggcaatgaagagtttttgtaccaagtgtggctgaatatcatggataacgccataaagtacaatcaaatcaatggacagattcatatcaaactatttgagacagccacagagattgtactggaagtgaccgattcaggtgtaggaatgaatgaagagaccagagatcgaatgtttgaaaaattttatcaaggagatacaagtcgtcaaatttctgggaatgggctagtgactttcactggttaaaaaaattctagaactgcatgatggacgtattgattatagcagtatcgaaggagtaggaacgacagcaatgatacggttaagtaaacaataggaaaaagaataaaacccctaaaaattctattgaaggtttttaggggtttttagtcgtttttttgtgattagggaaatgttcttacggttcttttggcataaaaatcgctgctttcttattgaactacgagaaatgttagaggtgtcattgaaacaaggacatgatgcaagaaagagagcgaaagtcatgcgtcgctctctttttttgggtggatagatggacagaaaatgtagggcttagttttcttcttgatttaaatactcccaaaatgtatctgaagccaaagaatgctcaccgactttacgagtaaatgcaagataactctctgttgttggagaaatagggagaatcacagtattttcttttaatagattcttgactgttttttccataacaatagcaatccccatgtcatttgcaatcatattgatgatcaagtcgattcttgctcctttataagagatttttggttcaaatccagcttcgcgacacagatctagtacaggttgatacaagttcgtagtggggccaaggagcaaaaagttctcctttttcagttcgcttagatccaatttctttttactagctaaaggatgatttttaggtagaactgctacaaaatcgtctgtttcagtaggcaaccactcaatcgaacttggtggggcctggaaacttctagcaaagtggatcgtgtcactatgttcattggcgtcattgtaagttaattcgacactttccacttctttcaactggactgtaaattcaggatggcgtttcaaaaactcggtgattttggaaaaacctttataattgatcattgtcggtatcgttaagatatttaatgaaagattgttgtctttcgtataggtttcaagcacttcttgcatagcatggtattgttctacgacattttttacatatgggagcaataagcttccagcttcggtcaattcgatttttctatgggcgcgttcgaataatttgacgtctaattctgtttctaacgaaagaatctgtttagaaatatttccttgggtggtgaattgtcgatcagcagttttggtgaaattcattgtttcggctaaatcaagaaaaacttcgaatttatggatatccatcatattcctcctacttattccaataaagaatactttaacacaaaaaatgaattggtgtaatcttctctgtctgttacaatctttcttgcagcgaaagcaataattacagaaatttttctgatttttttcgcttcgtagaaaaagagaggagttttttgatgccaactggagttttgatcaatgtaggttccgttttgtttggcggactaattggcggattagtaggaaataaattaagtgaacattttaaagcacagctgacgatggtttttggtgtgtgttcgatggggatgggaatctattccattgcgccgatgaaaaatatgccggctgttatttttgctttagtgataggaacagcgattggtttgattgttcatttaggtaatgggataaataagggggctgcgctgatgcaagtacctatttctaaaatcttccctagtgaaaagcttggtatgacccacgatgaatttatcagcacattagtgacggtcattgttctattttgtgcaagtggtacggggatctatggaagtttagattctgggatgacaggagacagtacgattttgatttctaaatctgtccttgattttttcacagcagctatttttgcgtgtaatttagggtatgtcgtttctgtgatagcaattccccaattcattattttttatattttgttcttattggcaaaatttatttatccattgactacaccagacatgatcttagattttaaagcttgcggcggattcttgatggtcgctaccggttttagaatgatcaacgtgaaaatgttcccagtagctgacatgatacctgcaatgatcgttatcatgccactgagctggatgtggacaaattggattatgccactgttataataaaaatcaaagagaagccattttttgctgactaaaaaggatcaaatcttttagtcagtttttttgtatttgacaaactgattttgaaactatattatatgttgtataatatagattgaaataaaatattacacttgagaatagaaggtgacgtaatgcacatccagattccaactgttcttcttgatggtactgtgctagcagcattaagcaaggaagatatgtatgggtatgccttaacaaaaatcgtacaagaaagtctctctgtcagtgaatctacactatatccggttttgagaagattgaaaaaagaaggatatcttgagacctatgatgaaccttttgaaggcagaaaccgtcgatattactcgttgacaccaatgggaagtcgtcatttagaagaaattattgatgaatggattgtttttcgagattctttagaccggttattggaggagagcacaaatgaatgaatatttgaatgaagttgtggatcatcttcaagaaattcctgaagacgatcgttttgatttgatccagtattatgaggaatattttttagattctggaaaaacattagatcagatcattgatgaatatggtacaccaaagcagtttgccttaaaattaaaaatcagttacttttcagaagaagaacaagcagaaaacgagttagtgaaaaatccaaaaagacaaattcgcctgatttggttaatcattatcggtttatttgcttctcctgtcctcattccactagcactggggtttatattggttattgggggactattggttgctttactagcgctcatttttagtatctatgttttatgtatcagtatcttaggtgttggcctattcatgatcatctcaggaatcagtgtgtttggacaatcgattctgagtggattattctttatcggtgtcggtctgttcgccacaggaagcgcagtatttatttcgccactgttgctgaaaggaacaaaagggcttttttatgtcatgatgaactttgttaaatggatgggacgacgttttattacaaaaagagatctgcattcagcgggcgtttgaaggaggacacataaattgagattgaaacattttttgattaccggtattggtctgatgcttactggtggcctcctagcaggtgcaacttatacattaggcgctcaaaagagtctgacttgggataatggtcctcggttgatcgatatggttactgagacaaaaaaaatcaaggatgcaaacaaaatcgtcatccatgcagaaaatcaaacagtttcggtcatacgcggattggattttgagataaaaacgacttatgataagacagaaaagccagaaataaaggagaaaaatggcgtgttgactgtgaatgcagtcaaaaaatcaacaggtgcaatcattagtttagaagacacaagtgcacaaatcactattgttgtccctgcagatcatgaattatctgaattgacaatcgaagggaataatagtgcaattgatatcaacgaagtatcaatcaaaaaagtgaatactaagacacatgatggctgggtatcgttcaatgaatttacaggaggaacaataactgcgaaagatgaattaggctcacttcgattagatgaggccaatgtggataacttgatcgtcacaggtgaaaacagcaacttccatctagaagacagtttgatcagcaaagaaggaaaagtcatcctaaacggtggcaatttatctttgcatgagatggaaaacagtggctatactatccaaacgtctggtgaatcttatattgaaaaagactaccagccaataacaaatactttgttagaacaaggacagaaaaagctaaagatcactgctaaagacacatcgatcaatattacgacggatcaagaggacaatgaaacagattgatcctgtactcaactggatattttaagaaaaaacagcaaagatccttccaatctttgctgtttttcatcgcttaacgcacataactatagtaaaataagaaagaaaatatctaaaaagaaaacagggtgaaagagtatatgaaggtagaagaaggtcaaagagaaaagttaaaaacagaaatggaaagattacatacttatatcactcaactaagccaaaccttctatgatccagacaaagaaaaagtgatggttaattacccgaacaattcagaaggtcgccaattagagcaagtgtaccatgaagttttcaaacatttattgacggtgaagaaagagctggattattattctttaccgattatcgatacaggaatattgaagtatgatgggaagaaggaacgatttatctttaaatctgttcgggaagatttgcctctttcagcagggatggatctagaggtcttggtagaagactattttacagaagaaaagcactgggttcgaacaaaattggattatttaccgcaggcagccggagggacacaggcaagcggttggtacatcactgaagacaaagagttagaactagaaggtgtaatggcgcgtattcgaaaaaaaaattaaaaaagtaacattagatatttattgaaggataaaggagcgcaggaagtagcatgagagaaaaaagagcattttatatcaatggttatgcagggattgtcggattggtcgtattagctttagttggattgtttttcttctatttaggtatgtggcaagcgaaagtttgggcactttttttaagtatttttctttggttgatcacgttattgttgttaagttcggcaactgtagtcagtcctaatcaagcaaaagtaattttgttttttggacaatatttaggtacgattcgagaaaatggctttttccttacgatacctttggcacaaaaaatgactgtttcgttgaaagttcggaatttcaatagttctgttttaaaagtcaatgatttggatggaaaccccatcgaaatctcagcagtagtagtctttaaagtcgttgatacagcaaaggcattattcgatgtagcgtattatcaagattttgtagaaatccaaagtgagacagccattcggcatatcgctagccaatacccgtatgatacattcaatgagaatgatttgacgcttcgaggaaacacgacggcagtgtctgacgagttgcaaaaagagctgcaagagcgtttagcagtagcaggtgtcgaagtaatcgaaacacgcttgaaccatttagcctatgcaacagaaatcgctagtgccatgctccaacgtcaacaagcaaaagccattttgtctgctcgacaaaccattgttgaaggagctgtcacaatcactcaaatggccttagagcaaatcgaagatggacaagaaatcaatttcaccgatgatcggaaagtccaattgatcaataatttacttgtctcaatcattacagacaaaggaacgcaacctgttatcaatacaggcgacatgaaagaccgtaagtgacatactttttgtaagataggaagaaggagtttaggacggattattgtcttgaactctttttttagttgttttaaagaaaatgacaaaattgaaagaagaatgatagttgattcgaaggcagaattgttcgcttttttctataatcagtatataaagtaagagagaaggggaaaaagtgaaaaaacttctgatcggtctacttgttttcatcgttgtggtacttgcaggggtgaaaatcgcagattacgtagttatgggtggagaagaatactatgtacaaattacgacagatggtacaaaaacagtttcaaaatcagactctggacaagaaacagtcaactatagatatatcctgcctggctatacgaaagagggtaaggaaaaagaactggacttcaagggacaattgactcgaccgcttcgtaaaggagcatatttaaaaatcacctggaacaaaaataaaggtgtcacttcgtatgaagaagtcgaaaaaaaagacgtgccgaaaacagcactggaaaaactaattaaagggtagggaaagaaatgaacaaaatagtcgaagtacagaatgtaacaaaagtatacggaaaaaacaatgagaaaaagacgcaagcattaagcggcatcagcttcgatgtagaaaaaggcgaatttattgggatcatgggcgcttctggttctggtaagtcgacacttttgaatattttatccacattagataaaccaacagatgggcatatccgaatcaatcaaaaagatgtgaccacattaaaaggaaatcaactagcagattttcgtgcgaatgagattggctttattttccaagatttcaatttattagaaagcttgacagcacaagaaaatatcgctgttcctctttctttacaaggcgtcagaccaaaagaaatcaagcaacgtgtccaaaaaattgcagaacgtttatccatctctcatattttggaaagctatccttctgagatttccggtggacaaaaacaacgggtcgccgccgcacgtgcattgatcacacaaccaacgattctattaggggatgagcctacaggtgcgctggattccaaaagtgcccgggatcttttagatacgatggacgaattgaatacaaaagatcatgtatcgattcttcttgtgacgcatgatccgttttctgcaagttattgccaacgtattttattcatcaaggatggcggtatccatcaagaagtgaaacgtggagatcaaagccgtgattccttctatcgagaaatactatctattcttggaaacttggaacagtagggggagattgactatgctttggaaattatcacttactgggatcaagagccgtttaagagactacttggtgttattctcaggattagttatggcatctgctattttttacatgtttgaatcaatggcaagcaacgaagcttttttgaaaagtaatacgatcgttgcggctacagttatcattttccgattcggttctgttttactagggatcatcacattcgtttatattttatatgcaaattcctttttgatgacgatgcggcaaaaagactatgcaatgtttatgatgctgggagcaaaaggcagaaaaatcgcacagatgattttttctgaaacattcttagtagggatcgcagctactttagtgggttcagctgtcggtgtaggattgacaagtatcgtccaccgattattagtggatcagttagatctcaatatttcgcattttacaccttttagtattcacgggttgttgatcactgttttgttttttgctgttttgtttttattagctgctgttgtcaatgctttttcgattgtcaaaaaaccgattttagcattgattcgtgcggatcagacaccaacaagaatcaagcagcataaattcttgtttttccttgaagtagtactgggaattgcttttctaggctgcggttactatatgatgaaacacgtggggacctatcaagtctttggtataggggtagccttagttacgatcgtattaggaacttatttcattttccattctgtgatcattttctttttatcattactaaagaaatcagaacagatttcattgaaaaaattgaacaatttcacattgtcacagttaaactttcgtattcgtgaatatacacaaatgctctcaatggtcgctatgctgtttgccttggcactgggcgctttgacggtaggattaggttttaaaaatgaaattgcagacttgacagaaaacaattctggatatgatctagtgatgaataatcctcgggcagaagatcagcaaaaaatcaaagaactttcaccaacactttctgcttcttatactcaaaaagaagatgcgggaacgatttactataatgcaagtgaatttgcggctcaaccattgatcatgataaaacatgaagatggaacaccgccgaagatcacgaaagaaaaagttcctgctaaaaaaatgaatgaactgactgtacaagaggaacttcgaagctatgaattgccggaacagcaagaaaaagaaatcaaggtagtcagtcaatcagaatttgatcaactgaacttgccacaatccactttacagctagttcaggtaaaagacttccaagcaaacctgaaaccaatcgaaacacttgttgctcaaaataaaatgaacaatccatctttgcaaaaagtagagtacagcaaccagaaatatgaaatgtatgaagtgtataatggtctattctctggttttgaatttatgggattcttcctaggtttagctttcttgaccatgcttgctagctgtttgatgttcaagatcttgtcaggaagcaagagtgacattgctcgttatgaaatgcttgaaaagataggaacacgacgcgggttgcttaaacaatcgatccgtagagaagtaggcgtgttattcttagcaccaggaatcttaggtgtagtccatgtcttattcggattacaaatgtttggtctattcatgcaaaatccatacaaagatatttgggttccgtttacgatattcttcgtattgtatttcatctactatgtactgacgacatggttatatactggaatcgtattgaaaaagagattgtgaaaaagctgtcctgcatcaagtaataagaacagccaagcaaaaatagctcctcatatttttcgtttggttgggcttattaccgcagatgcaagcttttgaacaccgtttgttcggaaaaagaggttgtgacaatatttttgtcacaacctttttttcacggtcttttattagaatatagtaaattttttctcgttactcacggaataagctgttaagaaaacggtttccatgtatactggaatcagtgcaaatgaaagaaaagagggtgcaaggaacatggaaatcaatgaacaaaattttggcgaaaactatcacttgattacgatcacgaatcaaaatgggacatctttgtctgtcagtgatcttggggcacgggttgttcattttcaaacaataatcgataatgaaaaacgagagttgatcttaggttttgatgaagcaaaagaatatctagaaaaagacccttatatcggtgcttcaatcggacgtatggctggacggattacgaatggcacattcaaattagatgatgaaacgttcgaagtaaaaacagacccggacactggtcattgtttacatggtggtgcacctagctttgaagccaagcagtggcattatacagtcatcaatggtgaaaacgaagcatcggtcattttctatcagactagcccagatatggaaaacggatttcctggaactttagatgtagaagtacggtatacgctgacgaacgatgatacatggcgagtgacggtccaagggatcagtgaccgcaaaacagtattcaatcctacaaatcatgtctatttcaatttaaccggtgatccagcacagtcaatcgacgaacatatactttggttgaatagccgattatttgctacgctcaataaagatacaacgcctacaggagaagtagtttcagtaagtggcacagcatttgacttccaacgtcctaaaaaattaggtgaggtctttgccagtgattttcgccaatcaatgatagtgggcggcatcgatcatccatttttgttgaaaaaacaatctggtttactaaatgctgcggaattgacaagcccagatgaaaaagtatcgatccaagtaaaaacagatgcttcaggaatcgtgatttttacagcaaattttggagaagatggaccggaaatgcgcgggaataaattagtaaatcatggcggtatcacatttgagactcaagaactgccaggagcggagcgacttgaaagttttggagatgtcactctggaacctaaccaagtacgcgagtttgtaacggaatacaaaataaatataaagaaatagaataaattaaaaagggagtgtgacagtgtcacatcccctttttaatttattctatttctttaaaggcagatcaagccagaatgatttgtctaaacttaacaaggttagtacaggaacagttgcagctttaactgtacgagtagttgtttctggtatctgtcttgccgtaaaattgttccacaaatcccagattgaagcgacacggaagatggaagaagcgttgttgacgcgttttatcgttgaaaattctaatcctgtgattggcacgccatctgttgtccatttgattggcacatcgaatcgcttagacatattgaggatttcagcgtttgcttcttcagttgttgctgcttcttttttcggttcatcatattttgtcaggtcgtacgcttcgatgatcgcgttcaatttttgtgaatattggcgatctgtagcataacgtccttccaaatatttggttgcttctttgtagtcttttgtttccgacttccaagttggtttgtagaaatcaggattgccagtcagtccatttttgatcaagtcggcatagtcttccaaactttccttgtaagaaggatatttacggaattgtgcgcggatttggtagctttgtccggaactatcttgttcaagtgtattgaaggtcacgctgcttcctttatatgatcctttgataccaaaaaggttatgatttggttcgcttgataataagctgtttccagatccactttcaaggatagcttgagccatcatgactgatgcgtagattccttctttttgcccgatttcctgtgcatcatctgcaatctttttcaagaactgatcagttgtttggttttgactgaaatggaacgagccatctaatccatctaaaatagatgagccgcctgtcagcgaacctgaagcagcaggtaaacctgctaagtttactcggacagcaaaatcaggcgtgaaatctgaaatagaagttactcgaactttatctcctggttgaggcgcatggataaattgtccgttcccaatatagatacctacatggtgagtaacaccggaagaaggtccccagaagacgaggtcgccaggttgggcctgacttactggaatctgcgtacctgcatattgctgttcgcctgtccagccaccgatataatgaccggttgctttcatatatacgtaataagtcaaaccagaacagtcaaaagtatttggaccttttgctccccatacatatggttttccaagatgcttgaatgcttctcgaacgattgcttgttggacattcgttgtatttgtaggcaatacagcatcaattggtgattttacaacaaaatcagaagaagcagaagatggattctctataccgctttgatttgctgtatttggacgagatgaagcattgttcgttccgccattcgatgaaccattgtttggatggtttggttctctctgagtatttccattgttattcgatccagatgggtttgtttgattcgaagaattcccgctgttcgaattattgttattattgtttgaattatttgaaccattattattgttgttattacccacatctggtttgtttggcgtttccggatctggtgtactagggacttcttcactaggatcagttggtttctctgttgaagtatccggtccagctttaaattctgcagtaatagataaattgttcgtacctactgtaaaggtctttgcatcataatttacttctttggcaccattaacagcgactgaagcaatttgttcaccttcagctggcgtaatagtgtaagttaccttcgtttccgctaataaaccttctaccgttccactttccgtaatatccaaaggttgctgttcaggggaatccgctgtcgaagcagtcagttggatcttaccaatcaaagaaggagcaattgtaagggaatatgtctcggctggcttttcattttctgatggatcagccggatcaatttcagttggctcggtcgatcctgttgttgagttagttgttccagttgggtcttctgtaaaagaatccgttgtttcactagtagctgagctggatgtagtcgtatctgttgtgactgtttgatcagctatttgattatctacggcaaatacggtattggtcgacaaaacagacggagcaatcagccaagtagcagctagcaaacgtatcgtttttttatttttcataataaactagtccttttcctttcattgattttctgtcttattcagcattcattagacattttttggaacagataatcgtgtcgaaaagctttttcttttcataaatctgtctgtgtattctaaataaaacaatttgtaaataagcaacgagcattcattcgtttttctttgacgttcattttattgcatagaccacctttgtttggggataaacaagtggggataaaaatggttatgcatatgtaaattataccaaagtttggaaagtatcacaaaaatttataaaaataatgatcctaaaaagaaaaagactgaaatatgtgataaacatctcatacttcagtctttttcattaactattcataagacattaggtcttcatcaaacccgctaacgagagtagtgatcattgctacgactagactaacagccagtcctgctaagtaccagaaaaaagtaccggaaatgaatgcaggcaatgtggtcagactaccaaatacaaaagcgatcgctttcacttgggcaaatcccattacagctccaccagcagctgcaccaatgcaagcagcaacaaatggttttttcaatgggatcgcaattccgtaaacagttggttcggtcactcccgcaagtaaaatcgaagcaaaagcagaaccggagatcgaacgggtttttgaacgtttacttcgcagaaatacacctaaagctgcaccagccattccaaaattggctgctcctgtcaacggaacgattcggtcgaacccataagcagagatattactgatcatgacagggtttacagcccattggataccaaatattaccaaaatattccaaccaccagcgatgattgcgccactgatcggtccgttaatatccatcatccaagtaattgcggcagctaaaccttcgccaaggtaaacacccgcaggcccgaataccattaacgtcaaaggaaccgtgataactaatgaaagtaaaggtacaaatactaattgcatattttcgcgaatatattttttgaggaatttttcaacaaaagaataaaagaaaatacctaaaatcgccggcatgacagtagacgtatactgcatcagtactacaggaatccccagaaaatcagtagctgctttgccactgtctgaaagtaaagaggtcagattcggttcaatcagtgctgcagcaatgacagccgcaatatatccattcactttaaacgttttggcagcagaaaaagcaagaaagattggcagaaaataaaagacggcattcgacgcagcagacaaaatatgataagttccgcttgtttcactaagccagccaatcgtagtcgctaaaacaaccagaccttttaatataccagaaccggcaaacagcggaatgatcggcgtaaagatttccgatatcaaaccaaatagtttttcgatcggatttagcttttctttcggagctgaatgatcgatttgacgcgtcaattccttgtaagcaggagccaatccctgatccatgattatttctgcatatctatcgagtaaaatgaaatacttaatggaagggatttgctgttttaatttttctgcattggctactggctgttttttcaatttgatacgaagccgagtcgcacatggaaggacagaatcaatattgtcttttcctcccaactgttcaatcagcatatgaatctgctcggacagtaccatctgttcaggattcattgtcgtttccattagaagaccactccactcactaatataatattggcgtaaggtgtcatttcgcctgtacgaataaatgcatgacagttattcaactcttttttcatttcttcatgtgggataaagctaatcggtgtatctggtaacaataatttgattttttccaatatttccgggttcattgtctttatttcttccgccaattcaatcgattgtacctcaagttcttctaaaacgttttctaaaacagataaaaaacttggaagaccgtttgagacagccaaatctattttttcagtaccaaaggggacaggcatgcctgcatccccgatacttaatttatcaaagtgccccatttgtgcgattactcgtgaaatatctgaattgattacttttccttttttcatgtttgtttcttcctctcattgttaattttagactgctgattgttctaaagcttcgcggtaagggatagaaggttgcgcaccataagactgcacagcaacagaagaggctagatttccataaaggatcgcttctttcaagttactaaggtctggctgaagtgtgctgcttaatgcgccaataaatgtatcacctgcggctgttgtgtcaacggcatccactttaaaagcagggacgataccgtgttctttttctgtatgatagaaagcgccggcactgcctagtgtaatgattactgttccaatacctaattcatggagtttttcggctgctgcgaccaaactgttatgatctgtcactctgattcctgtaatgatttctgtttctgtttcatttggtataatgatatctgtcttttcaagtagttcagtaggaatcgtttcacgagctggtgcaggattcaggatcgttgtttttcctgcgtcttttgcaatagaaaaagctaggatcgtcgcatctaagctactttcaaactgagcaataataaagtcactgtttgtaatcagttgcttgttttttaggacttcttgttcatggaaagcattatttgcccctgcatggatcaagatactattttctcctgctgcgtctaccataatcattgcttgtccggttgtggcgccttggatttcagctatcccagatgtatcgatgttttcttttgtcagtagatctaataactgttgtccttcgctgtcagccccaacgcctccaataaaagatgtccgtgcgcctgaacgtttggctgccactgcttggttggcacctttacctccgccagcgtgaaaaatctcatgcgcatgcatcgtttcgcctggcttgggcatgttggttaaacgaagggtagtgtccatattaatacttccaattactgtaaccgtgttcattttacaaacctccaactatctcatttattttgatgggaaaattattttttaaaacgttttagtaaaacgttttaatagttcgataaaaatatagcacaccttgaaagctatttcaagggtgcagttgaaaatcttttttctaatcgtacaggtaatcttttttcttcccattctttttctgggaattggatccgatctaacaataacttggcagatgtttgtcccaattcgaagattggttgtgcgatcgttgtcagtttcggcttgatatactcgcacatatctatattatcatagccaataatgctgtagtcttcagggatgctttttccagcttcctctaatccgcgatataatccaaaagctaattcatcatttaaagcaaacacaccagttgcagcagaatcaagaagttctgctgtgatctggtagccaccttgttttgagaactgtgtaggtaagaggatcagttggtcgtgagggatttggtaaacatcaagagcagatttaaacccctcaatccgagcgtggacattttccggtggattttcaggatagacaagggcgatcgtttgatgtcctagactaagcaagtgcatgcccgctaggtaaccaccgcgaaaatcgtctgttcgtacggcatcactaaatccttcagattttttctgatccaaaacaatgaagggccggccttgttttttcaaattttcgttgattgcatctgtagagacagcagaagtcgcgataatgaatccatccacacctcgacgtgtgagctcggctagatattcgatttctttttgatgatcagaatcagcattacataatatcgtgacgaaattctgcttatacaagatatcctcaattcctcgcatcagtgtactgaagaatggattcgtgatatcaggaacgagtacaccaattgttttcgtttccttggtaatcatttgtctagcaaaatagtcaggctgatagcctaattcttctttggcagctaaaactttctgaacagttttcggactgaatttctccgtatttccatttaatatcaaggagacagttgtgattgaaacgccggaaagtttagcgacttctttgattgtgatcttttttttcaccatgttcatactcctatctaaatcctgtggttattttcccatgaaatcaaaaagaagtaaatgaaaatcacgtgtgccagtacttatttgctttgttggatagcttcgattatttgtttcgttgagcgtactcgtgcagttttcggaaatatcttttttatgaacaattgatgggattctttgtcacgatcactgcaagcatcttcagcaagcacgatatggtacccgtgttgaaaggcatctaatgcagtagcatatacaccgtttgttgtcgctacaccgcttaaaatgatagtttcgattccacgccggcgaagttgaagatcaagagaagtaccaaaaaaagcacttggattgtattttgtgatagtcaacatattatctgtatctttcaaagaatccttcaaaagtaaatcagtgaattctggaggtacagaagcagtcattccacccatatcagtttgttgactcaaataagggaaagtggagatgtctacgttcactaaaactttcaaggcagcggtacgtttcaatgttcttactaacaaatcattgtttgtcagaatagatgctgcagtgtgtggagagagtgtaccgttatttacgatctctttttgcatgtcgatcgcgacaaaagcagtttttgataaatcaaaaatcatattttcctttaaatcattcatgatgttccttctttcaaataacaatgttttttatgtaagtaaatcataaatcgtttatttgtcaactaaattaaaggattcctttctttagtctagagaaattcagtggtaaaataaataagtgtgagaaaacgcattcgatgcatagatatagcgagaaatatcgtgaaaatggaggaatcagagtgaagtatgtcgaagtaaaaaatgaatacaaacgatacaaaatgggagaaacgaccattacagcaaatgacgatatttctttttcaattgaaaaaggcgaattagtgattatacttggtccaagtggagcaggaaagtcaacgattcttaatattttaggtgggatggatacacctgatgaaggtcagatcattattgatgacacagatattgcgcaattttcagataaacagcttactgcttaccgacgaacagatgtagggttcgttttccaattctacaatctcgttcctaatctaacagcaaaagaaaatgtggaattggcaacggaagtttctcctgatgcgcttgatcctgtagaggtattgaggcaagtgggcctagctcatcgattgaataactttccgtcccaattatcaggaggcgaacagcagagggtttcaattgctcgtgcactagctaaaaatcccaaacttcttttatgtgatgaaccgacaggcgcgctggattttgaaacgggcaagcaagtattgaaattattgcaaaacgctagcagacaacacggcaataccgttttgatcattacacataattctgctttagcgcccatcgctgatagagtcattcacattaatgatgctaaagtaaggtctgttgaattaaatgatcatccttcatccattgatgagattgtatggtagggggattttatgaaaacaagaacatatcttaaagcaggttttcgcgaaattcggcaatctaaaggacgattcattgcaatcatccttattgtcatgctaggaacacttttatttgtaggtgtcaaaactgctggacctgtcatgcaaaaaacgatggatcactatgttggtacagcaggactttctgatttgcaaatcgtttctactggtggcttgacacaaaaagatattgctcaagcagaaaagatcccagatgcaaaagtagaaacaggaaaacagatctattattccaatactggcaaaaacgaagtgattcaaatattttcttataacaaaaataacaagcagaacaagctacaattaactgatggaaaactcccggaaaaaccaaaccagcttgtattggatgaaaaagcggaagatgaagggtataaaatcggtgatatttatcagattgattcagatgaattgaaagaaaaagagtataccatcacgggctttgtccgttctccattgttcatcaacaatttggagagaggatacgcgaacgtcggaaatggtagcgtcgattattttgtctatttacctgaatccgtttttaaaacagatatttattctgtcttatatcttgattttacaaacgtaaagaatttgaatacgtacagcaaagcttacaaagataaaatggagcaaaatcaagaaaaggcagaaaagtatttacaagatcgacccgaagaacgcttagaagagctgaaaaaatcggccaacgaagaattagaaccggcacagcaaaaaatagcggatggcaaagcacaaacaacgcaagcaagaacacggttagaagatgctaaaaaacagttagcgcaacagtcagcaactatccagcagcttcctgaagcgcaacgaacaatcgctgttcaaacattatctcaacaagaagctcaacttgctgaacaagaaaggcaattagttgagaaagaacgtgaactggcctctgcagaggaagaattgaatcgaaatgcagaaaaaattgaaaatttaactaaaccatcatacctatacaatgaacgttcagaaaatgtcggttttcaagaatttggtgatctgtctgatcgtatcgctgcgattgccaatgtttttcctgttttctttttctttattgccgcattgatcacctttacgacaatgacacgtatggtagaagaaaaccgcagggaaatcgggacattaaaggcgttaggttatacgaaagttgaaatcgcaaaaaaatatgcaatctatgcaagtctagcctcagggataggtattgttttaggaacgatattaggaacgaatcttttgccaaggatcatttttgagctgtctaacgagcggtatgatattgggagtgcgcttattttttatgactggccgccgattttacaagcagctgccgcattcttcattgccgcatttggcgctgcaatgatcgttttattcaaagatttaagagaacggcctgctgcattgcttcaaccgaaagcaccgaagccagggaaacgcatttttcttgaatacatcactccgctgtggtcacgccttagctttaatcaaaaaatcagttaccgaaatctcttccgatataagtcaagaatgcttatggcgattatcggaattgctggatgtgccgggctgatggttgcaggcgtgggattgaaagattctctaagttctgtttcagccaaacaatttggaccgatcattgactatcaagcaatcgttacattggattcatccacggaagatagtcgtcaaaaagcagcggatatgctgcagaagcaagaaaaagtaaatgagatcctagctattcatactcaaaccgtagaattgagaaaaaaaggacatgcttcgcaaagtctgacagtgatcgtaccaagtaaaacagctgatttggatcgttttatccatttaactgatcttgaagagaacccacgctccttgcctaaaacaggaatcgctattacgcaaaaagtagcagaactatttgacttatctacaggagatcatatttcgctttatgatgaagatcaaaaagaatggaaagtcgaagtaaaagaaatcgtgaaaaactatctaggtagctttatttatatgtcccctgaatattatgcttcagttactgatcaatcgatgatggataatgcatttttgctgcgtacagataagatgacaacaaaagaagaagaaatgctttccgagaaactgcttgccacagacgctgtgacaaatacgtctttcatgtccaaacaaatcgaaacgcaagaagaatcaatggcgaacttagactcggttgtcttaatctttgtcgtattatcaggactgctggcttttatcgtcttgtataatctaactaatatcaatatttccgagcgtgtacgcgaattatctacaataaaagtccttggattttttgataaagaagtcacgatgtacattgttcgagaaaatatcatctttactcttttaggaatcatcggaggatttggtgtaggatatatattgactgacttcatcttgcaacaagcgtctatggagaatgtcatctttccattagtgatcacatggtgggcttatgtcttatcagcaggattaactatcgtatttacggttattgtgatgattgttacccatttcaaattaaagcatatcgatatgattgatgcgttgaaatcgaatgaataaaaacagaggttgtgaaatcagcggtttgacctgagtattagagaaacaaacggcaaaatagtttttcatattttgccgttttttgagctaataccgaaggacagctgattgaacaccatgaatcagaggttgtaaaaaagccgtcctgcatcgagcaaaaagaatactcaaataaaattagctcctcatgttttacatttgagaagactgattgccgtagataaaagcttttgaacaccatttatagaagaaacaagaatattttgctattttaaacaagaggatagacaaatacatgtctgatctcttgttttttattgggcaacagacctcttagaatgtataaagataaattttacaaacgctttcggttcagttataataataaatgataacttgtatatataagttgtggtaggtaataaatcagttgaatggaggtaaatatccatgacatttaaagacaaagtcatttaccaaatctatcccaaatcttacaaagacagtaatggtgatggaattggagatttaaaaggaatcaaagaaaaactcccgtatctgaatgatctaggcatcgacatgatttggctaaaccctatttatccaagccctcaaaaagacaacggttatgatatctctgattacacagccatcgatcctatctttggtacgatggaggaattcgaacagctaatagccgaagcaaagaaataccggatagaaatcatgctcgatatggtgctgaatcacgtttcgacagaacatgaatggttcaaaaaagcactagcaggggaccagcattatcaggacttcttcattttaagagaagagccaacggattgggtatcaaaatttggtggaagtgcttggtcgccatttggagatacggggaaatattatttgcacttatatgatcggacacaagctgacttgaactggcggaaccaagcagtaagagaggaactattcaaagttgttcgtttttggatggaaaaaggggtaaaaggattccgtttcgatgttatcaatgttatcggtaaagacgaacaattgaaaaataataaagaaaatgatggcaaacctgaatatacggacaaaccaatcacccatacgtatctaaaagaattgaaccaagcaacgtttgggacggattccactatcatcacagtcggtgaaatgagctctacgacgatcgaaaattgtatcttgtatacagaacctagtagagaagaattatcaatggtctttaatttccatcatttgaaagtcgattatgaaaatgggaataaatggtctactcctccatttgattttgcagaattaaagcgactatttcatacatggggagaaaagatgagtgagggtaacggctggaatgctctattttttaataatcatgatcagccacgtgcgctcaatcgatttgtagctatcgatcagtatcgaaaacaaggagcagagatgctagcaaccatgatccatttgaaccgtgggacgccctatatttatatgggagaagaaatcggcatgatcgacccagactattcatcgatttccgactatattgacgtagaaagtttgaatgcttataagttactccttgaacaaggattcacagaaaaagaagcgtttcgtcggatcaaagcaaaatctcgcgataactctcgaacacccatgcaatggtcagacacagaacaagcaggatttactacagggaaaccttggttaaaagttggaggcaagctagaagagattaatgtagaaaaagaactatcttctgaagattctattttgtcctattacaagaaattgattcggctgagaaaaacatatccaatcgttgcacaaggagattatcatgcttatgaagcaaatcatccggaagtttatggctttcttcgccaatttgaaggacagcagctgcttgtattaacaaatttctatgataaagatacaaggatcgccatcccagaaggattcacagaagccaatattcttatcgataattattccgatactgttcttcatcaaagtctggagctaaaaccataccaggcaattgctttgctgaaaaattaaaacaaaaacacaaaacgtcgttcctacgagctattctcgtaagatcgacgttttgtgttttatttaaaataatcttcttcagaaaatgaagagttttcatactctcctttatcgccataaaatttattgtagcgttgtttgaatttacggaaaataaaagtaacgagtaatttgactaacgtatagataggaataccaaaaataacgcccacaattcccattagatcacccatgacaagtaaaacgattaagatcgtaatcggatggatctgtaaacgatcacccattactcgaggaatcaccaagtcaccgtggagaagttgtacggcaaaccagacaatgacaaatttgacagccataaaagtagagtcttggaatgcaatgatcaaacctggaaagaaggcgataaacggcccaatatatggaatgatacataacaacccagcagaaatagctaaaacactagcaaattctaatccgatcagtaagaaacaaacccagtagactgctccaaggataaatgaagcaatgatttgcccctttagaaatgaacccaattgttgattagcaatctttgtcaaatttttaaaatctgtacgaaatgctggtgggacaatcgctaaaactgactgataaaatttttgaggatctctcaaaaggaaaaaagcgacaattggaccagtaaataaagtaataaaaatagctgtaacagttgaaaaaatgttgctgatccgttgtgcgccactttcccaataatttccaataaatccagctatatcagacgtcacgtcgtcaatagaagcgaaaaattgattaaatgaatcggcaaaaggtgttttctccaaaaattgtcggagactctcttgaaaatcttgaaacaaatctggcaaactactgatcaatgtctttgcctgttcttcaagaaaaggaataagccatatgcttccaagccccaataaaaataaaataatcacataaacgataatgactgacaagttcctcgaaaggtgcttgctcaaacgtttgatgactggttccaaaagataatacaagatcagtgcaaacaataatgggggcaagatagtagcgataatgattccgacaggcttgaatataaacgagatctgatggaaaaaataaatgatcagcgcaagtaagataactattcctaaaacatagtaagaggtttttcctcctaaaaagcggatcaaacgattcgttgtatctgtttcttttttcactctttttcctcctttatctataacttcattatagacaaaagcgggtataaaaggaaaatgatagaggttgattgcaaaaatatcgtcaatcattcatataaactttctcatcaattaaaataagaaaacgcttgacagttcttttaaccatatgataaattaaatcctgttgctaaaacgtaactattacggtttgcgaaaagcgaatcggaacattcaaatgaaagaagatgagaagaggagtgtcataaatgaaacgattgataggtatattggccatgctggttttagcaggtatgttaactgcttgcggggcaagtgggaaagccgaggacagtaaagaaaaattgagcgtgatgacgaccttttatcccatgtatgattttacaaaagcaatcgtcggggatgaaggagaagtagagttattgattccagcagggactgattcccacgattatgaaccttctgctaaagacatggcaaagatccaagatacagatatctttgtttataatgatgaaaacatggaaacatgggtccccgcaatccaaaaaacattacaagaaggcaatgtccatacgataaaagcgacagaaggtatgcttttacttccgggaagtgaagaaggacatgatcatgaccatgaacacggggaagaaggccatacacatgagctagacccacatgtatggctagctccaagtttagcaatcaagcaggtagcaaacatacgtgatcagctgattgaagcttacccagaaaaacaggaagtatggacaaaaaatgcagcagcctataccgagaaacttcaagcactccatcagctttatcaagaaacctttaagcaagcaaaacaaagatcttttgtcacgcaacatgctgcattcaactatctagcgttagaatatggattgaatcaagtatcgattgctggtctttcttctagtgaagaaccgtctgcggcgagaattgctgaactgaaacactttgttaaagaacatggaatcaactatatttattttgaagaaaacgccaaagatagtattgccagaacgttagcaaacgaagcaggtgtatctttagaagtattgaatcctttggaaggattgacgaatgaacaaatagaaaatggagaaaactatctttctatcatggaagcaaacctcgaagcgttgaaaaaaacgacagagacagaaaacccgctagaagatactttgacccccaaaaaagaaaagagcgtctacaacggttattttgaagacgaggatgtacaagatcgctctctttcagattgggcaggaacttggcaaacagtagatacgtatgtagaagatgggacttttgatcctgtttttgaatataaagaaaaattgaatcaggataagacagcacaagaatataaagaatattatacgaagggctatcaaacagatattgcttcaatcaagatcagtgagaaagagatggcatttacgtttaagaatggaacaacgaaacgttcaaattatcgttatgtagggaaagaaatcttgacctacgaggcaggaaaccgtggcgtaaggtatctattcgaagcagaagataaggaaagtggcgcttttagatatattcaattcagtgatcacacgattgcaccggctgactccgaacattttcatttatatgcaggaaatgaaagtcaagaagtattgctgaaagaaatggagaattggccaacattttatccagatacaatggatggacgtgaaattgcacaggaaatgcttttgcactgataggcaaaaaagaaccgaagggtttggatcggctggtcatttagtcggtccaaactattcggttctttttatgaaatcaatttctttaatccacggatagaggctgggatggtctcgccgtttgccaacgtgacttctctggtttttttattaatcgaccgcacattttgtgtattgataacataggatttatgacaacggataaaattccgatgcattttctcgatttctttgatcttctcatagaattgtaattgggcatgagtcaaatggacttccagtttatgtggcgctcctagcgaagtagaaaaatattggatgtctttgatcggtaaaaatttgatctcatcattaaactctattttgaagatatctttttggatttgggacatttgaaaatcttcgaaaattttgctcaggatatgctcgacattttcttttaaatcataaagatcttctttgacgatataatcagtcggttcgatgttgctttttaagattttcatcgacatttccgtatgggaagtcacatagattatttttcctaaaggatctaattcacggatcaatttaccgatcgctacaccatccatttcactgtcttctagttcgatatctaaaaagtaaataccaaaagaagaagttctgatcttggctgcattgagaagttcttccggatcagaggtagaaatatggacataactgtctaagttttcaatcatgattctatttttgatcaccgttgataaaacttctaattgttttggatcgtcttcacaaatataaatgggaatcatatcattactcctttattttatttgtatataaatcgtttgagaaaaacgctggttttcaattgatgtttcaaggaaaagataaggattggtctttgtcaattcatccaagataaacaagccaaggccttcgttttttggatttgtttttgttgagaaccctttttgtttcaactggtttaacggtaatgtatttgttgttgtattgatcacacgaatcatcacggaatgattcttcttgagtatggtcaattcgatttttttcttctttgcagcactagctccttcaatcgcattgtccaagataataccaagcatacgtacaaggtttaccgtatgtttcgtatccagttcgattggctcaggaaaatgaagctggacgatcaaccctttttcctgtgccatcatgagttttaatgacagtaaactacggatctcaggaactttcatattatccaacatacttagattggccggaaaaaggttcatcatctggcgtgtaggtaatatcgtttgatcataataagaccgtaatccttctaagtcgccttctgaaatatagctgtgaagagaaaaaagcagattttggtaatcatgtttgaattctctcaagtcttgatagtttttttctagatctttgatataatcctgttgcatcctgacttgttgctctaataactgatcagctaatttcttattagagattttccaataataaaccaagatgatcaggccaacacacagatatagaatgaaaaaactcgtattcaaagctaagacatcaggtgtttcaccagaaaaacgggtataaaaaataatgatatagtatgtaaataatatcaatgtcccgatcgtaccgatcatacggcggtccacagtgtgaaaccaagtctctaacgatttttttaaacaaaaagctaataaagcagataaaaaagcggataagacaatgtgaaaatactgcaatgaatctcctggttcaataaccgaagatttcaaaacaaaaaaatcgccgatgcttgttaagtgatctcctaaaagcgacgtcaataacccaaaaggaagcgcgtaaaccaattgttgacgcgaagtcgaaaagaagaaaaaagtaagcatcagcattcctatagcaattagagcagtaaaaatccctaaaatcgaatagacccatccaatcaaaatacaagaaatcagaatgactcccgcaaacagatatttgtatcggatgtgatggtcaatcaataagatacaaattgtgtaaatcaaatattgcaacgctatggaccataaaaacataaagtacagctcccattgatttttaccaaattatagcacaattggcgtattatttttttaatttttcagggattttgaattcagaactcataccaaagcagcagccagatacaaaaaagtcagataagttagttaattgtttaatgattgtttttttcatgaaagattcctccaaaattcatcaagtagtttgtaataggaagcaacgtagctatttctaaaacaatcccaagtagcaaataggtagaaaagtaagaagctgagaaaaataacgtaatgagagaaaaaattagaaacatgctgatcgccttctttaataatgggggacgtttctcgggttcaatgggattgattgctgtacctcttgatccatagcgaagcagtaacaaaaagcagctgattaacaaaaagaccatcattgggaaggagatagtcaattgcagatgtttcatcaccaagggaacgccccataaataaagtagtgtccacagcagacaaacgaattcagagtcggaatgcaatccataagcatatctgcggatgcagatataagaaagaaaggtgattcctgtttccgcccatgagcctgtcaccagagaaaagactagaacgaccgctagttttccaagattattcaataaaacttctaagacaaattttacttggacatacaccatatcttcttccgatttgtctccgctgaataaggcttctaataatttgttcacaactttatctttcatctcatacgtacctccaccacaaattttatgctaaaaaaataaaaaacgtcttttgtttcataaaaagtggttttgacatcaaaaccgtcatgatctcctaaaaaaatcttcgttttccaagaaccttaccaaaaaaagtgacagttttgatacgaaaagtactttttatgacaagtttgtgctttttcgagtgatttatgttaaaaaattactgaccttataaaaggtgatggagggattcttatggaaaatgaacaattgtttgaagtcggcgaaacatatgcatttaaatctgatttatttgaatcaccaataaaaggaaaaatagaaaaaatctatgaaaatagtgtgatgatacgtgtcatgaaatgcgcagtagaagacaatgataccgctcataatctgcactggcagttagttgtacgcaaatcaagtacaatagaagaataaaaacagataaaatgttgagagcataaagaggttgtgagtctcccgtttagctctgagttacaaggaataatgttaaaaaacagcttttcatgttttatgaatattgccttgtgaccgaggtgttggcaggagaatactgtttatttgaaaaaagggctgcgacaagacttttgtcacagcctttattttcatgaataggagttacttttggctacttttagagaagtagcttttaaggagcagataaagtcaaggcttttatttctataaatgaagtagtaaaatgaagaacagattttattacaggaaggatgccgataattgtgatcattgttgcaggaacgatcggtgcagggaaaagcacactaactgaaatgcttgcccaagatttagaaacaaaacctttttatgagaacgtggaagataatgaagtattgccgctattttattctaatccagaaaagtatacttttttattacagattttctttttgaacaaacgctttttggcaatcaaagatgctttcagccatgatgacaacgtactagaccgctccatctacgaagatagtatgctgtttcatttgaatgcagatttagggcgtgtttctgaagtagaagtaaagcagtatgaaggtcttttagaaacgatgctgaaggagttagaagaaatttcgccacaaaagaaaccagatctactggtttatattcgtgtatcctttgaaactatgttagcgagaatcaaaaaaagaggccgggaatatgaacagctagaacaagatcctgaactctattcctactataaagaactcaatcgacgatacgaagagtggtatgaacagtttgatatatgtcccaaaatagtgatcgatggggacaaatatgatttcgtagccgatccggcatgtggagaacaaatcgtacaagaaatcaagatgcgggcaaagaaaatgacagaagaggcagatgcccagtcgatccgctacactacaaataacccgaaagcaaagggaatctttacaactaaataatataaaaactaagcaaattgctcactcgcagatatttctctgtgagcagcatcttgcttagtttttttgattcattgagatcaaatagtgaaccgattcgtatgataaaattgccataaatgaaatgtctgagtgagggccatgatcaaaaataaaatggaaacgatcaaaatcgaatgggcgccaaacagatgatgacagaaaacaaggacaatagctcctgcgataaaggcaagaacgacacttagatagtggaaaaatcgatcaaaatctgctttttctttagaaatacaataatcatataagttcgttgctaccccttttaaatttccagttgtaaataaattagtgtaggcacgcccgttgattttatcaaaagctacccactggatcgatgcagtaaaagcaatcaaaatcgttactaatgcgggatgctcatggacgggtgtcaaactaacaaagaaaaaaatcactgcttcataatatagaacaaacaagcgccagaaatgtttttctttttttctaaaataatcaattagatactttgttagaagaatccctaagaaaaagaaaagggtagacaatacttttttaccaacacttagccattctccgtcaaatgcttggatgatcgatagaatgatattgccagtttgagcagaggcaaaagcaccatattggatataagtataactgtccatggctcctccgataaatgtcagcaaaagtcctattgtacgcccctcgtgaaaggaagtctgcatttttttcatcaccttttatgaatatttttgtcttccttatcttagcataaacgattgaaaaaaaggaaaaattttcagaaaactaaaatcatatcgcttcccattttcatttttagaaaggtctgttagtataaagaaaaaatagacaacgaaactttaaataaccaacttgaaataaacaaattcaaagaagaaagatgggaaggaaatcaatcagttgaatgaaaaagaaattctccgattacaaaaagaattgaaacgctgggagaacaagtataaaaagcttcaacaagtctttcggctacaagaagaaatcattgctacctatgaagcggcttatggcgaagcacccggacttattgaggaagaagtacaagtaaaagaaagtgaaggaaacagctctttctttaaaatgatggagaaacgttcctataatcgcttcaatcaagaacaaaaagcagctatcacatatgatatgaagaaacatcttcgaatcatagcaggagctgggagcggcaaaacgcaaacaatctgtgcaaaagctgtttatctgatgacgcaaaaacaagtagacgaagaacgcatactaatgatcacttttacaaggaacgctgcaaatgaactaaaaaaacgagtagataatttcagccagagaaaaaccgctgtccatatcggaacattccatagtatcttttttaggatatacaatgaaatttgtcgaaaatttcctgaagtagcaatgcaaggaatacaaggagacttttcaaaggatactgcacaaaaagtgaatgctgttttgcaacagctgatacgtaaatataatctttatatatttgatcaatatggagaaaaaacgattgcttctcggttagactattggcagaatatgaacctttcagtagaagaaatggttcagttagttaaagaaaaatatgattccattgataagaatgcacgacagccgatatcagaacgactgtatggattgctcacggaactccaagaacaaaaaagaagccagcaattgctagagttcaatgatgtactccaaaatctgaaaagcgctttggagaatgaggagatccagcattatatcggccaaaaatatgattatctattcattgatgaatttcaagatactaatccacttcaatgggaaatcgtgaaacggatgacaaaggaaaacaggatcaagttgattgttgttggagatgatgatcagagtatctatggattcagaggatcagagccagcatacatcaagaactttgaaaaagaatatcctaccaaaactcttttcttattaactaattatcgttctcgggcagctattgtccaaggagcaaatagattgatcagctataataaaaatgatcggataccaaaggcgatgattccagcacaaaaagaagcaggtgttatggaagcctatttgttttctgatactaaagcagaaagtcagtggctaatcaaacaaattcagacatttattcaaaaaaatgggaaatataaggaatcaatcatattataccgatcagcttcacaaacgcagcagcttgtccaatctctgctgaaaacgaatattccttttgtactggaagcagatagtccatatgaaggtatctttggtatcaagtctttccaacatttctatcaaaaaattgttcattggcaaacagcactgaatctgcaaaagaaaaatcaggcctaccagcaattgctccggcagctgatggcagactgctacctgaaaaaaagtgaatgcgatcaatacttttctcctaaatatcaaaatatagccgttgcagattatattttgtcgataagccccaatttaaaatcgaaatctgcagaaatccgagagtttgaggaagcgttgcgtaaaacagaccagcatcaagaaatctattcgcttgttcaaagctatcttcatctgccacgtatagctaaggaaatcgaccagagtgatcaagaatggatacgagaagaagtaaagcagcatgctactttcagaagactccaagccttatcgcaagaaacccaagcgacagctaaagaattaaaaacccgcttgattgcttacagacaaggaaaacttgatgcactatgtatccagagcattcacaaaagtaaaggtcttagttaccgaaatgtctttttgattggttgtaacgaaggaagtttgccttataacggagcgacagaaaagaaagtaatcgactttaatgaaataaaagcagaaccagtaacgacgatagaagaagaacgaagactattttatgttgcgatgactagagcaagaaatcgtctgtatctatgtgtacctcaaatgaaaaattcaagaaaattgaaagtatcgagatttatcaaagaaaccgggagtcgtgtgaaaaaaggaaagtgatagaagagagggtgtgacagaagtggtcagtttcaagaaagaagaaggaatgtacgaaaattgcttctcaaatttttgtgaaatttcagcttattttcgaagaagctatttctggaacacagtttattcggaaaagggaggtgtgacaagaattttgtcacacctcccttatttattttgaaaatgagaatactattatcaaaatagagaatatatagaaaaattctcattattcaaacgtaaataatcagttattttgatttttttatattttattagctaataattggtattttaaaagaaattactgtagaattggattataattaaaaaggagtgagaaaatgataaaagtatatacttcgcctagctgtacttcctgtagaaaagcaagagcatggttgcaagcgaatcaacttgaatttgaagagaagaatatttttgccgaaccgttaacagaaagtgagatcaaaaagatcttggcagcgactgaaggaggagttcaagatattatttccactcggtcgaaaatttacgaaaagctgggcatagattttaacgaattaactttaaagcaaatgatcgtcttattcaaagaatatccttcattattgagacgacctattttgattgatgaaaaaagaatactaatcggatttaatgaagatgagatccggtcatttgtccctcgtgaaattcgatgtgttgccagaaatctgatctatttacaaaacaataacatcttaaattcatagggagggagccttcgtggaagtgaaagtctatggatcagcgcactgtgtaacaagtctgaaggcgaaacaatggttagaacaccatcaattgccttatcaatttgttgacttagaagaacgcgatctaagtacagaagaagcagaagaattatgcagttttgaagaagtgcaagcagaacagctatttgcgacttggtctgaggcttttcacaacattgcgattgacctttcctgtgtaggaaaaaaacaactgatttttttatgcacacaacataccaatctcctcagacgtcctttgattattatcgatgaagttctatttattggatacaatgagcagttgatggaacagcttatcttaaataaatagactttaactgttttaatcaagtcactgagcatttcatacagttgtaacagtcgaacacttagcatcaagcgtgttatgtgttcttttttgactttatttttctactatagagacatgctcaatttatgtggtcaaaattcaaatctaggtggggatatagagttaaaaatatattgacatgtgtaaatttacatgatatattcatttctgttgttttaagtagcaaagcaataaaatagtattttaaaaaacatataaaatagttgttgacatgttagaaatgacatgataagataactgagttgttaaaaaagaaccacttgtgaagcttgattctatcgaaaaaaacttcaaaaaagttcttgacaaataacaaatgataagttatgataaatgagttgctgtaagatttcgaaaaacgaaatcaaaaaaacttttaaaaaagagttgacaattacttgtctctctgatatgatataaaagttgctacggcagccaaaaacgaatcggggaacactcctgatgaagtagacctttgaaaactgaacaaagtaagacaaaccaaatgtgtagggcgtcttgattcaattcaagacaacaaacattttttaacaagcaagcaatatgctagcaaacaaattgagcttaacaatcgcaagattgttcgaactttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagtcgcctaaggtgggatagatgattggggtgaagtcgtaacaaggtagccgtatcggaaggtgcggctggatcacctcctttctaaggaatattacggagactacacaatttgtttttactttgttcagttttgagaggtttactctcaaacacttttgttcattgaaaactggatatttgaagtaaatgtaagtaatacaaaccgagaacaccgcgttgaatttgaaagctgaacaaattgtttagcctgaagcaaaataggcggacggccataaaatctttgattttatgagacgatcgatctttttgccgtacaggctgatttgtgagctggatagagttttttaataagttcaattgcttattttcttgatctaacttctatcgctagaagaaggatcaaaacccaaccgtaaggttgataaggttaagtgaataagggcgcacggtggatgccttggcactaggagccgatgaaggacgggactaacaccgatatgctttggggagctgtacgtaagctatgatccagagatttccgaatgggggaacccaacatctttaataggatgttacgattgtgtgaatacatagcacattcgaggtagacgcagagaactgaaacatctaagtacctgcaggaagagaaagaaaattcgattccctgagtagcggcgagcgaaacgggaaaagcccaaaccagcaagcttgcttgttggggttgtaggactccaatatggtagttctttcagatagtcgaatgacttggaaaagtcagtcaaagagggtaaaaaccccgtagacgaaatgtggaagacacctaggaggatcctgagtacggcggaacacgagaaattccgtcggaatccgggaggaccatctcccaaggctaaatactccctagtgaccgatagtgaaccagtaccgtgagggaaaggtgaaaagcaccccggaaggggagtgaaatagaacctgaaaccgtgtgcctacaacaagtcaaagcccgttaatgggtgatggcgtgccttttgtagaatgaaccggcgagttacgattgcatgcgaggttaagttgaagagacggagccgcagcgaaagcgagtctgaatagggcgtttgagtatgtagtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtcccaaaatatatgttaagtggaaaaggatgtggggttgcacagacaactaggatgttggcttagaagcagccaccatttaaagagtgcgtaatagctcactagtcgagtgaccctgcgccgaaaatgtaccggggctaaacatattaccgaagctgtggagtacacctttaggtgtattggtaggagagcgttctaagggcgttgaaggcagatcgtgaggactgctggagcgcttagaagtgagaatgccggtatgagtagcgaaagacaggtgagaatcctgtccaccgaatgactaaggtttcctggggaaggctcgtccgcccagggttagtcgggacctaagccgaggccgacaggcgtaggcgatggataacaggttgatattcctgtacccgttgttttgtttgagcaatggagggacgcaggaggctaaggaatgcagacgatcggaaatgtctgtccaagcagtaagtctgaagaggagtcaaatgcttcttttcttaaggacaagctgtgatggggagggaaataatagtaccgaagttcctgatgtcacactgccgagaaaagcttctagtgagaaaacagcggcccgtaccgcaaaccgacacaggtagtcgaggagagaatcctaaggtgagcgagagaactctcgttaaggaactcggcaaaatgaccccgtaacttcgggagaaggggtgctgatcatacgatcagccgcagtgaataggcccaagcgactgtttatcaaaaacacaggtctctgcaaaatcgtaagatgaagtataggggctgacgcctgcccggtgctggaaggttaagaggagtgcttagcgcaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagaaatcggaacgctagtttcgatggaggcgctggtgggatactacccctgcgttatggccactctaacccgcaccactaatcgtggtgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagaccaacaagtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtagctatgtagggaagggataaacgctgaaagcatctaagtgtgaagcccacctcaagatgagatttcccatttctttaagaaagtaagatccctgagagatgatcaggtagataggtcaggagtggaagtacagtgatgtatggagcggactgatactaatcgatcgaggacttaaccaataggttaaaagaaaagaactcggaaaaaaacttatatgacttcaaatccagttttgagtgaacaaaatttactcaataaaagataacaccacagtgtggtggcgatagcgagaaggatacacctgtaaccatgccgaacacagaagttaagcttcttagcgccgattgtagtgaggggttgccccttgtgagagtaggacgtcgccacgcaaaggcaaaaagatgaactagaaatagttcatctttttttatttttattaagttaaagaacggattcaattgcagcggtcattttcaatggagaagtttgtggtgcaaatcgttcgattactttgccatttctatcaatcaaaaatttagtaaaattccattttattgctttagtgacagtaccaggagcttcatttttaagataagtaaaaagaggatctgtattttctccatttacgtcaatcaattgatgcatagggaaggtaacgccataagtggttttacaagcttctgctgcttcagtcgctgaatctagctcttgtttaaattgattggaaggaaagcctaagataaccagaccttgtgtctgataagcttggtaaagttcttctaattgtttaaattgaggtgctagaccgcattttgttgcagtgttaacaatgattatcggtttgcctgcatattttttcaatgaatagacagtgccgtcttctaaagtagtttcaaaattataaatagacataaagttttctcctttctattttatataataaaaagagcgctaaactgaaaactagctatttgttttcccgtttagaactcttttcagacaataaatatttaataaaatacgaagataagatagctatattgcttctcatctttacgttcttttagaaactatgcttctacttcagaccattcatcgcgttttgctaaaaattcacgagccaaagcttgtgcaccttctagtgtatggctggcagcccagccacattgtgtttcattgcttgcaggtacttcagtagcttcaagaacatctttcattgttgcttcaagaacatctaaaatgtcttcgtagctttcatgattcaatacagtcaagtaaaagcctgtttggcatcccattggagaccagtctacgatgtaatctgcgtgattgcggattagttcggcagtcaagtgctcaagtgaatgtagacttggcatgtccatgtgttctttatttggttgtttaaagcggacgtcgtatttaatgatgacatcgccatgcgcacccgtttttcgatcagctacacgtacataaggtgctttgacttttgtatggtcaagattaaaactttcgacattcattctcatttgtaagactcctatctgtttgttcattcgttttgatgcttttcactaaagaattatttagtgaaatttacaaaaacgtctttctacttgattctaacacttatcgtttccaaggtgtagcaatctgaaatattttttagatttttctgctaagtcgtttattgggacttctagttcttgattctgtcaaatgcctgagctaaatcgtttatgagatcctgaccatactcaattcctacagaaagacggatcaagccgtcctttatgccagcctcttctcgtttttcttttggaatagacgcatgagtcatgacagaaggaatttccactaaactttctacgccacctaaactttctgctaaagtaaatagttggagtgattcaacaaatggaatagcagattcttcattttttaaagtaaaagaaatcattccgctaaagccgctcatctgctgcttagcaactccatggagttcatgatcgggtaatcctggatagtagaccttttctactgctggatgagaaaatagaaaatcagctaccacaaaagcatttttttgatgttcctccatacgaacacttagtgtcttgattccgcgctgaagtaaccagctatcttggggaccaagtacggctccgatagcattttggtaaaatccgatctgatcggctagatctttatggttagaagtcactaaaccagctactacatcgctgtgtccgcctagatatttggtaccgctatggacaacgatatcagaaccgagatctaaaggtctttgaaaataaggagtagcaaatgtattgtcagcaataactatcaatccatgttgatgagccagagtggcacttttttctaaatcagtaatctttagaagcggattgctaggtgtttcaagataaagtgcttttgtattgggtttgatggattgttctattttatcaagattactcgtatctatgatcgtgtactcgagaccatttttagtaagaactttgtcaaatagacggaatgttcctccatagacatcatctcctaataagatatgatcgccagcttgaaaaagagaaaaaacggcatgaatcccagaaagaccagaagaaaaagcgaatcctcgaacaccgccttccaaatcagcaatcagttcttccaatgcaaaacgagtaggattaccagatcttgaatattcatattgtttaggctggccgacgccatcttgccgataagtggatgtttgataaataggtacactgacagctcctgttgtgggatcttcactgatgcctccgtggatcaattttgtttgaatgtgcatgtttctttcctcctataagtaaatgttttttgataaatagcggtctgctgcgtctggaaaaatcgtaacgacacgatgaccaggtggtaaacgacgaatttctcttaatgctgctgcaaaagccgcaccactcgaacttccaactaatagtccttgttctcgtgctaactgcctagtatagttaaacccttctacatcagagattgtctcgatctgattgattgaaaggggagaaagaaacggcggaatgaattctacaccgataccctcaatttcgtgaggggctggatcaccaccatttaacacagagccctctggttctacaccgattattcgaatgtcgggatatttttctttcaaaaaggtagaagttccagcaaaggttccaccactcccaattcctgctacaaaactatggatattttctttgatttcatgaaagatttctggccctaacgtatgatagtaagcagcaggattatctttattttcaaattgaagaggcagatagctgtttgatatctcctctgcaagttttttacttttgctgatggcaccgatgattccttgctcactaggagaatggatgatctttgctcccaatgctttcatcaattgttgtttttctaagctaaacttctctggaacaacaaaaaccgttcttaatttgtatgtgagtgcggccagagcgatcccaattcctgtatttccggcagttggttcgatgatcgtcgttttttcattgatttttccttgggcaaatccttctttgatcaaataactgcccaatctatctttgatacttcctccaggatttaaatattctagttttgcataaatagcagaacctttaggcatagaatagtgctgattgtcaaagcgataaagcggtgtggaaccaatagcttctgtaattgtcgagataatcatgtgggcctcctaaaaaaagataataaaaaaaggagctgactattaaatcagctccttgaaagacatagagaaaaattgagtagataaaaagataagttacctggtactcattctatgaagggcaattaatagacatgacaaatagtatgctgcttttatgcaccatacaacagcaacgattcaattgtttttggttgctgactgtcatgtgtatccctccaagtaaaatttttattaacgatagcatgaaaaaaaataaaagtcaaaggcttgaaagaaaaaaatatttcgatagcatcgtttacccgtgtttatttttctgacaaataggcatgagaccttaaaagatagagaatactctagttttctggccggttgtctgatacaataaagttgattatgataaagaaaagaaggagcaaaaataatgatctcagcaagtgatttaagagccggtatgactttcgtacaagacggcaaactgattaaagttctggatgcaagccaccataaacctggtaaaggaaatacagttatgcgtatgaaactgaaagatgtccgttcaggtgcaacatacgacacaacgttcagaccagaagaaaaatttgaaaaagcacatatcgacacaaaacctgtacaatatttgtacacgatggatgatacagctttcttcatggatttggaaacatatgagcaatatgaaattcctgtagaaacagtagaagaagaaatgaaatatatcctagaaaacatggaagtaaaaatccaatttttcggtagcgaagtcatcggcgttcaattaccaacaactgtcgtattacgtgttgtggaaacacaaccttccatcaaaggtgcaacagtcactggttcaggtaagccagcgacaatggaaactggcttagtagtcaatgttcctgacttcatcgaaacagatgaattgttggaaatcaatacagcagaaggttcttatgtaaaacgtgcgtcaaaataattcgctaacggattgataagaatttgaaaacagagcttgacctcttgaaaggcagatcatcggatctgcctttcaagaggtttttttgtggaatcagcaaattgaaaaataaaaaagtatttgattttatttatattttgaaagatgaatggcaaaagctagagaaagaaaaaactgcacttatttatgaagaaattgaaatgattcataaaattgaaaatatccgaactattccgaactatattgaagcgaaaatattttttcatcactaaatagtgttgaatttatgtttttatgtataaatagcttctaatagttcgggtattttgtttttataaccatttttattcttatttttaaaaaaatatttcgaaatatactagacaattcagaaaattttgtttaatattattccaataaaattcaaatctttatcaaatgaaattccaataaaaacggaaaaaaagtgaaaagaggaatgaaaaaatgacagaattgataattggcggagtcacagcaagcacattggcagaaaagtataagacacctctgtatgtgtatgatgaagaaaagatgagacaaacgatgctgtcattcaagcgaggctttgtatcgaaacgttttgatacaaaagtgctttacgcctctaaagcattccaaacgattgagatgctgcatttagttcgtgaatatggattcgggctagatgttgtcagtggtggggaaatctataccgctttgcaagctgattttcctagagatactatctacttccatggtaacaacaagacgccagaggaactgatctatgcacttgaaaatgatttgttgcatattgttgccgataatttgatggaagttgaattattagcagaattaagccaacgctatttaaaaaaaatctgtatcatgcttcggttgaatgtcggagtagaagcacatactcatgaatatatcgtcactgcgcatattgattcaaaattcggcatgagctatgaaagtaaagagtgccaacaagcccttcagttgataaaagaaagcagctatctagagttagaaggatttcatgctcatatcgggtcacaaatttttgatgttactgcttggttagctgaaatcgacaaattgacgaattacttaaccgattttgaccaacctctttccttgaatcttggcggagggtttgggattcgttatacacaaaatgatcagccgatcccagtcgaagaggcactaaaaaaactgattgaatatacggaagaagctttggaaaaacgaaaactgaccattcgtcaattactgatcgaaccgggtagaagtattgttggagaagctggtacaacactatacacgattggtttcatcaaaaagacaccacataaaaaatattactttgtagatggcgggatgacagataatatccgtccagctctgtatcaggcagaatacgattgtgatttagcagcaaaactgtcggaagaaaaaacagagaaagtgacgattgcaggaaaaatgtgtgaatcaggcgatgtggtaattaaagaagcttatttgccgaaagcagaatcgggtgatcttttagctgtttattccacgggagcttatggatactcgatgagcagcaactacaatcgagcgacacgaccagcagttgtttttgtcaataatggccaatcaagactgattgttcgcagacaagcattttctgatctactaaggggggaagtttcctatgatccttcataaatataatggctgcggaaatgattttatcttattagattacgcagaagacacagattatagtcaattagccgcttctttatgcacaaaagaaaaatatgatatagacggattgatcgccgtaaaaatcgatccgttggaaatgatctattacaacaaagatggcagccgcgcgccgatgtgcggaaatggcattcgctgttttgctcgatacgtaaatgatcagaacatgatgaatgaacaggaattcaacgtagagacattagcaggcacaagaaaaattacggtgttggatccctcacctttttattgcagcgtagatatgggagtgccagatgattctccggaaaaaatcaaagctaatcaaacttatccaataaaaaaccaggaaatagagatcaatggtgaaaaagtaacgatcactagtttatttttaggaacgattcataccgttgtttttgttgaaaatgcgcgtgaggaagtctggagaaaaagaggtgaactgatctgtcatcatcctttgttcaaagaaaaaaccaatgtcaactttgtagaagtagtcaatgaacaagaattgatcgtccgtacctatgaaagaggagtaggttggacacttgcttgcggtacaggttgctgtgcctcttatgtggttgctaaggaaactgggaaaatttcagcagatcaggtagttgttcacttggaacaaggagacttgatgatctctggtgaggatgcgatacaaatggctggcccagcagttcatgaatggacaagaatattggaggaatgaagatgataaaaggttcgatcgtggcgctgatcacgccgatgaatgaagagggatcagtagattatgctggtttggaaaaattgatccaattccatttagatgaacaaacagatggattattagttttaggtacaacaggagaatcttctacgctcacacaatctgaggaggagcagatccttcaactgacagtaaagaaagtggctggccgtgtgccggtgattgcaggagctggaacgaataatacgaaagaaacgattgaaaaagcgaagcattttgcttctttgggggcagacgcacttttggtcatcaccccttactacaacaaaacaagtgatgcaggactagctgctcattttacagcaattgcagaagcctcaccgattccgcttattttgtataatgttccttctagaacaggcatgtcgattccaatccatgtattagtaaatttagcagaacatcctaatatcattggtttgaaagaagcctcaggagatatggcttatgtgatggatgccgctcggttgattggagaagaattcttcctttacagtggaaatgatgatttgatcctaccagtaatgagtgtaggaggaagcggtgtaataagtgtatgggcgaatatccaacctaaaatagtccatgaattagtaaaagatacgcaggacggaagatggcagcaagcaaaagaaaagcaattaaatgcacttgaactgatccatgccttgttcagtgagaccaatcctattcctgtcaaagcagccatgtcattattagacttaccttccggacctctacgcctgcctttagtttctctttcaaaagagaaaaagaaacaattagctcagcttttgttaaaagaaaggacggttgaaaaatgaaaatcggactgattggcagtggacagatgggaaatagagtcgaagaagttgcacaagaaagaggagatacggtccttcttttacggacggcacctaaagaagcaactacgcttgcttttacggaactgccagaactgcttattgatttttctcatccagataatttagagaaaatcctttcgtatagcttatcatatcaacttccgttagtcattggcacgacaggttatacacaatcacagttccaagaaataaaagaacatgccaaacatgtacctgtgatgtatagtgctaatttttcgttcggcatcatggtgatgaatcaactaatcaagcaagcagctgcaatgttgcaaggctggcagatcgaactgattgaaaaacatcatagtcgtaaaaaagatgcaccatctggtactgcaaatatgctgcttcaaacaatccaagaagtgcaaaagctgcagcccgtatacaactggcaagggaaaaaaagagaagaaaaccaaattggtgtacacagtattcgtgcaggttctttacctggtgaacatgatgtattgtttgctgctactgatgaaatatttacgatcaaacatgaatctttttctaatcgaatctttgctgcaggcgcagtagaagcagcggactggttgaaagatcagtcaccaggttattacaaattagaagatttattaatggacaaaggggtgtaaaaaacgtggaagctcaagaaatcatccgctacattcaaacggcatctaaaaagacgcctgtgaaagtctatctgaatgtaaccgagccaatcgaatttaaagaaagtaaagtttttggtgaaggaagcagcttcgttgtttttggtgactatgagacgattgctccggttttagaagctgaatcagaaaaaatcattgaaatcgaaatcgaaactgctgcaagatacagcgcagttcctttgctagatattaaaaaaattaatgctcgtatcgaaccaggtgctattatcagagatcaagtgtcaatcggcaacaatgccgtgatcatgatgggagcgattatcaatattggtgcagtaatcggtgaaaacacgatgattgatatgggtgctgtcttaggtggacgagcgacagtgggcaaaaactgccatattggtgcaggagctgtcttagcaggtgtgatcgaaccagcatcggccaaaccggttatcgtagaagacggcgtactggtaggtgcgaatgcagtgattgttgaaggtgtccatatcggaaaagatgcagtcgtggcagcaggagcagtggttttagaagatgtggcagcagaaactgttgtcggtggaatacctgcacgtgtattaaaaataagtgatgatcagacaaaagaaaatacagcattgattgctgcgttacgcgaattatagaggagatggagaaaaatgcgcgaaatagatacctgtattgtgggggcaaccggattagtcggccaaacgatgctcaaagtgttagaagaatatgattttccagtaggacgattgaaattattagcttcaaaacgttcagccggtaaagtttgtgtattcaagaaaaagaaacacactgtacaggaattgacagaaacttcatttgaaggatatgatttagcgctattttctgcaggtgcttctgtatccaaagagtttgcgccaatcgcacgaagtcagggactatttgtcatagataattcctcagcatggcgggaagattcggatattccattaatcgttccagaggtcaatctggaagactatacattgaatcggctgattgcaaatccaaattgttcaaccattcaagcggtacttccgcttaaagctttacaagaagcctttggtatccagcgagtcaattattcgacctatcaagcagtttctggttccgggcaaaaaggcattgaagatcttcatcgtacgcaaaatgacgaggaaccagttttgtatccttataatattagccaaacggtgattccggaaatcgatcagcctttggaaaatgggtatacaaaagaagaacagaaaatgataaatgagacccgtaagattctgcatcagcctgctttgccagtatcagcaacctgcgtacgtgtgccaatcgaaaatggacatggagtctctgtggcagttcaactgcaaaaagagtttacgacggaagaaattagagagtgtctcagccagtttccagggattcaattagaagatgatctagcagcacataaatatccgacgagcattcttgctagaggaacagatatggtttatgttgggaggatcagaaaagacacttctttagagaacggattgttgttctatacgactgccgataacatacgcaaaggagccgctgcgaatgccgtacagattgctgcagctttaatgcagaaaatagcggaggtggcaagatgagtaatacgctgaaagtagcgaaattcggcggaacatcgatgtctcatgaagagcaattcaaaaaagtccgtacaattgttctttcagatcccaatcgccaagtgatcgttgtttctgctttaggcaaacgtacgtcagatgatgacaaagtaacagacttactttatttgatttatgcttaccttcagcatcatgttgattggacacccctttggaaaaggatttgtgatcgtttcattcaagtaagagatgttcttgccctgcagttacctattgaagatgaactagcacgcatacagaaacaactggaagacgaaaagataactgaagattatttagtaagtagaggtgaatatctgactgctcaactgatggctgagtatcttggttaccagtttattgacgcaaaagacctgattttctttgactatgatgggaaaatcgatcaggaaaaaacagcacaggaaatcacaaaagcatttaaaagatatccgaaaatggttgttccagggttttacggggcgaaccctgcaggaaaagaaaaattattgggccgtgggggaagcgacattaccggcgcgatactggcgaagatgttgcaagcggaaagttatgagaattggacggatgtttcaggaatcatgatggctgatccgcgaatcatcgatcatcctaaaatcatcgaggaaatctcttttagagaactgagagagatggcttatatgggggctaacgttcttcatgaagcagctgttttcccagttcaagaggctgatatccccatccaaataaaaaataccaatgatcctttcgctcaagggacaaaaatatcgaatcacgaaatagaaaaggaaaatggactgacaggaatagctggacgcaaggattttctttccatcactttattcaaacgtcatatgtccgatgaaatcgggtttatctggaaagcaatgagcatttttgctaaacatgagatatcaatcgaacatattccttcagggatcgacaatatcggagtgatcgtctcagcagaagcgattgccgataagttatttctcatcacgaaagaattaaaagaaacacttggcgtggaagaaatcgtcgtgatcgaagacttagctttgatctctgtcgttgggggtccgcataaagaattgattggattatctgggaaagtgttatcgatattgaacaaattagaaattcgcacatcgatcttatcacaaggagcacaggagttgaatctgatcatcggtgtaccgaataatcaatatgaaacagtagtgaagggtatctatgaagggatggtgaatacggatgctgaaagaatatcgaatggcactccatcaaattcctgaaatcgggtttcatgaattcaagacaaaaaaatatttatatgaacaagtaaaaaacagcgaggccgttatccatgaaatcggcgaaacaggactactcctttattttgataatcagcaagaagaaacgattgcttttcgaacagatatcgatgcactgccagtcaaagaagaaacgaatctctcttttgcttctaagcatgaaggttatatgcatgcatgtggtcatgacggacatatggcgatgcttttagggttgactgactttataactaaacacattgaggatcttatttataatgtagtactgatctatcagccatcagaagaaatttccggtggcgcacaaagcgttattcagtcaggattgttggataaatatgaagtacaagcaatatttggctttcatctatggcctggactagctaagggagaagttttctctcgaccaggacctttgatggcacaaagcagtgaaacagacattatcattaaaggccagtctgcacatattgcttctagtgaaaaaggaatcgatagtctggaggcagctgtacgatttttgaagaatgtttatgattttgaccggcaattaccggcagagtggaatcatctaatgaaatttggccaaatccaaggtggaacgatccgaaatgttttagctggagaagttattgtatccggaagtatccgttcttacagttcagatatgcaaaattatttgaagaggggattagaccatttagcagaacagtttcactctacagctactatttcttttcgctataatgacggctatccagctgtaatcaaccatagaggcttatatgcagcactgttagattcaaacaaactacatgaattagatgctccagttcttcaagccgaagattttggcatatatacgcaacaatatccatgtgtatttttctttttaggtgtcggtgatacccctgctttacatgatccgacgttcgattttgatatggatgttttagaaaatggtgtagaatggtacaaaacgattctttttacagaaaatcttcttgtaaaaatcgatagcagttcaaaagaggagcgagtaaataatgatgaatttatccaatcgatttagtcctaggctttctagaatagaagtatcaaaaatacgacaattcgatcagcaaatatcgtcgataccagatgtgatcaaactcaccctgggagaaccggattttccaactcctgaacatgtcaagcaagcaggaatagcagcgattgaagaagacttttctcactataccggaatgagaggattagaggaactgcgggaagcggcttgtatatttcagcaacagcgttatggattaacttatgatccgcaaacggaagttttgacgacagttggtgcaacggaagcgattgcctctgcgttgttatctgttttggaagaaggagacaaggttcttattccagcgcctgcttattcaggatatcagccattagtggaactagctggtgctgaattgatcccgatagatacttctgacacagggtttgtctgtcagccggaacaatttgaacgagcatttgaacaatatggatcagctgtcaaagcagtcattttaaactatcctaacaatcctactgggacgacattgtctgcaaaacaattgaaagcaatcgctgaggttttaaaaaaatatccggtatttgttataagtgatgaagtatatgctgaattgacttatagtggaacgcatatgtccatagctacttatcttccagaacaaacaatcgtgataagcgggttatccaagtcacatgcgatgactggttggcgagtgggctttatttttgctcaaaaagcccttattgacgaactaattaaagtccatcaatatctggtgactgccgctacaacgatgtcgcaaaaagctgcggctgaagcgctaataaatggggtgaaagatagcgagaatatgaaagagcaatatcaaacacgaagagactatctggtccagcaattggcgcctttaggatttgaagtgacccagccaaacggtgcattttacttgttttgcaaactcccagctgccattcaaactgactcttggcagttttgtgtagaattagcggaacaggcaaaagttgcgtgtatcccaggaattgcatttggcccagaaggagaaggttatatccggatttcttatgctagcagcatggaaaaattacatgaggcctgcaaacggatcaaagactttttaacagaacagtgattcatagattttatcaaaaaaacaatcgttaattttgcggtatattctgcaaggagacgattgttttttaaatttagttcaaatgaacgcgtttcttttgattcataactaatgtaatgttaagtttaaattgtttagaatgattttaaaagaatattcaaggaggtttcatcaatggaaaaaatcaaagttgtcattgtaggtgcatctcatggagggcatcaatcgatcttggaactattgacacgatacggtgaaaatgtagatatcacgctatttgaagcaggagactatatttccttcatgtcatgtggtatggagctgtatttagaagacaaggtaacagatgtaaatgatgtacgtaatttcagaccagaaaactttccgcaatccaatgttcatattttaaataatcacgaagtaaaaacgatcgatgccgataaaaaaacagtaacggttactagcgcatcagataacgaaacaaaagaatatccttatgacaaattgattttgagttctggtgtcaaaccaaacaatctgccagtaccaggagcagatctagaaaatgtctacttgatgcgtggatacaattgggcaaccaaaatcaaagaaaaattaaatgatccggctattaaaaaaatcgctgtcgtaggtgcgggttacattgggatcgaagcagcagaagcaagccgaaaagctgggaaagaagtcgtattgcttgatgtgatcgatagacctttaggcacttatttagatgctgagatgacagatattttagaacaacacctaaatgaaaacggtattgaagttttgacaaatgcaaaaatcgaagcttttactggtaacggaaaagttgaggcaatcaaaacaagtgaaaaagaaatcccagcagatctagtcattcaagctgccggtgtgaaggcaaatacagaatggttaaaagggatcgtcgacttagatgaacgtggctggatccaaacaaatgaatacttgcaaacgaatcttccagatgtgtatgcagtaggagatgctacacttgcttattctatcccagcacgcaaaaaaatgccgatcgctttagcgactgttgcacgtagagaagcacgttatgtagtaaaacatctttttgaagaagtaccaaacaaaccgttcggcggagtcgtaggttcctctgcattaagtgtctttgactatcattttgcagcaagcggattgaatagctttacagcagcaaaagcaggagtagatgtacgagtgtcttattatgaagatacgttacgaccaaaatatgtaccagaagaacaaggaaatccaaaagtgtccatccaattattctcggatccaatgacccatcaattgctaggaggagcagtattatctacctatgatgttacaggtcaaggaaatgtattggcactagcgatccaaaacaaactgactttagaagaactagcagaagctgacttcttcttccagccaggctttgaccgacaatggagcatgttgaatctagccgctcaacaagcgttaggagaagaaccatttgtagaataagaaaacgaaatatttgaaaagaggttgtgaaaaagctgccttgcatcaagtaataagaacagccaagtaaaaacagcttcttatgtttttaacttggctggacttattaccgcagatgcaagcttttgaacaccgtttattttcaaaaaagggactgtgacacgatttgtgtaccgacccccaaaagttagaccaaaaaatctaacttttggaggtcggtattttttatggttaaatatacttttgaacttaaattaaagatcgttcatgattatttggatggcaaaggcgattggaccgtaaaaatccagatcaagagattgaagcggaaatgcttaaaattcgggagaagcacaaggattatggctgtttacggatgaccaatgaactaagaaaccgcggtttctctatcaataaaaagaaagttcagcgcttgatcaagaagctaggaataaaagtaacggcatacacgcgtaaatcacgtcgctacaattcttatcgaggaaaagttggagcagtagccaaaaatcggatccatcgtcgtttctacaccagtatctgccatcagaaaatcacgacggatacaactgaatttaaataccatgaagtggatgccaaaggcattatccgtcaaaagaaattgtatctagatccttttatggatatgttcaatagtgagattttatcctatcgtatctctgaaaagcccaatgcattagcggtaatggaaggtttggaggaagctatccagaccactaacgattgtccctatcgtcgtacgtttcactcagatcaaggttgggcgtatcaaatgaaagcttatagaaacaaattgaaggagtacaaaatctttcaaagcatgtctcggaaagggaactgcttagataattcacttatggagaatttttttggcttattaaaacaagagatttttcacgggaaagtttataactgtttcgaggaattaaaatcagccatcgatagctatatctattactacaataatgaacggataaaacagaaattaaactggcaaagtctcgtccaatttcgtaaaacaaccgtaacggttgtgtaaaaatatcattttagagcataaaaaaaaggagtggatttctccactccaaaaaagtctaacttttgggggtcactacagtgtcacagtcctttttttagtaaaaggatacatttcttccttgtatattccatgcgtgttcgtgagaaagcatatataatttaattaacagatagttagggggagaaaaaatgattttttcaattacaatgaaactggtgttcgggttgatcggtttattattagtggtacgtttgcttgggaagaaatccatgtcagaaatcacaccgtttgatttagtctatacgcttgttttaggtgggatcttagaagaatcaacctatgatgacaatgtccatgtagggcatgtcctatttgccattgcgctttgggcagtaatgatttatggtatcgaacgtatcgtccaaaaaaatgaaaaggtcaatcgttgggtcaaaggcgagccatctgttctaatcaaagacggcgtcatcaacatgacagagttgacaaataaccatatcgagatggagcagttgcgagcaatcttaagacagcaagaatgcttttttcttgaaaatgccaaacatgttatcctagagaatgccggtcaaatgagtgtattgaaaaaatcagatgaagacaaagctttatcgatcctgcttgtagatgaagggcaaattcagcataaagtgcttcagtccaatcaattgactgaagcatggcttatggagaacttgaagaaagaaggctatgcagatgtaaaacagctgatttatgttgaatggtcagaagaaaaagggctctacatactaaataaagaagacgtcatgcatgaatcttaccgaatagatggatagatagacagaggttgtgaaatcagcgccttggcttgttactcaaaactaagcgactttttcacaacctctgatatctaatatacgttgttccagaagttgcttcttcgaaaaataagccaaaattccacaaaaatttaagaagcaattttcgaaaaatcctttcttattttttgaagttgatcacttctgtcacaacctctcatgtcacaaaccatttttttgtttcctttaactcaatataccgtacgtcttcccacaatatcggctgatggtcaatcataaagtaatcttcataggcttcaccaatgaagtgcccttcgacctcatccaagagtcttccaaattcatcttttaaattgagctgaatgattactgctttacgagataaaaaggcttctgtcagtatactatcgatttcttgcaatgtcatttgttgtttaggaagaggctgtttgcgtgcttcttcttcatttttttgataccgttgactagttcttccatcgcaaaagcagtcccccattttaatccaaatggccgatctcgatactcgttatagtcaatgaatttttttgctgtccgtctcatcttttccaccttctaatccactcataccacctgcatgcccgccaacgagagaactacgtgcgatggcgcgtcctccttgcaagagactatgcgcatggatgattgattgaaagccgtatttttttctaatcgtatcgacaacaaaatcaactttcgcttcatttatctgcttttcaggatcttcaaaaaggttaagctgtaaacctgtcgcgtatacgaggtcggaacagttcacgcctacacgccgaatatcctggtagtggtaatgctggtggaaaatggtcaataaagcatctgctagatctctgctagcatttgtcgcttcgattttcatttgctggtgaaacccggtcttgccatttggatcaagatagcctaaagagtatcctacccataagctgactacttgtgtttttgctgcagatcgtctcaagcgagtgccgacttggtcggccatttctttgataacgatctcgatttcttctcgtcttgtataatctctatctaggatttgactatttccgatactttttgattttggtgtatattcttgtcccaaaaaacttcgatcgatgccccaagcatgggcataaagctgagtaccgatgacccctagcttgcttttcaagtgataataatccgcgtgagctaaatcataaacagaatgtatacccatttgtttcagacgttttgctgttcgtttgccgattccccaaaagtcagtgatatctgagattttccataacttttctggtacatcttcataacgccattcagcaaacatttgctttccgtcttttgagccattgtctaaggctagtttagcaagtagcgggttatcgccaattcctatagtcgtgtagattccggtctgctcaaacacatctttatggatcagtttagccatgtcgtacgcatttgttttaccaaagagtgccatgctatttgttacatcaaggaagctttcatcgacggaatagacatgatggttcgcttcgtctgcatattttttatagatagaattgatttctctgttcttttccatataataggccatccttggggcaacaatatataaatcacttggataggggaagggaagatctctggcacggctgatattggtgatgccgtaagctttttttgctgcaggactggaagccaagattaatccgctaccccgtgtttctgtcgaatcggacggataggacatgactactaatttagttgtaaggggatcaagatccttttcaacgcactctacggaggcgtaaaaagatttgcagtcaatacataaaatatctcttgaaggttctttttcataaacaaataccggattttgattcgcccacataacaatcacctcttcaacacaattagaacacacgttctctttccgtgtcaataaaaaacagcaattttcaaatacgagcaaaaggctcacatttggaaattgctgagaggttatttttatctatttgtttttagctgagatcgttgatttttttatcaaacatgaacagcttctggatcgatctttgttgtcccatttccaatgtgtgcaacataaaattccggagcatagccgacaactttcatgtattcatcatagacattgtttttgaaggcaggtatattttcttctttgacaagagcaatcgcacagccaccaaatccagctcctgtcattcgtgcacctaagacaccttcttgtttttgagcagcatctactagtgtatctaattcgatcccagttacttcataatcatagcgaagagagtggtgagaatcatttaacagttgaccaaatgcttctaagttcccagcttctaattcagcttttgccttcaaagtccgctgattttcagaaacggcatggcgagctctgcgtatcaatgtatcatcgccgatttggtcaatagttgattcaaattcttcttcatctaagtctcctaaagaagagataggcaaagttttttgcaaacgtgccaaggcttcttcgcattcgctacggcgttcattgtattttgaatctgccaattcccgccgcttattcgtattcatgatgacgattgcataaccatctagtttcactggaaccatttcgtatttcagcgtatttgtatctaataagattgcatgatctagctcaccgaagccgatggcaaactgatccatgatacctgaattgacaccgatgaattcattttctacttttttacctgtttggactagttccaagcgatctgtttttaaatcaaacagatcttctaatacaacacctactaataattctaatgaagcgctactggaaagtcctgcaccattagggattgttccttccactaataactcaaacccatgatcgattgagtgtccagcttcttttaatttaaggaccattccttttacgtaatttgcccagtttgcttttttatcatattctagctcatctaaagtaaaactaatgacaccgatatcgtcaaagtttgtggaataaactaatattttattatcgtctcgaggtgctgctacaccttgcgttccataagtgatggaagcggggaagacatggcctccattgtaatctgtgtgttcaccaatcaaattgatgcgtcctggtgagaagtattgtgtagtttttttaggtccgaatgtttcggcaaattttgtgtttaagcttcttttgatttccatgatgagttattcctttcttgttttgattttgaattctgttactgtttcaaatactgatccggcttttaaatgaatcgaaccaaatgctgagaagcgctctgcacctggagctgtttgagtctcaaatgtgatgccaccgtgatgtgccagttttcggttgcgcatttctggtgtttctgtgccgaaatttgcagtgaaaataaccacactagaagcatctgtagcaatatctacttggattcttttatcggggctagtcaagcgagcggcttctttacccaagccggtttcttttaagaaaaatggatgatcgattccgtcaacaagatttttttgatccaaatcactagcaaaaacggacgctaattttttaggtatttgaaaatcgaaagcacttcctgcagcattttcttttacccctataggaatactatctgttcgcaaaggagcataagcttcgctattgagccaaagctcatgttgatcgattgactgagaagcatctcccgtcaagttgaagtaaacatgatttgtcggattgaataaagtatcttggtcactggtgccgcgagaggtcactcgccagatattatcttttgtcaaagtatagcggatttccacatccattgtacctggaaaaccatgttctccgtcgggacttgtagtagtaaaaatgacagaagcttcattttcgccattcaaaatgacataagaccatttttttaattcaaatccaggagcaccaccatgcagattatgtccagtttttggatctgtggctaattggtaagtttttccattgagagaaaagcggccattttcgattctccctgcggtgcgaccgatagaagcaccgatatacggatctttttcgatatattcttcagcggtgtcaaatcccaaaactaattctcgatcatttgattttaaactgacgattctagcacctaaatcagagatagaaagtgctagcttgtttttgttctccaaggttatcaagtgataaccttggccaaaatctttttctgtaatcttcattttcaagatcctttcttaatgggaaggaactactgcatcgtgaagttcatcttccattgtatcagctggagccaatttgttttccaatttctcaacgatttgtgcatgttttttctctgtcaatgtaatcttccaagcaaaaataatagcggagaaaatcatcaaagcagcaggagcatagaatgcataagctttgaaagtcgttacgccatgagcagtgatatcagcagcagtagcattaccagtcatcccagaagcgatagcgacaaaccctacgatcccgttagacaaagcaccagcgattttatctagtaaagggcgaattgatagagtaacagcttcgttacggataccatttttccattgaccatattcaacagagtctgtgatcgtcatcaaagcggataagaaaatcaattgttgagggaagtagaacaatactagcccgatgataacgattggcaaacttgaacctgcgatcgtaaagaaaaagtaagaagaaatcatcattgcgatccctccaaggtaaacgtagcgacgagagatgacgcgtgtaagcattgggaatagtggaacagctactaaaccaagtaaggcagcaactagaccaacgatccaaaattcagttggttggccaagtacatatttgaagaagtagaataatacggcagttgttgctacattggcaatcgcataagcgatataagcaagggcaagccacatcaactgatcattttgagcaactgctttgaacacatctttgatcccagctttttcattttgctgacggatcgcagtatcgacttcttttgtgcccaaggcagtgataatcgcagtaccgcctgaaataacagcagcaatcacaccgaaccagaaccagcctgaagcgccttcaatatgtttatgagtaacaagataggtaaagaaagtaacgatagggacaacgactagagtagtaccatttgcacctagagaagagccgaaacgagcaaacgtagcaaatttttcacgttcctttgtttccgtactcaaagctggaatcattgaccaaaaagcgatatccttaaatgaataaaaactatccaataagatgaaaacgattgcaaataatatgataaataaagtcgtattatgagtagctaagccaaagaaattggtaaagattgctaccaagagtacggaactaacaacgccgccgataactaaccatggtttgaatttaccgtattttgtacgagtattatcgatgatgccaccaatcaaaggatcaaaaataatttcaactaagcggatacctacaactaagcttgtaactgtagcaatcatttttgcattcgttgccttatctgttcctgcgaacatctggcttgtcacgaataccataaaataagtgcttaatgtaacatagaatgtgtcgtgtccaaaagcgcctaaagcgtaggacacacgttggatcattttgcttttcataatctgtattcctctcctgttcaatatataatactaagtaaaccggttacaacgaataacaaagatcttttaatgacttaaacttaacaagaaatcgcttcctttttaatatatttctgtgacttttatttaactttttgttgcattatactaaaggagtaaggagggatagacgtggagcaatcgatttttttaaaaaaggaacatcaacaagtagaaaaagaattgtattttgatttttgtggtttctctaaaacgatgccgtttcattcttttggtcctgctattcgcaatgattacatcctgcatgtcgtgatggaaggcaaaggatcttatcatgtgaaaaatcaacaattccaattgaaaaaaggtgatctgttcttgattcgtccaggagactcgacgttttacttatcagatggagaagatccgtggatgtattgctggctttcatttggtgggagtgctgcagaagaaatcattcggcagtcgcttttcagagaagaccaatacacgatggtctcttctgacatacaaaaatatatcgacattattttagaatgcatgaaagatacggaagaaaccttggaaaatgaattacagttaacagcattaacctaccgttttttatcagtccttttaaaagatggcggaaaggtcagcggtggtgtacaaaaggttcattcctctttagctgttgaaacagtcaaatacatcgaggcacattatgctgaaaaattgtctgttgaggaaatcgcccagcatttagcggtcaatcggagccatttgtcgcgagtattcaaaaatcatatgggtaccagtatcaaggaatatttgatcggggtacggatcaatcgaggggcgtttcttctttctctgacggatgaatccgtggaaagtattgcctatcaagtagggttcaatagtctagtcgtatttagccgaatgttcaaaaagagtaccggagaaacggctacgaactatcgtaaacgtatgaaaaacgaaaattttaagaatattgctttggataccttgaaaaaacagttggaaaaacaaaccgcagtttcttggacaacctgattagtctggttaaaatgacaagcatcggcaaaagaaacttgtggcggttatgctacactgtaaagcgaagactaaaaaggaggaaaagggatgcgtacacttatcatcattagccatccaacgatcgaagaatctttaaatcagcaatttttcaaagaagcttctgctggtttaccagctacttggcatcatttggaatcaagttatccagacggaaaaatagatatagagactgaactacagctcttggcccagcatgatcggatcattttccagtttccgttttactggtatagttctcctgctcatttaaaaatttggcaagataatgtcttggaacgagcagcacatgtattaaaagggaaagaactaggaatcgtattgacaacaggtgtggcggaaaaagaataccaagctggaggaaaagaagaatatacgatttccgaatttttgaggccgtatcagcgaatcgcaaataaattccatatgacctatcttccgccattcgttttagcacaatttatgtatttatcccaggaaaaacgttgggagaagctaattgcttatcagcagtatctctcattggaaggcaaaccatcgctgactcagcggattgactggtttattcaaagagtacaggaaaatcagaaaatgcaggaagaagaatctgaaaaacaagcatatatcgtagaagcactgactgaggcaaaagagcagatcgaagacttgacctttacactgcaagaaatgaaaggaacttcattatgacaaatgattggctgatccaacaattagatgaattaagcgaaaaatcagaatatcaagaccgtgcgctcttatatgaaataaagaaactgatggctgagatagacgaacgaacaatgcagctgcaaggagaaatcgacggacaatcttggaatcatctcaactggtgaaattttcttataaataacaaagataaaaatgtgcacagcgacaattatttgctacaataagaatatgaagcgtttgataacgctattatacataaaaattggtggtgaaaaaaatgtatgatgaaaatgagtggggagaaaatgttcggatgacccgaagaagacagcaaaaacaggcagctcgtaagcggatgatcatgattggggcagcagttgccgtgtttttgatcatagcaggaggagttgcgggtctatattttcatggaaaaaattcgtcagaagcgaaaagtacgaccataacggaaacaacgacaaagaaaacagagacgaaacaaacaagtgagtcatcaactaaaacaaaagagacacaaacttctgaagaaaaaacagcaaatggtttgccagagcaacttcaagcaatcgtaaatgattattcgaaaaagatcgaagaaaagacgcctgcattgattgaagaataccagacagaaattcagggaaatcaagagggaatagctggtttatcagcagttgctaaccaaaaagcacgtgagcttcaagcaatctccgacgaagggatcagaaaattacgtgcagcgtatcaggcagcagaaaataaagacggtgtagacttagatactttgatcaatcaattatcggctaattatacgaatcatgtcgctaagatttccgatatttatttgcagactagcgcctctcttcaagcagagtcaacaagcacacaagacacaacatcttctgattctgagacagcagagtcggtagaagcttctgaaatgcaagctcgaacaacacaagacacaacagattcctctgaaactaataccaacagcgcgacttcacaggctgcgacaaccgtagttttggaaggagaaggtccaaatcaaatagccgaacgaactggcgtaccagtagaaacgatcttgtcgctgaatgggatgagcatggagaattatttcctgactcccggtgagacgctaaaattgaattgataaaagcaataaaaaagaacgaagcttccactaaggtgaagcttcgttctttttttattttccggttcttttttcgcgtacaaagtaatggatcgtcatgtaaagcaagaaaacgagtccaataatcaatgagattctcgtttcaggattgataaacatgaaaatcaatacgatagctaaaaaagcaagtgtcacataattcgtataaggagatagtggcattttaaaaggatgatcatgcattttatctgcgtgcttctttttgaagcgaatctcgctgatcaaaatcactacccaaggaaccataccaggcaaaatacttgagctgtatacgaaaacgaaaatattttctgactggttgatgaacattggtagaagataatttaagatcagaccaattaagattccacctgagattgctacgacaggataaaaaggcgcaccgtgacgagatagtttcagaaattttttagacatctttccatttatggcaagtgtatagaccatacgacttgcgctgaaaatccctgaattgcaacctgataatgccgctgtaatcacgacaaaattaatcagtcctgcagcaaatgtaatgccgactttagaaaaagtttgtacaaaaggtgaaccaatctcactcaattgattccacggatagatactcacaatgataaaaatagcaccaatataaaaaatcaagattcgaccgatagtggactggacagcttcaatgatcgtctttttaggattctctgcttcaccagcagtcattccgatcagttcgattccttgataggaagcaacaacgatcgataatgcaaagaaaaatcctttgacgcctccagtgaagaatccaccatttttccaaagatttgaaatccctactgcctgaccatgattaccaaatccaaataagattaccccaagacctgcaatgatcatcaaaatgatcgttatgactttgatgatcgaaaaccaaaattctaattcgccaaacgccttgacagaaataagatttgccagcataagaaacaagacgacaatgattccgggaataattgccggcaaatcaggccaccaataattcatataagatcctacagcaatcacttcacttattcctacgacaatatattgaaaaatattactccaagcggtcaagtagccagccacaggatggatgtactcgctcgcgtaatttgcaaaagaaccagtcgaaggatcaacgtaaagcatttcgcctaaagcacgcataatcaaatacaaaaagaatcctgcaatcgcataggctcccatcactgagggccctgtccaacgtatggttgaggaggcacccataaacagaccgacaccgatcgttccacctagtgcgatcatttggatatgacgggcactaagacttcgagttaacttttcttcttccatacaaaaactcctttcgttgttgagtcaacaagaaaaaataatcaaacgtttcaacacatgtttttcattattaggttagccttattgaactcttgatgtgattctacagaaaattttcataaaatgcgaggaaaattcgaaaaaaactttttcatcattctacttgaaaatgctttccattttagttaaactatatttaaataaaaagttaggtaaacctaaaaaggagtgtaagatttggaacgtacggccattgtaattcaagacctttcagccgcttatcaagggaaaactgttttgaaaactatcaacttgacgataaatccacaaaaaattaccggtattatcggaccaaacggtgcaggaaaatcaacatttatgaaatctttgctagagttgataccagctactactggtaaagtcaccttttctggacagtcggtaaactcagtccgtaaaaaaatagcctacgtggaacagcgaagtgaattggatctttcctttccaattgatgtattaggcgttgtacttttaggaacatatccatctttacgaattggacaaagacctgggaaaaaagaaaaagaacgtgcaagacaagctttgaaaaaagtagggatggaagaatatgccaaaagacagatcagcgaactatcgggtggacagcttcagagagtttttattgcaagagctctagcccaaggagcagaatggatctttttagatgaaccattcgtagggattgatgcgttaagtgaacgaaagatctttgacatcttgcaggaattgaagaattcaggaaaaacgattttgatcgtccatcatgatcttcataaagtagaagaatatttcgatgaggttattcttttaaataaacagctgatcgcttccggtccagtacaagaagtctttacatcgaagaaccttcaattggcctatggtgagatcatcagacatttagtaaaaggaggagagaaaaaatgatccaatcctttattgatggattaatgaattatcaattcctgcaatacgctttggtcacttccatgcttgtaggacttgcttctggagtcatcggttcttttattattttacgagggatgtctttgatgggagacgctatctctcacgcagttcttccaggtgtagccatttcttatatgtttggttttagttacatctttggagccactgcttttgggatgctaacagcagcagtgattggtttcgtgactcagcggagccgattgaaaaatgatacagcgattggaattgtctttagctccttttttgcattagggattatcttgatttcatatgcccagagtgcgacagatttgtatcatattttatttgggaatgtcttagctgttagggaaagcgatttgttgctgacagcactcgttagtggaatcgtcttgatatttgtctttttcttttataaagaattgaagatcacatcattcgatccgacaatggcaaaagcttatgggctgaacacatcgctgatccattatcttttgatgttctttttgacattagtggctgtagtcagtttacagacagtaggaacaatcttggtgattgccatgttgatcacaccagccgccacggcttacttgctaacgaaccatttactgaaaatgatcattacagctgcaggaatcggtatgctaagtgcagttgtcggtgtgtttttcagttatagttacaattggccatcaggagctacgatcgtgttagcatgtaccgcattttttatccttgcttttttattttctccaacaaaaggaattttatttcagaaaggaagcagatagatgaaaacaaaaaaatcactctttttaatcttggcagttagtttcttggtattagccggttgcggaaagcaggcttctgaccaagcggatgaaggaagtaaagaaaagttgtcagtcgtggctaccaattcgatcttggcggacatggcaaaagaggtcggaacagatcaaatagatatccacagtatcgtaccagtcggaacagatccgcatgaatatgaagtactaccagaagacatcaaaaaggcaagcgatgcagatgttattttatacaacggtttgaatcttgaaacaggtaacagctggttcgataacttgatggaaacggctaaaaaagaagaaggaaaagattattttgcagttagcaaaaatgtagaacctctttatttaactagcggtgaagaacatacaaaagcagatccccatgcttggctagacctatctaacggaataaaatatgtggaggaaatcgcacgtatattctctgaaaaagatgcagaaaatgcgacactctataaaaaaaatgcagaagcatatgtggaaaaactaaaagaattagatacacaagcgaaggaaagttttgcttctatcgaagagaacaaaaaattattagtaacaagtgaaggggcattcaagtatttttcacgagcatatgatttgccagcagcttatatatgggagatcaatacagaaagtcaaggtacgcctgatcaaatgaaagcgatcattgatcagataagagcaaaagaagtaccggttttattcgtggaaaccagtgtagactcaagaagcatggaacgggtagcaaaagaaacgggtttgaaaatctatgataaactgttcactgattccatagcaaaagaaggagaacaaggagattcttactatcagatgatgaaatggaatattgaaacgatccatgaaggtttgtcacaaacaaaagaaagctgaaaagtgcaaggtctagcttgaggagcagaccttgcattttttataagagatatgaaaaaaaattatgctgtttttcgtcgtacagataccttttttgaagaaattccgttatagttagagtaaggaaggaaggtgtggctatgaattttacacgtaaagataaatatacgattaaagaagaagtctttcgattgatcagccagcaggaaaataccgacaaggatcaagaccttcaatttcttgaagcagaattagctaaattattcatagcaaatcaaaatgagacaacagaaccagatgaagagctgtacataggcaaatggttgtttgatgaatttcagcctttagatgaaaataccggtatcggttattttgtgttcctttctccagtcggcttcacacctggcgtattagttaaacaaaacgacgaaataaccgtcaaagcatggcctgcattattttcagtcatcaaagcagaaggagtaatcaaaaagatccagtcggcctattataaaagtcaatttattgccaacagcaaattaatgaatatgttttataatcgtctagtagaaattgctaggcctgggaaaatcccgcaaacattcacgtacacacagcaaaaaaatctctatgaagaagtattgtattcccgcgatctgtctgagttttcgccatgggaagaggtaaggctccatgaactgttaagtacaaaaccagtttcattgaatttttttaatgcattagataacaaaagaaaattaatttcaacaaattattgggaagtatttgctgcaagaaaaaaatggatggaagaaaagaagattgccgatcagcagatccagtttgtccagctgaaaaaagaaaaactatattatgggttatacagccgttaacagcaagcgaggaagaccatgacattaaaagaagaaatcatacaagaaagcaaacgattaggaattgacaaaatcgggttcaccacggcggaaccttttgattcattaaaagaatcgttggaagaacaaaaagcagctggccatacttctggctttgaacatccaaatatcgatgagcgtctttatccagaaatgacatttgatcagccgaaatcgatcatttccattgcacttgcgtatcctactaggatccatgaagaagtgcctagggatgaaaaacgcgggcagtttgctcgtgcttcttgggggatcgattaccatgatatactcagagaccgtttgaaccgattgatcgaattcatccaaacaagagcagaaaaatggcaaaaagaagaggaatggcgtctagctccgcaagtagatactggagaactgatcgatgtcgctgtagcacagcgagctggtttaggatttattggacgaaacggattgttgatcactgaagagttcggttcatttgtctatcttggtgagatcgttactaatattgtatttgagcctgataaaccaggagaatttggttgcggtgactgtatgcgctgcgtgactgcttgtccgacaaaagcattgcttggtgacggaagaatgaatgcccagcgatgtttgtcttatcaaactcagacaaaagggatgatgccggaagaatatcgtaaaaaaatgcgaaatgtcatttatggatgtgatatctgccagttagtctgcccttacaatcaaggaaaagattttcattttcatgaagagatggaaccaaaagtagacgaaatatatccaaaattaaagccaatgctttcgatgtctaataaagacttcaaacagcaatttgggcatttagctggttcatggcgtgggaagaaacctttgcagagaaacgcattgattgctttagctaatctaggtgatcgaacggcattgcctgagatttcagaatgtttaacagatgtccgccctgtcatcagaggaacagcagcttgggctattggacgtctaggaacaaaagaaccggaaaaatggcttgatgtattagatgaaatattagctaaagaaacagaagaagtcgttataaacgaattggaacatgcccagaaattattgcggagaaagttaaaataaaaaaatagttaacattattcaaagtttttgtccagtaattgttgtaacaattactggtttttttgtattttttacatttttttaagagaatttgataaaaatcaaaaatttttttgcttttttttatggattattgcagtgaatgttacagaatctgcgtttttcattcaaaaataaaaaaacatagaaaaacgattactttgcttatacaacaaggcttttatggttttgtatcaaaaaaatatttgtttaaatgttacaaatattaaataattcgttattttgtcattaaatgtcatgtttcttttacctatgaaatatttctaaatgataaagttaatagcgtcgaaagaataaaaaacggagaaaaaaaggagtttaatatgaattcatttaagaaaattgttttaggtacaacttttgctgctggtgctactgcaatgtttgtaggaactacaaatgctcacgctgatgaagtttatacagtaaaatcaggtgattcattatctaagatctcacaaaaatttgcaggagacaactcaatgatcgatgcaattgctgaaaaaaattcgatcgcaaacatcaaccgcatttatgttggtgaacaattaacaatcccaacttcaaatgattcttcagcaacaacagaaaacaaaacaacagaaaatacagcatctacaactgaaacagcaacgcaagaacatacatacgttgcacctgttgaaacagttgaagtagctcctgctgccccagctgctgcaacagcgccaacttcaagctctgcaaaagaatggatcgcacaaaaagaatcaggcggttcatacacagctactaacggacgttacatcggccgttatcaattagatgcttcatacttaaacggcgactattcagctgccaatcaagaacgtgtagcagaacaatatgtaacatctcgttatggttcatgggatgctgctaaaacattctggttagcaaacggctggtactaagccgataaaaggaaaatgatgaaaccgagaaacttgtttattcaagttctcggtttttttgtgtgaaaaataactcgtttgcttcccacagcgcagcagtacaaataaaaactcgaataatgtataataaagaaaacgtttttttgtttagggaatgaggaggagccatgagtacaaaagagagtctcgaattaaacgaaatcacaagtggaaatccactgttatccagtattcgatcgattgtagaaacgacattttacggtaataatgttcatgaagtttttgataggaagacagcttatcaactagcaaaagggagtccaggaacgatcatcacagatttaacaatctcacatgctgaagaactagatttaccagctgatgttaggacactagtattcaatgatggaagcattgtgggaagaacagcaagtgctcggcggatctttgaggacttagacaaggaacaaagcaaatacgagaaaattttaagagaagctgtgtatcaaagtcgcaagcgccagttttaccatacaaaagtaatcgttggcctatctgaagaattttctgtgcaaagtcatttgctgattccagaaggatttgagaacaatttgtattcttatttgctgaattttcagccagcgaattcgaagatcttagagacttatcaaaagtctgtttcctttgatgagggagatctttatatcttttgtgatcccgaatggacacatgaaacatttccaaatggactcattttgtttgatgctctccataatacagcggctgtgctaggattacgttactttggagaattaaaaaaagcgactttgacgcttgcttgggcattgggaaatcgcaatggctttattgcctgccacggtgggatgaaacaatatgctagtaatgaccagacctatacgatggctgtatttgggttgtccggttctggaaaatcaacgattaccttagcaaaacatacggaaggtcactctgtttcgatcttgcatgacgatgctttcgttatttctcgaaaaaatggttttgctactgccttggaaccttcttactttgataaaacacaagactatccgtctgatgatccggccatttcttctttccttacttgtcagaatgtgggcgtgacatgtacaagtaaaggagaaaaagtcctagtaacaggagatatacgaaacggaaatgggcggacagtcaaatcacgttatgcgacacccgaccgagtcgatcatcttagcgaaaagatcgatgctgttttttggatcatgaaagatgattcgcttccgccaattatcaagatcaatgacccagttttagcagcgtcttttggtgcaacattagcaacaaaacgatcagacgcggaaaatatcactacaaaaagacagctagatgagctagtcattgaaccatttgctaatcctttccgtgtctatcctcttagggaagactatcaagcttttcgagagttgtttttgaaacagcaaacagcctgctatgtcctgaatactggatatttcgatgataaaaaaatcaaacctgaaacgacattgtcaatcgttgaaagaatcgtgcaacaaacggcagaattcaagtcgtttggtccatttgaagacatccactatttacctataccagattttcctgtttcttttgaggatacgtcctataaaaatctggtgaaacaacgacttgatattcgtttacgattcattgaagctcagataggaaaagatctcttgccagatgaagcaaaagaaagtttggagaatttgattcagaaattgaactaaaataacagctttttcaagaagtaatccatgcgcaatatcgctcgggatccttacttgaaaaagctgtttttctatgatggatttttcgtaatataggtggagatgtccttttgataatcttccgtaggccaatgaccagtatttaagaagttggctaatagatagccgatataaggacctgtggtcaagccagaagagcctagaccgctagcagccagtaagcttggatcatctggcagtacgccgaaaaatggggaaaaatctgacgtataagcacgggtacctacacggaactcgtatggccagttttttatctgatctggatcagtcaagaactgttctgtactcttagtcaatcccttataagcttcgctagtaggagccaaatcccagccttgatcgttttcatgggtagcacctaaaaggatctttccatccatgaaaggaatgaaatcagcttctccgtcaagcatagcaacaggccagtcttgactcatcttataagatgtctgaaatgctaagagctgccctttttgcggacgtatatctgcagcatagcctaattcttgtaataaaggcttaagtgccgggccaggtgtcaaaattacacgatcagctgtgtattctccaaacggtcccttgatgagccaagaatcgctcttcttatgcaaagtgacttttgcctggatctgctccatttgtttttgtgctaaacgctgaccaagatgttctaaatatgcttttccatccagacgaccaccaccactgatacgcagtgaaactgctggtttcaataacggaagtgcttgagatgtctgttcaggtgaaagccattcgatgtttccaatttctggcgcttcttcttttcgtttctcggcaagaacagccaattcagctaaatctttttcaggtcgaagcaaaagtgtccctgattgtgcgtaaatcgtttgatcaagttggaaatcttttataagtttagggaaaaaagcagcgccgtctttagccagacgataccattgtttgtttctgcgtttcgacaaccaaggggagataatcccagcgctagctttagttgcctgtcctgtcccttcatcaaataaagcaacattgaattttgatgtatctaagtaactggctagggtcataccaatgatcccgccaccgataatggcaattttttccataaaaaagcctccttttacaaacaaccattttcacacaaaaaaacggcagatgcaacacctgccgtatatggaatctacgcttttttagcaaagaacagataataggcgaatcgagcaaagcttacgagaagcaacagcaacaagacgcctaatgctgcttttgatcctaatgtagtagacacttcatagttatgggaagtatgatgctggacgtaattgataatgaccgctactaatgaagtagccacagcgccagaaaactgctgcaaggtattgaacattgcgttcccgtctccttgtagttcttcattcagtgcattcattccggtggtcatcatattgctgtaagataatccgataccgatcatataaaacacatgacaagcaatcaatacacccactgaagcgtgtcctatgagtaggaataatgctagccaaccaatcaaagaaagaatcagcccagcaaaaattggcttcttcggaccatattgatccagcattttcccggaaaaaggagaaagcaaagcaccaaccgctgcgccgggaagcatcgctaatccagcgacaaaaggactacttccttgaacgatctgaaggaaattcggcaagacaaaagatacaccaagtaataaaaactgataaactaagaagccaatcaaaaacaagcggaatgttttatttgaaagaatagacagtcggatcagtggatgctccacttttttacttcgatagtaaaaaaggaaccagccaataccgccgatgattaaagcaatccagctggaaactgttcccaacgtactcaaaaatgttagacttccactaaacaaaagacaaattcctaaaacgcttatccaatccaaataaccacttttttgtactgccatctcgggaatagcaaaccagccgataatcaaagaaagaaacaaaacgggcacaagaaacaggaagatatgattccatgtaaaatgtgaagtcataatgcctccataagtggggccaattgctggagcaatggccgttgtcaaagtaccgacacccatcatcgcgcctcgtcgattgaggggggcaaatgtcaagataatatggaacatcaacggaagagcgatacctgtcgctgcaccttggagcaatcgaccaaacaataggaccatgaaggtaggagagaagaaatcgatcattatacctgccaagaaaagcagatttgaagctaaaaagagttttttgagactaaaattgcgattcaaataagtagacagcggaacaatgatcgaaatcatcaaaagataaatcgttgttacccattggacttgtgcagtcgttaaatcaaactgtctgataagagttgggaaagttacattcatggccgtctcgatcaatacgcccgcaaaagacatcatccctgttgcaattactgcaggtactaaaagcagctgtttttgttttgtcatttacatcacctctaaaaaatttcgtaaaaaaagagagtgatttctattataaaaatagaaaccgcctctctctcgacacgccgaaacgtgttatctgtacgatttatttacttcacttattctagcacaaactgaaaaatagtgtcaacacgattagccaagtcactcaaaaagaggtatgataataaataactaaatggaatttcgcggaggaagaaaaatggaaaaaattgaatggcgtaaagacaagagctatagtatgaaaaaaagcccgcaaatactagaggttcctaaaaaatcattctttagcatcagagggatcggcgacccgaatcaggaagactttaaacgaagagtagcctgtctatatgcagtcagctatgcaatacgcatgtcgcctaaaaaaaattggctgattcctgattatcagatgtatactgtctatccactggaaggacaatggggactgcaagaaaagtatttgcatgaaccagtgatgaaaaaagaacatttttcttatcaattgatgatccgacagcctgactttgttacagaagcgatagcacaagaagccattcagcgttctagcaaacttccggaagacttgaaagaacaagtagtattcaaaaagatggaagaaggtctttgtgcccaaatcttacacgtcgggccctatgccgaagaaccagcaacgtttgagaaattagaagcattcatcgcaaaagaaggctatgaaagagcttctaaagaacacaaagagatttacatcagcgatccaagaaaatcagcacctgaaaaaatgaagacgattttgcgtgttaaaatagaaaaaggttagcaacctgaatgaaaacaaaaaataaaagtaaaaaataccaaaatatgaagaaatattacttatcttttgctataatcaacattgagaggtgtctaatatgaaaaagaaacagcgacaagcactgatccgccagatcattacagaacaacctattgggacacaggaagagctgcttgcgcggctgcatgaagcaggcgccgatgtgactcaagcaacgatttctcgagacattcgagaaatgaagttagtaaaaagtcaaaatgaaaacaaaatagtacgctatacattatttaaccagccatctgtttctttaaatgaagaacgtttgcgtacagcaattagacgcgaggttttgcgtatccagtctgttcagttcatggttatcgtattgactgaacgaaatggtgccgatgtggtaacgaattggctagatgaagtggcttaccctgaagttgtcggaacgatggccggtgtagatacattcattattatttgccgctcagaagaagaagcacagcgatttgcagaaaagctggaaaaaatgagggaataaatgaggaggacttttatatgaaagatatgaaagcgctgcaaaatggatcggatattcgaggaatcgcattaccagttgaaggatatgaagtaaacttgacgacagacatggtaaaaaagatcggctggggactagcaaactggataaagaaaaagaagaaatcaaccgatccaaataaaaaatggacgattgggattggtcatgacagtaggataagcggaccagcactgaaagaggcgttgatccaaagtctgaaagaacaagggatacatgtcatcgatttcgaattagctactacgcctgctatgtttatgtccactcaatttgaacagttctcgtgcgatgctgcggttatgctgactgctagccatcttccctattattataatggaataaaattctttacctcagaaggaggagcagaaaaagaagatattgcttttatcctatcacagcagcaaaaaataaaaagcgaacaaactggaagcgtagaaaaagcagaccttttgacaccttatgcgcaagatttagtcacaaaaattaaaaaggggattggaacactagaaagcaaaccactaaatggttggaaaatcattgttgatgccggaaatggtgctggtggattctttgctgaaaaagtattgaatagcttaggtgcggattcaacaggttcccaatttttggaaccagatggccgatttcctaatcatatcccaaatcctgataataaagaagcgatggaaagtatcaagcaggctgttttagcaaatgaagcagatcttgggatcattttcgatacagatgtggatcgttctgcagttgtcagtgcttctggaacagtgatcaatcgaaataatttgatcgcagtattaagtacaatcgtattaaaagagcatccaggaacaagaatcgtgacgaattcccctacttcttctcatctacaaagattcattgaagaaaaaggaggcatccaagttcgttatatttccggctatcgaaatgtaatcaataaagcattagaacttaaccgtcttgggaaagatacacagctagccatcgaaacaagcggacacgctgcattcaaggaaaactattttctggatgatggtgcatatgtcatcgcaaagatcctgatgcttttgccagaattaaaaagaaaaggtatcacattagatgaacaaatcaaagagttgaaacagcccgtagaagtacaagaaatccgattaaaattgttcagcgatgaaccacgcgaacaaggaaacaagatattagaagaaatgaagcgactgttggaagaagaaaaagggatgaacttcgacccggaaaatgaagaaggtattcgatatgatctagaagagccatacggaaacggctggtttttgatccgtttaagcttacatgagccgttactagtattacagatagaaaatgatgaattcggaaagaacaagttggcgttagtaaaattagcaaaattattcggacatttttctgatcttgaatcattaacagcagaataaaccagtctttttgaaaggctagttgcttggacggcaaaaaaagtggtatggttaaatcgagtgctggtagggagaccagcaaaaggaggaaaaaatggtaacgaatatggttatttttttaacagtattggtttatggggtcaactttctggtatatatgtatcttaaaatcaatcatataaaagattatgtagaaaagattgctatttattttggaacaaatatgacgctgttgttcacgagtagtatttttttgttttttggaaaaatagtagaagacggcattctggtattcgaataagcagaatttttgtagaaagcgccttacttgtcatacactataattatagccaagtagcaaatggtcaatcgaaaggagcagtacaatgaaaaaagcatacgaaacagcaatgatcaaccatggcgggcgcaatggagaagtcgaggcaccaaatggctcgatgcatatgaaaatcactcctccaggaatccatgcagaaggaacaaatccagaacaattatttgcagcaggttatgcttcttgtttcaatggggcggtacaacatatgatcaaagaagcaggaatgacagcagagtccacagtaaaagcacgtgtctctctttataatttagatgatggcggctatcagatcggtgtagtattagaagtgcatatcgatggcatcagcgaagaagaagcccaaaaaattgcagaagatgcgcatgaattctgcccttactccaaagcaactagaggaaatatcgatgtagaagtaacgattgtttagaagaataaaggaaatcgaaccagactaaaaacgtgaaaggaccgctttttgtctggttttttttgacaaataaagcagatgatttggagaatagacaattatcggttatcatatttttgtaccaatcggtaggtaaaaaagaagcgagggaaaaatgatggaaaaatatcaaaatattgtgatcggttttggaaagggcggtaagactttagcgaaggcgttagcttcaaaaggtgaatcggttttagtcgttgaaaagtcaacacgtatgtatggcggaacatgtatcaacatcggctgtattccttctaaatcattgattttcaatggagaaagaggaatcgactttacagaggctgttgctcggaaagaaaaattgacgggcatgcttcgcgccaaaaattatcatatgatcagcgatgaggcaactgggacagtgatggacggtacagcacgttttctttctaaccatcaaatcgaagtgacgaataatggtgaaaaagtgattgttgaaggcgaacggattttcatcaatactggttctgaaccaatcattttaccaatcaaaggattgaatacaagtcgctacttgattgattctacgcaagcgatggatcaggaacaattaccggaaaaattagtgatcatcggggctggatatattggcttggaatttgcatcaatgttcaatgaatacggatctaaagttgtcgttcttgatgcccattctgaatttcttccacgtgaagatgaagatatcgcgcaaatgattttagaagacatgacaaatgcgggaatcgaattccatctaggtgtatctgtagatcaagtagcagaccaagaatcaacagctgccgtcacctttacagaagatggccaagaagtaacaatccaagcgtcaaaagttttggctgcaactggaagaaaaccaagtacagcatcacttggattagaaaatacagatgttaaactaacagatcgcggagcaatcgctgtggatgaataccttcgtacagatgcagacaacatttgggcgattggagacgtcaaaggcggattgcagttcacttatatctctctagatgattatcgaatcattatggatcagttgaagggcgagaataaacgaacaacgaataaccggaaagctgtgccttacagtgtatttatcactccgactttatccaatgtaggtttaacagaaaaacaagccaaagcacaaggcgtcaattacaaattattcaagtatatgacaagcggtgtccctaaagcacaagtattagaagatcctaaaggtgtattcaaagttttagtcgaccctgaaactgacttgattctaggggcaagtatctatgcggaagattctcatgaagtcatcaacttgatttcgctagctatgaatggaaaacttccttatacgttattgagagatcaaatctattctcatccgacaatgagtgaagctctaaatgatgtattaaaataaataacgaatggagaatccaccatgttcaataataaaaatacagcagtagttctcactgacccgcaagtcgagttcttgaaaccagcaggcggtggctttggtttgacaaaagatatcttagaaaaatacaatacgatcgaaaatatgattgaaatggtaaaacaagcaaaagaaaaaggatacaaactctttatttctcctcattatttttacccacatgaccataaatggcaatttggcggtgcaggagaacatatgatgcttgagcagcagatgtttgctagaaaaagtcaatatgaatcagtggaagaaggttcaggagccgattttatcgaagaattgaaaccttatttggatgaaaatacgatcatcagctctcctcataaaatctttggaccagaaagcaatgatttggcgctccaattgagaaaaaatggaatcgacacagtaattcttggtggaatgaacggaaacttgtgtagcgattcccatatgcgtgaattggtagagagtggattcaatgttgtggtagcgacagatgcaattggtgctcctggccaagaagcaatggatgcagcgttgacgaactttggctttattgcagatcaagtgatgacaacagaggaagtattagagcaactatcataagataggaattgcttttgtcctcgcagttcttgaatcaatgaacatctagctatatgagaacagttttatagtgagggctgtgtcagataatttggcacagtcttttttaaacgattaagaagaaaaaatgatgaatttactgtataatataggactatgagaaatgaaaaaggagaatatcattgaaaacaaaggaaaagatcttggaagcgaccaaagatcttatttataaaaaaggctatcatgaaacgtcaatccgagatattctagcagcttctgatacaggaaaaggtcaattttattattacttttcttcaaaaaaagaagtttgtctagcggtgatccatgcgcatatggacgtatggcagacagaattgttcgaagacatcttaaatgctggaaaacagccagaagaagcattagaagaaatgttggactggattttcgctgatcatgagacacagatcacttatcatggctgtcctgtaggtaatttgattattgagttgagtacagtggatgaagaataccgtctgttgctactagaattagtcaatcaatgggtcaagtatacgaaacaaaatatcctggcactttctgaagaaaaactgtccgatgaagaagcagaccgtcaagccaaagcgttgattgctgaaatccagggaagtatcttattgttgaaagtcacacaggatctatcactacttaggcagaattttcaattgatcaaagaaagattgttaacttcgcaaaaggttctttaataattagaggttgtgacagaagtggtcagcttcaagaaataagaaggaatttacgaaaattgcttctcaaatttttgtgaaatttcggcttatttttcgaagaagctacttctggaacaccgtgtattagaggttgtgaaatcagcgctttgacctgagtattagagaaacaaacggcaaaatagttcctcatattttgccgttttttgagctaataccgaaggttagctgattgaacaccgtttagtggagaggttgtgaaaaagctgccctgcatcaagtaataagaacagccaaataaaaatagctgctcatatttttcgtttggttgggcttattaccgcagatgcaagcttttgaacaccgtttaaggaagaggttgtgaaaaagtcgcttagtttcgagtattaagaaaaattttgtgaaaatagctttctacatttttgcataaatttggcttaataccgagaaactggcttttgaacaccgtttacccagaggtcgtaagcctgccgtttcactccgagtcacaaggaacaatttcaaaaagcagcttctcatgtttgttgaatattgtgacttgtgaccgaggagttggcaggagaataccattcactggagagtttgtcacttgtcacaacttttttagttctacaaaaattgaaagcgttttgttggtgcgaacttcttgttgcagtgtatgatagaaaaaaagattgggagggattaggatgtgtggtcgttatttttttgatctagagtcagagctccttcagaattattatcgagaagcccagacgaaacaaccgaagcaggcagcagaattagcagctggagaagtttttccgtcaaatcttgttgtgacgttaagaaaagaggaagaaaacatcctcactccggaaatcatgaagtggggatttaccggatttaaaaaaggacaattgatgattaatgcccgtgcagagacagtagaagaaaaaaagacctttcatcaaccatttttgcaaaatcgttgtgttttcccaatgagtggaatgaagaaaaagacaaatttatgttttcaaataaggaaaaaatagtgtatattggcggtttttatcgtagccatcaggatgaaaaaatggcagaatcaatcataatgactactgaacctaaccgcacagtcgcaccaatccatgaccgaatgccgcttgtcttgactgaagaacaaatcgaaccttgggtaacagatatttcttttgcgcgaaaaatcattactcagcagatgcctgaattagtaatggagaaggtataacataatcgatttttcaaagaaagagcggcaaaaaacgaaaaagacttcagcacagatcccaaaaacaaagagaacagaagaaatgctcataagctgcatatactgcatctatagggtcacagtcgacctttctaatgtatagcttctatttgttttttactcgtgctgcgagtcttttttatttatacctaacgatgtttatcattatgactctttgaattcttggaatctaaaattcaaagttaacgactggttggcagttgtatattctctgaatttatagataagaggttgccatttatccacattgatatgagttggatcatgtaaaatcccttcttctacaaaaatagctacgatctcacgttctacaatagcaaagtcttgtctagttgaaattcgttgaaccaatgtttctatttgaagcgggcattctttgatccgaacagttgaaacttcttcacctgctagtttcgtgaactttcccaattgaaatttgtcagagcaaaaggaatagccagctttttgtttataatcgggcatgataggatggcctgttgtctttgaaattttctcccaaagcgttttatctgcaaaattgaaggtagcggggggttagctatagtatttgggtagcttttggatccataggttcaatgtttcttggattatttttttagttaaagaaaaaatgaactggctacaatttatttctatttatatccaataagatatactttaaacaaaacaattttctagatagtttacaaaggggaattttgcgttacttagtgttatatagtatacttttattaagggagtgatgataatgcttgttacaaaatctagattacaaggaagttctgtagtggtaactttaccttctgataacggaaagaaaccttcagaaaaccaagaatatatcgttgtgtattctgatgatggaacaattacgttagttccaaaaattgaagatccatttagtggtggggaagaggccgagtattatgagaaagacgaatgggaagatttaactcctgaagggagagaaattttatagtgtcagaagaaagaatttatattcctaaaaaaggtgatattgtatggattgattttgatccctccgtaggaaaagaaattcaaaaaagacgaccaggactagtcgtctctcgttatgaatttaaccgtaaaacaatgttttcggtcatatgtccaattacttccactataaagaatttaccgacacgttactcattacctgaagagctagatataaaaggacaagtaattattacacaattaaaatctcttgattttaaggaacgaaaactcaaaaaaatagaaaacttaccattgcaagacatggctaaaattgatcagattatacagtatatgttttaagcattgtaagtaaactctataatatttttatatgctaaacataacgaaattaaaaaaaggccaagtaaatgtcgttcattctactagtgtggtcgatggcattaatttccgtatcttaaactaaagaatatatagcattttaaacgaatgattgaggtgatttcctcaagtcattcgtttttttgtgtcacaaaacttgttttttcacgacatatcttaacgtatacgaaaagtcgcgacaatactttaacagaaagaagaaaaagaacaactgacagttttagtcctaaaaaatctaaactctttagatatgagtaatgtcattttaaactatatcgatgctcaaaaacgtaaaatttgggatcaagatctgtctaggaaagaatttctatagtttaactgaataacacaaaaaggcatatcatgcgacaagaaaaacaatgaaaagagaaatttgccatcactggaacatccatacagaaattagcatagattctgaaaaatctaccgctagtttttatttagttgttctaacgacaccaatacttgtaatgatcgaaaatgtgcaattgggtcagatagtgaaccaaagtagaatctcaaagcgacaattatgaatgtaaaagtaccttttatgattagtttattctctaattgattacatcccgtataattaataaaattactttaccgattacacgatcttatgtcagtagagcttttaggtacactatcaatacagttcattccagtataatgtaaggttttttttattttgagtcactttttgtcaatattattatttacaataccttctataataaaagttatttaaggaagtgtctatgaatgagtaaaaattctaaaggattcctaaccatcttattagcttttatagggtatatgttggttgggctgctaaaatcatacagtaatgagttgctgaatttttcaacatttattaatgatacattagttccaagtttgtttttcattgtattttttgctgttggttattttataataaagatatgatgactaatttagctcaactattccagcgtcagctgaagatattgcaattcccgattccttaatcatttatctggatgagacagaaagtgaagttgcaacagatgtgcatgtagttgaggataaaaatgatagtttaaaaattaatagttcagatactttactaagagtaagtcctatcttttcagctgttatttagatgcaagtagcaactaagttaggtagtactcctgcaatggataggtatttgtgtgttcgatatataagtggtcgaagtatcaaggttatgtatactggatgggagatagaagagttaaaaattggaggtcaccgccacaaatggaatttagatttagaggtaccttagatttggtatagttattaaacacaagatggcctggtttgtagggaaagtcgaagagtatttttccacttctgcgcccctttaatttttctagtaatgccgtgaatttgtgattaattggaaatatgaagaaaggagagtctatgaaaacaacactagttctattctataaaaagcatccttattttacacttctgataaatatattgttggctagtgttatcgggatttctgttgaatatctaataaataaagatttcataggttcttgtttttatacggctttatttcttggacttcttgaagcattttccatttataaaaaatcaaaaaaataaaatagattgccgtaagagatctttttcatttcatttttttctgaaaacccgttgtttctgtcagtgaagcagcgggtttttagatttattgtctttagacctaattgagcgcgccgagcgattgaaatacaaaaccacttgctatgcgggtggagcaataaagggaaatagtttagcccgtacaaagtagatgtgtaaataccacattgtattcacaccaaagtatagaagaaaaataatttataatcaatatcgagccaatattcaggagatcatcaagagattgtgcaaatctaaaatataaatttgggtatcgacacttttgggtggaaggatactatgtgacaaaagtaggacaaaatgaagcgaccatcaaaaagtacattcaagaacaagaaaaacatgatagtgcgttagataagctgagtgtacgagagtaagacgatccttttaagggctaaggagtagtacataaaccttttaagaggtgggcaaaactggcaaaggcaatatggcttgaacataaaatatgaaagccagcgtctttaggcgctggccggtgatttgagcttatagctctagagaaaaccacccttttgaagggtggttatgattaatgactttagtcagttttgctcacaaagcgtgtggaacaaaaaacgggtgtttctacgggtagatatttatttcttgaatggaggtgtcccatacatttttggtgttactggttctaattttggtgcagcgccttcgatcttaggttctttcaaccattgatattcgccttcgccatccagtgctttgccactagcccaagaaccttcactactttggtctccctctgagaagttatagaagtcataagcaatgtcttttcgttctttgtcacgcgggaaagtacttgggactaagattgaaccttctttttcttctaattctttcactgcacattcccatagattttgatgatagctatctcttgcaaggagaacagacagcatatcttttacgccacgatcatcgatcatttcgtaaatacgtgctacttgaagtcttccttgtgattcggcatttaaattagctctaaagtctgctaacaagttgccactcgcaatgatataggcaccgctccatggattgcccacgctgtcagcaggacgaggtcctaagccagctacgatcgcgtgctgtggattcattccagagataatggcaccgattgttggatctttttgcatcgctgcttcttgatcttcaacaggcgcaccctctaataaacgagcaaccattgtcgccaacatttccacgtggccgatttcttctgttgcaatgtccatcagcatatctttatatttttcttctcctcggcagctccagccttggaacaggtactgcatagctacactcatctcgccatattggccgccgatcagctcctgcagatatttcgcgattaatggattcggacgatctggttttgcttcaaactgcaattctttctggtgtctaaacatcaaaattcctcctaatctatttttaatacattctcattctgctacgaaagattaaaaaattcaaagaaagcgctcgcgaattatataaagtattggtatcattaataatttttttagaatcataccttataaattgttattttcagaacaaaatgatatcgttatattaaaaccggcatcggttacattaaaatttggaggtaaaatatgaaaaaattattgtttacagggttgctggcaagttcagcattgtttttattaggaggatgcggatcaagtaatgcaagcgatgccagttcaagtgcagcaaattcttctgaaaaaacaagtgatggaagaaaaaatattgatttctggtccttttggggatccggtgcacgaaaagaagctatcgaagaaatcattgaggatttcaatcaatcacaaaacgagatccatgtaaattataagtatcagccatggggtgacatctggactaaatctttatctgcaataacagctggaaatgcacccgatgttattgtacaggacataaattccgttgcccaaagagcagaagcacagcaagcaactaatctctccaaatatgtagaaaaagacacttctaaggatttttatccgcagctttgggatacagtagaatatgaaggtgatccttatgcgatcccattcaatacagatacacaagtcattttttataataaaaagttatttaaagaagctggaatcagtgaacaagatctaccgacaacttgggatgaattagaagaaacagcacgtaaactagataaaaaagaaggaaaagaatttacacgcatcggtttttatccattatggaatttaggggctgatgtatgggcgctaaacgcagataacgggactagttggtttgacaaagatgaaaaagtcaagattgatactaaaaataaagtggaagccttggagtggatccaagactggcaagattattatgggaaaaatacgatcaataaattagaagccgaatttgggtctggtgtatctgatccatttatttccggattagtagccatgcgtgcccaaaatatcaattattactctagtttgatggaaaatgcaccggatgattttgattttggcgtgatgcagctcccagaaaaagaagaaggttcaggccattggtcgtggggtggcggattcgtcttggaagtaccatacggagcaaaagatcctgaggcctcttatgaattcatcaaatatctttcttctccagaagtacaagaaaaattcggcgaaaaaagttttgatatcatggcgagcaagacagccaatgagaatttagtgaataatgacaacctaacggataaaggaaaaatgatctatcaaatggcggacgaaaactttaaaaatacggtgatcacaccagttcctttagatgctccggattacacgacattagtgaatgaacagattgaccagattcttttaggaacaaaatcaccaaaagaaggattggcagatgcacaaaaagcagtagaaaacttagtcaagcaaaatcaataatccatttttgactgtctaggtacagaggaggcaagaaaatttgaagcgtttatctatccgaaagaaaaaagaagcaagatgggcctatttatttatctcgccttttattatcgggttcttggtatttatgctagggcctatgcttttttcagttattggtagtttcaccgattataatttgacatccaagatgaatttcattggtctagcaaatttcaaaagaatgttcgttcacgatgatttattttggaaatcgttatacaacaccgtttatttcgtcatcttcaatgtaccgctgacgacgattttcagtgtgtttttagccacagtactcaatcaaaaaatcaaaggaatcagtgtattccgtacagctttctatttaccggcagtcttatcaggagtagcagtctacatcttatggatgcagctgctttctccatctgcaggattgatcaacacatttctgggctggttccatatccctggaccagcttggctgtttgatccacaatggacgaaacctgcgttgattttgatgaaaatatggagttctggaggagcaatgctactttacttagctacattacaaaatgttcctagatctttatatgaatcagcagaaatcgatggagcaggcgtttggggaaagttcaaaagtattactttgccattaatcactcctattattttttacgatgtgatcacctctacgatcggttctttccaaatttttcaagaagcttatgtcatgacgaaaaatggaacaggcggacctgcaaattctttgcttttttataatctgcatatgtggaacaaggcgttcgtagcttttgatatgggttatgcgatggctatgtcaatgatcctgtttctgatcgtgttggttctgacgtttgtcaatttgaagcttgcacctaagtgggtctattattctggaggtgacggcaaatgatggattatttcaaaaagaccagtgtgaatcggcaaacaaaaaaaatactaagttatgtcctcatgacagtaataggaatcattttgatcattccattgctttggatggtgtttacttcattgaaaccaatggaagaaatcgttcgttatcctccgacctttttcccagaaaaaatcgtatgggaaaactatctggatacgattgccgcctttcctttttggcgctatgcaagaaatacattattcatcactgtgctagtagtgatcggtaatgtcctttcaaattcttttattgcttatggatttgcgaagcttgattttcctgggaaaaagctgatgtttgctttggttctttctacgatgatgatcccggggtttgtaacgatgatccctcaatatgtattattctccaagatcggctgggtaggtacttatttgcccctgatcgttccatcgttcttcggcaatgcgttcaatatatttctgatgcgtcaattttacttatcgatcaataatgaattgatcgaagctgctgaaatcgacggagcgaatcatttgtatatttggagtcatttgatgcttccattgacgaaacctgccttgattaccattgcgatcaattccttcaacgcagcttggaatgatttcttaggtcctctgttatatatccaagatcaagaaaaatacacgttacagattggcttgcaagtttttcagaaccaagcaacgacacaatggaattatctgatggcaggagcaacacttgtcttgatcccgacgattttgctgttcttttttgcacaacgttatttcattgaagggatggatttgacaggaggttcaaaaggatgatgaatcgatcgattggtaaaaaagccaatgattatttcttagaaatcattgaatggattccacgtcttatccatttacagctactatggttcctgtgcgtcttgcctgttttcacattaggaactgcaagtcgaacagttctgtatatgatttatcattacaaaaaaaatgaagagaaaaagctcggttcactattctggaaaaagtttcgtgagaacttctctctttatggaaagcaagatagtttagcaagtgtttattttcttcttctattgatcgattatcagattttccgctattggggtgggggaattggctatacattgatgtatactacgttgtttttgcttctattaagcgcgcttctctttagttacaaaatcttgcttcaactggaacaaaaagaagcttcttggattactgcatttttcttgttttttaatgatttcaaaagcgcgcttttctatttggcaggcacgttgatccttcttgtcgcattctggtttgcaggaccaatctattttgctttattaggtttcagtttcttgttttattttcaagtcctgctttttatccatcgtacgcaagaaaaggttcttaaaaaggaggaataacatgttgcgtttgattgctaaaatcgatgatagtattatcaacaagttcgccaagcaacggaaaacggatagtcgaaaaatcaattttttgaaatttatcagtaatatctctaatggtggttttatttggttgctccttgctgctgttttagtcttgatacctgatactagagaatatggtctagccattcttatcggcagtttgatctatttttttgttggtttgctttttatcaaaaaaacgacaagacggaaaagaccttatgaaaaaaatcgtcggcttgtcctttacacaagtaaaccgaagacttcttcttttccttcaggacatacagcgctagcctttttatcagtagctgcgttgttcgaattaagtccagttgcaggaatattagcctttttatttgcttgtttgatcgcttattcgaggatttttttacttttacattatcctactgacattttaggaggagctattttaggaagtgttattggcatcctatgcgctgccgttatctgaattaattgtacgaataaagcatgagtgcgtaaatgcgcatttgtgctttatttttttgtttcgaggaaagcgtagttgtttattcatttgtcttaataacttaagttttgttaaatgagaacgttataaaattttataatttaattttaataataaatgttgtataattggtgttttttaactaaaaaggatatcatttgatttaaaattaaaattaaattaaattataattagatgggcattgttttgttgattgttgtgaaagaagacaaatatttttgaaaggagtataaggatgtgaaagggttaaaattgaagcttttgcagttagtaactgtcagtttgctatttggaccatatttccagtcagtctatcatatgacgaccctggatgtagctgctgagtcaacagaaacaaaggaggatgaggtattcttagatgaggactatgcaaaaattgaagggaagtatattgaaaaagaagaaacccttgaatggcatctggcttttgaaaaaaaggaaagtgccaatgaaggtagaatacgtttagcaatcgatgcggcagccgccgggattggtaccgtaaaaaacgttcgtggaacaggtctatcctcctatgatgaagatggagaagacctaaaagtcgagacgatcgatggtcaagaatggtatgtcggaaaagtttattcaaaagaagcagaaaccggcacattgatttttgaaacagaaaagatccccgatgtgaacgaagggtaactacctcttcaagtggtggttgatgaaagaatagataaccaagaattacaagaaaatgaaactgatacagaagattccgctgaaattcaacgtagcgaagaaaatgagatggaaaagctggacgaaccaatcgtacccagcggtcaagcactccagcgcattcaacgccagttattcaacggtattttggagcgtcttgggccaacagctacgcaagacccctatgaatatatctatcctagcggagaagttgaaaacgaacagcatcgctacccgaagtttacaacgaatgactatacaaaagtgttaggaaattggacacaaagcaatgaacgctatcaaggagacaaaggctcgccatatgacggagagaacttgatcgatgatagtgattatacaaacgggggagcgaactggcgaaattacgactatgctactaataatggatcaactgcaggcgaagaagatagaaacgttccagctcaaaccgttcagctttggggaaatgaacggaattttgaaaacagttacttggattataacggggcgtacatcaaaaaatgggtagaacctgttctgccaagcagcacagcatctgatctacatcctgaagatgcaacaaccctttacaatgtctatctagatgtcatcgggggcgagaaaaaggaaatcagtccaatcgatatcgtttttgttctagataagtcagcgagtatgagtgaattaaccgctgggaccaatagtcaaactaaaaatgctgcgttgattgaggcagtaaacgaaatgagtaaagatctgctctctgacccgagtctggatattcgaatcggtatggtgaatttttaccataatagtacagctatcaataaccatgagcaaatcagttcggacatctttccattgacaaatgatatcaatcgtttgacgggaagtgagaatacagcattaaatcgtacaccaatcggaggaactccgcttacactagggcttaaaaatggctatgaaacattgtataaagacaatggcggagaaaatagaaatccagaaaaaatcctaatcgttgtgggagatgggacaccgaccttcagttatgcaccgattcagtcaagttatcgtacgagcactaatggagcttggagcaactggactgtgatggaagataagattgctgaagataatgacgttttgttcagaaattttgaggagttttctgggaatacttctaatgcagggtttactcatccagttacctatgcatctgactttaaccgtccagaagatgaagtaaatgtacactatcgttatggagaggtaaaagaaggagataataaagcgactcactgggttggtgatggttcttctaataacaatacgaatggcagtcctacttcgcaagaaaagtcatctgcgatcaacacagttgcttatcatcattggctgaaaaacaagtatcaagagaacccgccaagtatcttctccattggtttaggaatcgatggaaacgttagcgggagacaacgactagatgctattggacgaaatgtattgaaaaatattgctgatttagaagaagatggcgtaacaccgcgatattacaatgcgaacaacaagaatgacattgttacagccttggaggatatctcttctaccttcaagagaacgatccagcaagccacactttatgatgaaactggttttaatgtctcaccatttggagctggcagatcggcagatattcagttttaccatctagatccaggagaaaacggcatgaagtaccaagagccagaaatatgggatgaagaacgtcatggacaagccccaccagaagtagtggcgactccgacaacgtatgtcggacgggaaaaccaagcttataaattttctccgatttctttaggtgaaggggaaatggtcaggatcaagtaccaagtaaaacttgatgcgggagctcaagacggaaatttttgcacagtgaacaatatggcctatattcagaacctggaggattatgagaatgatatcactactggacggatgtatttcccatcttcttccattcgttacgaacataaaggccgtaatttccaagtcagcaagaagggtcaaaatggcgagccgttggctggagtcgaatttgcattatatgaccaaaatccagagagtggggaagccgaaccaatcgaaacaagtaaaactaccacggacggaatagcgatctttgaaacgaagatgccgattttaggagatgaaactggagcagtcagcgacatattttggatcagagagatcgctggaccaccacgttatcagttagtagatgagacgtatcaattccaaatcaaaaaatatgcagccaacgaagatgagatgttaggtcactacgagcttgtagatgaatatacatctggttcgagagtcggcggaccggaaggtaaagatccgaattcctattatgaaggagaatatcacaagctttctgttgtacaagagcctaacatagaaggcacagagtatgatgagttgtatgtcaaactggaaatgcgaaatgaattcaagccaatccacatgaatatcaataaactaattgaaggcagtaatatgccaatcaatggcgcagagtttgaactttatgaaacagatggtaacggactggaaatcggatatccagtagcgaaagggctttctggtgtgaacgaagtagaggaagagaaagggagactcacgttctattcagtagatgaagacgggaaatatgtaatcgtggatggtgagaaagttattcatccaatcggagagccagattcatttgtttataaggatagtgaagaaactaccaactatgcagaatacaaaatcattgagagccagaacccagaaggtttcaaagaacctgatgaaaatgacacatggatcttgcgactttacgataatgctatagggactatccaactcaagcaaacaggtgaagaaaattggcaatatctcacgtatacaacagatgaagaggatcgtttatgggtagcattcactgcttacaatacgtttgattatcgggagatccgagttagaaaattagaccatgaaggccatacattagatggtgcaggtttcgatatcaggaaagtgggggattcttccttcccgctgtatcgagcatacactggtaatccgttagaaccagaagaatcgaaacgtttgcctgggatcggatacttctattctcgtgccgtaggagtagaaaagtatgtcgatttaaattacgaccaacctctgcatctgtctattggtgaatatgaggtctcggaatctgtcgcaccaaatgggtatcggctatctgatcaagtgttccagtttgcactgaatgaagaaggtaagtttatcattgaagatacggtcatcgaagacgaaactgctcccttgccggaaggctatgaaatcatcgatggtgtactacaagtaaccttagaagatgaactagcgccaatcgatttggaacttttgaaaattgacagtatgaatagccgacgtcttgaaggcgcagaattttcaattgagaaacaaaatagtgcaggagagtatgaaatcatcgagggaggcttggcaccagatccaaacgattcttccctattcaatgcttcagacttgttggaaggggtctatcggatcaaggaagtgaagtcacctgacagctatagaaaacttccaggttactttattttagaaattagttatcgagaagaacctgacatagaaaatgatcgggtagttccaggaaaagaagcgggtacactaaaagttgagatttcgtattatccaaacgaagaagcagagacgcctgatctacagcaagagttagaatatgaacttttggagacaaatcgaatcagattacagcttagtgtcgggaacgatcctgaaaatccgttgcctgctacaggaggatccggacgattattctatatcctgcttgctgcattcttcatggcgcttgcaggagcagcctatggtttgtttgtcagacaatctaaaaaggagggagcaaggtaatgaaaaagctgttgtgtttgatgcttcaattacttgttttactaccgcttgcagcagtccttcttccacatgcgatgtcggcagaagaatcaggggaagatgtcgtggaattcgtgttgcataaacggatgattcgagatatcgattataacgatcaatttgaataccatgaaaatgatggcttggctatctctgaggaagcaggggaaacagcagatatcatttcacagacggtgccactaaatggagcgacatttgccatttacgacatgaccgattattatcatgaaaaaaaagctgctgaaaacatgactcctaaagaattcgtccagcaaatcgctgaaacgaacagaaacaatatccgtcagctaatcacagaagaaaggcttgtccaaatagggacttcggtaacaactgggaaagatacggttggcggattaggagacgggattgcacgtatcaaagcacctaagaaaaaccaagatcgggatgcagtttatttgattttcgaagaatcgattgatccagaagttggattggatgttgatatcgatcagacagctatcccaattgctgctattttgccaatttatcacccgacagaatcaaccgaggaactgcaagagattcatatctatcctaaaaatgtcggttatctaagagatccatacttcttcaagtatggacgtcaaagaggaacaactgaaaaaggaaaaccattagaaggtgctgtttttgctctatatcagatgatagaaggggggaaatattatttagatatggctcctgctaatgacttgaaaaatcaatggatcaaaccagcagacaatgatcctttgaatgacaaaaatgtaagcaaattcatttcggataaagagggccttgttacgacaggacaacgtttcttgccttctggcacctattattttgaagaattaaaaggtgtggaaggttacgagatggatgaagcaagtaagagaatcgaggtcatcatccctgaattttgggtggatgcaaaaggccaaccacaatatgtagtagttaacggacaggagatggctgaattagaatccgggaaagttccagtctctgcctatgaatccgcaacaccacgtgtttataacgagaccgtaaaagaaacaacggacaaaccgaaagagccgagtggtccaagcaatccaggtcaatcaggaaaatggtccgtattcccgcaaacgaatgaagcaagaacgttgatttctttactaggaattcttttattgttaggtgctgttttattaataaaaaaagaacggggagaaaaaaatgaataaaaaaatgattgtcacgggaatgagtgtactgttactcgttactgcgggaatagggattttcgggaacggaaaactagtcaaagccgaagaagtcgcacaaaaaccaagtgaagtgacgattacattacacaaaaaaggtttctcatctgttccggaagaacgaccgaatagcggattggtttctacggattttggtgaagaaaatattccaggagtcgattttgatttgtttgacgtaacggaagtatattacgatttgattcgagataatcctttaacaccggaacgagaagacggtcttaattctgccgaagcgattgaatggattcaaaaacggcacacagaaagttggtttttaaaatatcgactgacaagtattgacaaacaaacaacgaatgaagctggagaagcggtattctctaccgtccaagtgacggaagaagcaccttcttctagagataaagtctatcttttcttagaaacttattcgccagctcatatttccagaatcgcgtctccaatggttgttatgatgccagtgatgatgcctgatatggtggatggcgtgtgggatggttctacatggaaagacacatacaatacagatgtgcatttgtatccgaaaaacgaaatcagagaagcagataaacagatgaatgtagaggaaagcgaccttagacaagtaacgattattaatgaagctggagaacaagaaacgatttcttatattgatctagaaagaggaaaaacggcttcttacacgatcacagcacctattccttatttcatcgattctgtccttgaaaacggaagcgctgttatcaaaaattacaaaatcacagatacgcctacagttggtctaacttattatgatcaggaaatagaagtgcgagccggcgagacgattttaacaaaaggacaagattatatagtagaagtagtaagcaacgggtttgtcgtgacgattttgacagaagaaaatggagtagccaaagtagatactttaggtagattagcagatgcacgtggaggagatttaacgatcacgtataatttgaaggtttccacagaactagaagcggatgatttccataacaacacagcggttattgaaatcggacgaaatgatgaatttgattatgaagaaggagtagagccgccagagaaagtcacaacaggtggaagaaagtttgaaaaatatgatgcatcaagcagtgaattgcttaaagatgcaagattcgaattgtggaatgaagaccgttctgaatacgcaatattttataaaggggagtcgcctttagctgtttatgaatcaggagcagatagaattgagtgggcaacaagcggacaagcaacagaatttgtcgcagatggaaatggatactttgaggttcaagggttagattatggaacctatcaaatgaaagagaccatggcgccagaaggttatgtacttccaacaggtgaggcagcctttactgaatttatcatctcttatggaagctataatgaagaaattcagatcgtaggagtagaaaatccagggccagaaagagtaccgaatatgaaacgcgggtcacttcctgctactggtgggaacgggctcttggcattcttactaatcggaataagtttgatgattggagcgtacagctggtaccgtaaatctaaaatgaagtctgaagtataagcaacaaaaataagctgcagcaatcggttttataaaggttgctgcagtttttttaaataagaaggtgaagaaaatgaaaaagaaaataggtaatagacctcaaacccaaatcagtcttttattacaattatttatggcagtgatgtttcttgccggagctgcagtttttacatatccatttttagcagatgctctcagcaattatttggatcaaagaaggatcgagaattatcaaaagcagcttgaacgcgataaagaagaaaaacatgagcaacaattagcagtgcatgaaaagaaaaatcagacgcttgctcatacatcagtaatcccaggaatgggacaagtcaaagatccttttgagcaagcggttagaaatgtccaaaatccaggaaaagaatattacgaacaacatatgatcggagccatctatattccgaaaatcaatgttagcttgcctttatttgatgaaacgaatgatcttttgttagatagaggagcgacagtcctgcaaggcacctcttttccaactggaggagagagtacacattccgtgattaccgcccatagcggtattgctgagaaaaaactctttacggatcttgaagaaatggagcaagatgaccgattctatcttgaagtgtatggtcggatgctcgcttatgaagtcgttgagaaaattgttgtccttccaacaaaaacaaatacattagcaattagagaaaagcaggatctagtcacacttatcacttgtacaccttacaccgtgaacactcaccgattactagtgacaggaagacgagttccctttacagaagaagtctcttcaaagatagaacagacaaaaaaataccatctttatcgattacttatactccttctaggtatattgctagtgctaacgcttttcggttattggtgttatcgaaaatttaaaagacaaaaacaacgaaagaaaaataacagataatagaccaattattaagaataacataataaatttaagctgcttggaagagacaaacgcgattaaatcgcatatttccagttttttttaacgtttgctaaaatgacattttccaggtaagccaacttgtttcacaagggcttctttgatattgtagtagcaagaagaaagatggagggattttttatggcaaaaatcatggtagtcgaagacgaagagatcattcgacaattgatcatggaggaacttgagaaatggcaatttgaaacctttggaacgaccgatttcaatcaagtgttctcagactttgaaagagaagaaccacagcttgtattactagatattaatcttcccgttttggatggctattattggtgtcaaaaaatacgtgaagtatcgaaagtaccgatcatttttatctccagcaggaatacgaatatggatatgatcatggctatgaacatgggggcagatgattttgtgacaaaacatttccaaatcgatgtactgattgcaaaaatcaatgcattacttcgccgttcttacaactacacagaattatctagtgaaatgatgagccacaatggcattacgttgaatgttgacaacggaagtatggaaatcaacggagagatcattgatttgagcaaaaatgaatatcgtctattatttattttgatgaagcacaatggaaagatcttaagtcgggaaaaattgctgcgagcactgtgggatgacgaacgatttgtagatgacaatacattgacagtcaacatcaatcggttacgccgaaaaatcgaacaggcaggtatccaaggatatatcgaaacaaaagtaggacagggatatatcgttccctgaaaggatgagcggttaagatgaatttttttaaatatttgaaagatcagtggacattgatcttgggatggctgttttttattgcattgacgatctttgtgatgtggctggcgccaaacatcaaagttgatttgagcacaattgcttatttagctttgattgagggcgtctttctgattttttatctgctgggtggttacttgagcaagagaagatggtggggaaaattagccgacatacaaaaaacttcccctttgcaaaattatttgagtggtgggaggacagaagaagaaaaactggtagaagaatatatcaatcagctgatccgtgaacaccaagaagtaatgcaatcagcaatcagtaatcaacaagaccaaaaagattatattgactcatgggtccatgaaatcaaagtgccactttccgcttctaaattgctagttcgttcgatcgagttcgatattgacgatcaaaagtatacattactagaaaatgaattatcaaaaatcgatgaatacgtagaacaagttttgtattatgcaagactcgacagtttctcgcgggactacctcatccaagaatatggactaaaaggaatcattcagcctgtgatacgcagtcaggcaaattattttatccaaaaaaatattcgctacgagatcgttggtgaggatcatactgttttgaccgatgctaaatggatcgcttttatcttcaaccaattgcttagtaatgccatcaaatatacgccggatcacggaaacatcattgtgagcatagaaaaggaagcgcaaggagtcagcctttcagttaaagattcagggatcggtatcccagcggaagacttgaaacggatctttgataagggatttactgggagaaatggtcgacttagcaaaacacattcaacaggattaggactttatttagcaaaaaatctggccgaaaaattaggtatccatttgacggctgaatcaactgaaggaaaagggacaacaatgactttatttttcccaatcttaaatttttataatgaaaaacgttagaaaatcgttagaaacgaaaaaaagtgcttgtgttgttaacgttttcgctgataagtttcttatcatgtgaaataaaaggagattggttatggaaattttaatagcattagtccctatgttggcatggggtagtattggtttagtaagtggtaaaattggtggcgatgccaatcaacaaacactaggaatgacgatcggtgcatttctgttttctttagttgtctttttcgttgttagtcctgtaatcaccccttggattttcttgatcggatttttatccggcttagcttggagtgttggacaaaatggacagttccatggaatgaagtacatgggtgtttctgtagggctaccattgtctactggttttcaattaattttgaatacgattgcgggagccgttttcttccatgaatggacacaaacgaaagattatgtatacggtattattgctttagctcttcttgtaagcggtgcgtatttgactgcccgacaagatgacgaaggaaaaatagatacagataataaaatgcttgattttggtaagggttttagagcattgatcttctctacgattggttatggtgtatataccatcatcgtcaactgggcgaatttggatgcgatgtcaattatcttacctcaaagtatcggaatgatcttaggcgcaagcttctttgctttccgtaaagttaaagtcgatcagtttgtgtggaaaaacatgatctgtggattattatggggcttaggaaacatctgcatgcttctaacagtcaaatcacttggtttagctgttggcttctcactttcacaaatggggatcattatctctactttaggtgggattttcatccttggcgaaagaaaaacgaaaaaagagctcatttatgttattgttggttgccttttagtcattttaggtggtatccttttagggtatatgaaaacagtttaatcgctgttttccaacctaaaatggggaggaacttcaatggatttgtttcgtaagaaagagatcaatctcaatcatacgagtgagatgaaaaaagaactaaaaacgtctgatttgatcatgcttggaattggtgcgatcatcggtacgggaatatttgtggtgacaggggttgcggccaatcaaaatgctggtccagcactgtcactttcatttgtcttagctgcaatcgttgtcattttgtctggactaagtttcgcagaatttgcttcgcgagtgccagtgattggtgggccatatgcctatctgtatgttgtatttggtgaatttgctgcctggctgacagggtggttgttgatcggggaatttttactagcggtttcctctgttgcttccggatggtctggctatatgcaaggttttttgaaaagtttaggggccgaacttccacaagcattaactggcgggtacaatccggaaaatggtacatacattgacttgattgcggtgctcgtagtgatattcgtcacttacatcgtgtcgcttgaagccaagaaagcattacgtttgaataatgccatggtatatgtcaaatttggtatcatcgcgttgtttatcattgtaggaatatttttcgttaaacctgataactggcagccattcatgccttttggtttttccggtgtgctagatggtgcagctcttgtgttttttgctttcttgggatttgatgccgttgcaatggcagccgaggaagtcaaaaacccgcaaaaagatgtgccaagaggaatcattggttcgatactgattgctactgtcctttacatcatcgtgacgctgatcttgacaggaatcgttccgtatactgaactaggagtcaatgacccagtggcttttgcaatgaggtatgtaggacatggaacagtgggcgcggtgatcgctgtaggggcaattttaacgctactgacggtaacgatctcgatgatgtattcacttgctcgtttactgtttgctgtcagcaaggatggcttacttcctaagtttatgacagaaatcgatcaaaagcatcgtacaccgaaaaaagcgacttatgccgctggtgtggcagctgtattctttgccggatttttcccattgaatgtattagcggaactaacgaatatcatggcgctcgcctatttgatgcttgttagtctaggcttactgaagttgagaaaaatgtttggcaaaccaaaagctggagaattcaaagtgccattcgttccgctattgccaatcgtctccatcttgacttgtattgtattgatgcttcgtctgcaaactgtgacatggatcgtgttcggtatcgtaatggttattggactgatcatttattttggctatggctatggacacagcaagatgaatgagaaatagactccaatggagaagttagaagaaagataagaaaaacgcccatcaacagttgtaataaactgttgttgggcgtttgttttagtaacaagcgaaaggtgatctattgggttaaatccaacagtttttgtttcagatcttcttccatgtgtccaagctctacttctgcatgacgacgtttttcttttccttctttttggatacgcaatgtctcttggattgtttcgatcaaatcattttgagtggtttgaagggtctcgatatccacgattccacgttcattttctttcgctgtttcgatggctgagattttcagcatttctgaatttttcttcaataagtcgtttgttgtttcagagacttggcgttgagcagttactgcatctttttgacgaagcaaggtcaatgcgatcacgacttggtttttccacagcggaatggctgtagcgatagatgcttggatcttttcagccaaggcctgatttgtgttttggatcaaacggatttgtggtgcttgctggatcgtgatctgtctagctaagcgaagatcatgcgtacgtttatccagacgatctaggaattgcgtgtaatcattggcaatctgaacatccatctgatcgccagtttcttctgctcttttcatcgcttctggaatgatcgttgtttgaagttcttccattttcaattctccagcagcgatataaatattcagtgcatcaaagtagtctttgtttttctggtaaagctgttctaacatcagattatcttttagcagaccgtctttttctttatctaatttcactgaaatcttgtcaatttgtgcaccaatcttttgatattttgctgtcacttcatagatcgattgtttgaccttcccgaagacacgctggaagatgttcccttctccggcacgcagttcgtcaggattggcttcttggagacgatacatcagttcagttaaggaatctcctacaggaccaatatcttgtgcttgcacatgattcaacatcgattgtgagaattcacttaattttgcttgggcagccgatccgtagctgatgacagactgtgcatcattagcatcgatttttgctgctagctgtttagcttgttcttggcgttccgccggtagtttgtcaattaaacgagcagctgtctgttgctcttggagctgatcaatctccgcttgttgtgaagtggtcagcgtatctgttggagttgaaaacgggttgttcaataaatcttcaagtgtatcgttaactggtgtaacatcttttgtttcagtcggtttatgatccataaaaaattcctccttgttgaatctgttctcgattcttacatgaatgtctctactttagaaaaagtactcgaaacagccagacatcatctgaatgttccgagtcttcttttatgaacaaaagagttaatccttttgttctggttcatatttattatcacgctttaagctctgtttcgcaacagatatctctacgtcgatatcatctagatcctcagcaacgaatttttgataatcttgtgcgattaaagctgacagctggtcgatgatctgcgcgctttcttctagtttttcataggtctgtttgtttttgatctcatggtcattgatctcattatacttatttgtcaaatcaactagattcggcagatgcgtataaagaaactgacttgcttcatgcagtcggtttggttctttcaccaattctttgaataaagctttcgctgctttgactggatcatggcggagatcgattgctttaagtttggctgtctgctgcatattcatttgcaattgattgatctcattttttgtttgattcattgtttgtcgaaaaaatgaaatttcattcgctgtcataccgcttttttcatagtgagtttcaagttcgtcagtcagtgcaggaatttcttcttgttttccctttttcctgcgcgaaccaaagagtccccacaaaactaaaactacacctatcaataaaagtcctagaacaaaagaaaaactattgtttcggacaaagagaaatagcaagaccaatgctagaagccacggccaatttcgttttatcataataaaccctccatgtcatttatcgttgagtattgaattcttttcgttattcgattacatacttattttagcatacggactactagaaagagtatcggactaaagaaggattttctatatttagagaaaatctaaggtttatctatggtaaactaataaggagtttttgagaaaaattgaaaaatgaaaaaaaagcagttatgattacaaagaaagcaggagaagatatgctgaacaatgagcaatttgaagaaaaaacaatcagtcgcaaagaaatctatagcggaaaaattattgatgttgctgtagacgaagttcgtttgccagatggaggaacttcgaagagagaactggtatttcatcctggcggtgtcgggatcattgcttttgacgaacaagatcgtctgcttcttgtcaaacaatttcgaaaacctttagaaaaagtgattttggagattccagctggaaaaatcgatccaggagaaggacaaaatcccgaaatgacagcagctagagaattagaagaagaaactggctatcgtgcgaagtcgctgagccatcttacttcgatgtatctttcaccaggttttgcaaatgaagtccttcatatttatcatgcacaaggggtagagaaggtcgagaatcctttagcacaagatgaagacgaagtactggagttgtatcatctaactcttgaagaggcgcaacaagcgatgaaagatcagttgatttgtgatgcaaagacgatttatgcgattcaatactgggaactattgaccaaaggaaagtagagggatcggcttatggccaaaggaccgcttattacgcgaagcgaacttcgcaagcgacaacaagcacaagcaagcgagtcattaaaaaaacagcgaaaagcagaaacagcttatcagcaagaagaaaaaaagattgccagcttttatcgtaaagaaagcaaaaagaataaaccaatcacgaaaacaaggatcagcgaacgggaaaagacgaccaaatggaactcttttttgatgaaatctcttattattgttatcctaatgttatgtgtggtttttttagcaatcgcatttatatagaaagaaggaattaaaaagatgaaaatcggtattatcggcgcaatggaagaagaagtaaaaattttgagagagaacctaagcgaaccattatcatgggaacgcgcaggcgctttatttatttcaggttcattaggtaaccacgaagtgatcgtcgtacgttccggtataggaaaagtcttagcatctattaccacaagtctgttgatccaacaatacggcgtgaacatggtgatcaatacaggttcagctggcggaatcggtgaaggcttacaagtaggtgacatcgttatatcagacaaagtagcttattttgatgcagatgcaacaggatttggctacaacccaggacaattaccaggaatgcctctatattatgaagcaagcacatatttgcgcagtgaaatggttaaagcagcaaaagcaacgaatttgaacgcaaaagaaggattgatcgttacaggtgatacatttgtcgactcgccagataaaatcaaagaaatcttaacgaatttccctgaagcattagcttgcgaaatggaaggagccgctgttggacaaacagctcgtcagttcaatatcccatttttgatcgtacgtgcaatgagcgacacagcagatcactcggcgacacaaagctttgacgaatttatcgaagacgcaggcaaacgatcagcagaaatggtgatcgaatttgtcaaacatctcgtataaggaggactaagatgaacgcattgatctcgattgactacacatatgattttgttgcagaggatggaaagctgactactgggacagcaggacaagtaattgaaaaaaagctgactgctcatacaaagaagtttattgatcaaaaggattttgtcgtttttgccattgatgcgcatgatccaaaagattcctttcatccggagaaccgcttatttcctccgcataatgtgataggaacgggtggacgggaattgtacggctctttaaaaagtttataccaagactatgagcaagaggaaaatgtttattggatagacaaacggcattattccgcttttagtggaacagatctagacatccgtttgcgagaacgccagatcacagatatttatttgaccggcgtatgtacagatatctgtgtgttgcatacagcagtcgatgcgtataatctaggatacaaactccatattttcaaagattccgtggcaagtttcgatcccgttggacatgaatgggcattgagacattttgagtccacactaggcgcagaaattttataaaaaaacaaagtgatttgataaaataaaaagcacaaaataataaaagaagagcataaaacaaacgactttgttttatgctcttttttatacgttattttaaaaaaacttattctttttacgttaataaatctctttattatcaacaacttaagttatattttttctttttataaaatacacttattataattttgttttttattgacagtaaaaataaattaggtaatactttaagtaaacgctttctaatttgttacgggaggaatacacttgttaaaaaaacgtataaaatacagtgcgctaatgatgaatctccttatgctcagtaccccggttttaatttctgtcgttgaagttgctgctaacgaacaacagtctgtgaacgaagaaaatgcacacgtgaacattgaagggatgtcaacaatggaggaaataccaagaactagtgaagatatggatacggaagaaggaaatgatcctatgatgaaagaatcagaaaatgaaaagacaaaaaagcaatctgaagaagcaaatgaagagtggaaaggggttgttttcggagaaagcacaagtgctagtaggtatgccattgaaccattagaagacggcgtgcggctctcttccacgaataacggcggaaaattccagtcaagcggatcagatggaatgacctattattatcaagcaatccccaaagacatcaactttaggatgcgggcgacgatcgaaatagaatcttggacctatacgaatgcccaagaaggatttgctttaatggtaagagacgcagtaccaaaaaatcatttgtttgggcaggcattttattcaaattcatttgccatactaggcagtcggatcgaatatgtctgggactcggatagacaagaagtggtcaacacgagcggcagcaaatatacgatgcgacttggattggggacacgggcaatcacaggaatatcatctgaagatccgcaagctgcgccagctcctgggagtgtctcagtggaaacaacacctttagagacttcagcagggttcttggaaaaagaaacaggttcttataatatattcggaaacggtcatgggaatctgtttccggccacgaactcgattactaaactggacgtagagatgaaaaaaacgaatactggtttagaggcatattattacgatcctgaaacaggagaagaaatggcttctgacatcatgtatgactgggaaaaattatacgcttcagatgaatcggttatttatgcaggatttgctgcagcaaggaatatgacgatcaaggtagaaggaatcgaagttgcttactcagatcctgcgacagatcctcctgggcaagaaagacctactcgcttgattgatccgatttacactgtgacctctagtaatcattcaggaaaccaagatcatactatgtcctttagagcaaatgctgacggattattgacaattaaaaataaagcaacaggagaggtgcttaagaacgcaaaaaacttggctatcactgcgaatcgggaatttgattatcagacaaaactgatggaaggaacgaacgaatttactttcagttttacgccagataaaaactatccgccagaagaatacgtagagatgactagttatgaaacaaaagagattcttcatacagtggactaccgtaaacctaaatattcgacagtttatgtaacaccagaagggtcagatgcaggaaacggaagcagacaaaatccattatctctgacacaagcattgagatacgcatatgctgggcagacaatcgtcatggcgcctggaacttattccttcgaaagaggattgacgattccaaaaggcgttaacgggacaagagaaaacccgattcagttgattgcagagaaaaatccagaaaacaagcgtcctgtacttgattttaaaggaactggaaatgggatgacactgttcagtcactactggggtttacgagggtttgacattacaaatagtgcagctatgcaaaaaggattacagatttctggaaatcataatttgatcgaagagattcatgcttatcggaatggaaatacaggaatccaaatcagcggtagctcaaatgatcctttcgaagcatggcccgcgcataacttagtcaagaactgtacatcttttgaaaatgccgatccaggatttgaagatgccgatggatttgcggccaaactgacaataggagaaggaaatgtatttgacggttgtatcgcgtatcataatgcagatgacggttgggacctttttgctaaaaatgaaacaggttcgatcggaaaagtaatcatcaaaaactcagttgcttatcgaaacggctgggtaccaggaattgagggagaaggtaacggtaatggattcaaaatgggcggttcttctttaacgggccctcatgaattgatcaatagtttgtctttcgaaaatcttgcgaaaggaatcgattccaatagcggaacagatattatcgtcaatagcagtacaagttttaataacggttcatataatgtggctctttatacctcttcagcaggaaacacagactaccatgcttctggtatcttatctttccgaacagagaatcttgagatgagagagcagatccgcccattgaatcaaaacgaagatcaaatctaccactcgttgaactactattggaatgaacgagagaaacaatcagaaaatactcttggacataccatatcaaaagattggatcgagtctctaaatacatgttcgaaagaaggtcagcagcctgttacgcgctatgaaaatggaagtatccatgttcatggactgatgcagattaaaccggggaatcgtcaaacagaaaaggaaagagtggatggtcttccattatctgtaggtgctatttttgacggagaaacctcaccgtcttcggaatatccagagtatgcaatcgtacaagaaccaaatcagacaaaaccaaatgaacaaaataatccgattattatacaagaagcaaatggtgtggcggagaatgcagaaggaaatatcattgaactgaagccttttacagtttttgtgtcaactttcacaccaaatcaaggaacgcctgtctttgaagatatgcgttatttcccagaaaagatccaaatcgttgaaacacagtcaagtgctcaattttctaatcataccgctattttttcagcaccttcaaaaggagaatatacgctagaagtcacttatcgttcggaaatatttgatggggaaaaatggtctgctcatacagaatctgttacccagcaaaaagcgatcactgtgcgagaaactgccgatgtgcccccgggaaatgacaaaccagaaagagaaaatccaggaaatgaatcaccaaatggaaaaccaaatggaaaaccttctcatccggataggacagcaaaagaaagtgaaaaaaatggcactcaaggactcccaaaaacgggagaatttaataacccgttgctagcattagctggaggaattttgttaatcggtgtagttgtttatgtcatgaaacagcgaaaaaaataagtggaatttctccttttatgatgtaaaacaattgactgaggaaagtaaaaatagaaggaaatgagaccaatagatgtctcacttccttctatctttttatagatgaggttctccttgctgcttttgattggctgttcttattacttgatgcaggacagctttttcacaatctctccactaaacggtgttcaatcagctgaccctcggtattagctcaacaaacggcaaaatatgaggaactatttttccgtttttttctctaatactcaggtcaggacgctgatttcacaacctctcgataaacggtgttcaaaagccagtttctcggtagtaagtcaaatttatgcaaaaatgtggaaagccattttcacaaaatttttcttactacttgaaactaagcagctttttcacaacctctaatacatggtattccagaagtaacttcttcgaaaaataagccgaaatgtcacaaaaatttgagaagcgattttcccaaattccttcttatttcttgaagctgaccacttctggcacaacctcttaccagattcgcactcttttttctggcgctagatacatagcgtcttgttccgtgataccaaatgtttcatagaattcgtcaaggttttttggttgcacgtttgctcggagtttagcaggggcatggacatcgatttgcagtaaaagttgttggtattctttttttgcttttgtacgccaaatcgttgcccaattgacaaagaattcctcgatagaaagatctgattccgtttttgctgcttccaatgcacagcttagaccgcctgcatcagcaatattttccgaaacggttaattttccgtttacttttccgtcagcaaaaggcagaccatcgaattcttcgatcattgcttgtgctttgttttgaaattgtgtaagatcttcttctgtccaccagttgttcaagttgccatattcgtcaaataaagcgccgttattatcaaatgcatgggaaatctcatgagcgataacagctccgattccaccataattagcagagcttgattgttctagactgtaaaatggtgcttgaaggatcgctgccggaaagacgatcacattccgaaatggatgataataagcattgaccgtgtcagcactcatttcccattctgaacgatccactggtttgttccatttgctgaaacgatcttttaatgtgagtttgctgaaaacaagagtatttgaaagcaaagtaccaccctgatctgcaggtactgttttgaactggtcgaataatgctgggatcttatcggggtagcctacttggatacctaagttatttaattttatgacggctttttcttttgttgcatccccaagccagtcattttcttctagacgttttttataaacggcgatcatttttttcaccatttgttctacgtcttttttagcagcttcgccaaaatatttttttccgtagtaatcgccaactacttgatcgaattgtccagaggcaaggtaatacgctgcttttttctgaggcattgcttcgtctgttccagacaatacgcgagaatagattccgctgacttggcggaattcttctgatagataaccactaagagaacgtactgttttaatgatcatccagcttttgaataacggaaaatgagcttctgtcaggatgtcattcaaatgatcgaagtacactggatcagttacgatcactttatctggagttgtcccaatcaaacccgtgacaagttttttcaagtccagtttatctgtgtatttaataaatgtatcaaaagattgcggattatacattttgctgtaatctgcgttttcttctgcactttttacatgaggagcaatcaatttatcaaattgcactgcttgttccgtgattgcttctgcctgacttttttctttgccggcaagctctaataactgaacagccatatcaaagaaaacgcctattagttgtgcaccgttgggatggtctgatgcataatacgtcttatctggaaggaataaagaaggcggataagcaaagaaggcgttcgtttgcgcattcttcatatctgcatctacatccagattaaatggcaatggtaatgtatccaacagccattctggaaattgcttattcaattcgtcgaaagactgcaatgattcaactttttcgattataggttgaagcggttgagcatgcaactcatttcttcggtcataatcgtttgccagttgataatatgcaaggaaatgtttcattttttctgaagacactttttctggatgggcaagcagatcgtctgtttctcccatcaaaagttggtcgatcccgtcaactaaatcttggaaaccgcctgtagctggtttatctgcagggatttttgctgttttttgccattcttcattgactgcttcatagaaatcttgtttcaatcgttctttgttcattcatcgatcgctccttttttgtttcgtgtgcccattatcttacaaaatgaaggaattaacaaatagaacataaaaaattgaaaattcgaacaatcaaactgatttgtttttttcaatccttcacttataatgaaaaaaaggaggcgatcccaactgaatcaagtagtggataaacctttatatttcaaagtagataaaaaaattaaaaaattagccagcactcagcagctgcagtcaagaaaaagtaaattgctttttttagctctggtttttgaagatcaaagttatgtgattatcgatcaatcaggacatccggtagaatattctccagcaaaatatacttatcaagagggtctttcttgtaaaaaatggaagctgatcaatgaagagccaatcgagttatctagatggatcaacagaaaagaagatattcccgttttgatcgaagaaaaaaggtcaggaaaggaactcgcaaattgctgggtgggattgccagaagaacgttttttgaggtataagaaatgggctaccccctcaggctatctttgtggtacttacgcggcagcagttctccttgcctattatcaagactatcgtaaggggtggatgcttccaaatgagattcgcaagaaaaatacggctgattcgttggttttgacgaaggcattgcgtagccagatccaaccactaggacttcctacgattccttttcaggttagtacagggatttctagttttttaaagaagaatggcaatcatgagcgtgcacgagcaactcttctaggttcatggcagcgagctacaaaacgtatacgtgaaggcaaacctgtgatgattggtattttgaaagtacttggcagtacatatggcaatcattgggtgacagcgtacgcttattttgaaactgaaacaggagaacgttattacaaagtacacgacaactggggcgattatcataaagtcattcctgccagttggagtaacggaacagtttcacttccttaagaatttgctgaaattaacagaaaatcttggaaaaatatgttaaactatcgaagaatagagaagttttggggaggactacatgagtaataagtatcaggatgacacgttgaagatttttagtttgaatggcaaccgtccattagctgaaaaaatcgcgaaagtgttcggaacagaattaggtaaaagcgtcgtgaagcaatttagtgatggcgagatttccatcaatatcgaagaaagtattcgaggggatcatgtgtatatcgttcaatcaacgaatgcacctgtcaatgattactatatggaactactgatcatgatcgatgcaatgaagcgagcaagtgcgaaaacgatcaatgtcgtattgccttactatgggtatgctaggcaagaccgcacggcgaaacctcatgaaccgatcactgcgaaattgatcgctaacttgatcgaagaagcaggggcaactcgagtactgactttagatctgcacacggttcaagtacaaggattctttgatattcctgtagataatttatttacgatgccgttgtttgctcattattaccgtcaattaggtctgacgggagatgacatcgtagttgtttcgccaaaaaacagcggtgttcagcgtgcacgtagtctttcagaatatttgaacagcacattagccatcgtagatcatgcagatgatgcttcaactgagggtggttatgtgatcggtgatgttcaaggaaagacatgtatcatggtagatgatatcttgaacacaggagcaacgcttgcacgagcagcaaatgtattaaaagaaaacggcgcaaaagaagtatatgcctgtgcgtcacatggattattgtccgatcatgcgaaaagtattttagacaatgcaccaatcaaagatatttgtatcactgattctgttttcacagaagaaaatcgtcatccagaaaacttaacaatcgttacatgttcagaattaatgggtgaagcggtcaaacgcatccatgaaaatacaccgatgagtccgttattccgtctggaagaaaaagaattcgaataaacaaaaaaaagagggaaagaagttgtgacagaagtgagcagcttcaaggagctgcgacaagacttttgtcacagctccttttttctatgcccatgaaacgtcctctagacaaaaatgagctcttctttggtttgttcgctattttatgctagaatgtgcctagcaataatttggaagggatgaatgaagtgaaaactatttatctggatcatgcggcaactacccccatgcatccacaagtaattgaagcgatgacggcaatcatgcaagacacgtttggaaatccttcaagcatacatggatttggtcgccacgcgcatgaaaaattggaaacagcaagacaaatcattgcagacagtctgcaagcaaaacctcacgagatcatctttaacagtgggggaacagaaggggataatacagctatcttagaaacagcgttctcgcgtcaaaaagaaggcagacatctaatcactacagctatcgaacatcctgctgttcttaataccatgaaatatttagagacaaaggggtttgacgttacatatctgcctgtagatgaaaaagggaatctgtcgatcgaagaggtcaaaaaagcgttacgagaagatacgatcttggtctctgtgatgtacgggaacaatgaaatcggaaatttgatgccaatcaaagaaatcggtgaacttttagcggatcatccagcttatttccatacagatgcggtacaagcgtacggaaaccaaacgatccatccagaagaattaggaatcgatttattaagtatctctgctcataaaatcaatgggccaaaaggcgtcggtttcttatataaacgagacggagtaaatatccctgcattgcttttaggcggggagcaggaagaaaagcggcgtgcaggtacagaaaatttagcagggatctggggtatggcaaaagcagttgaactgctgtcacctgaagaacgtgaagcacgtaacaacaaatataaaggattccagcaattgattcttgatacattagaagcaaacgaaatcccttatcaagtaaatggtgatttaacgaataaactccctcatgtgttgaatcttcgcttaattggcgaagcaaatgatttgctactgatgaagcttgatcttaatggggtcgctatttctactggttcagcttgtacagcaggaaatatcgagccttcacacgtattagaagcaatgtatggagaagatacaccgatactaaaagaatccatccgtatcagctttggtttgggaaataccgaagacgacatccagtatttccttgatcaattagttcgtgctgtcaaaaaataactagtgaagtcattcttatatgaacagatgtctgagagaacgccttcattttttagggaacttaactgaaaaacctagtaaaaatcaggataaacttttataataaagagaaactaattttatcgaggtgaaaatcatggcatttgaaacaacagcaacggtactgggcgcaccaattagctatcgtttgcatcctgatgcaaaaagatatacattgcgcgataatggatttacagaaacaaacggaggcaattatcaattgatccgaccattagatgccacgccgcaaagcaaagaaggattcaaattaaaaatcactgtatcaaaagatattcaaacattgaaaatgtcgatcactacagcaaatggattgaaagcagtcaatattttcaaagatccaaaacagaaaatgagccaagataaattttattttctgatggatgggatgattagccgtgggttattcgaaaaagtcgaatgatctgtggatataaaaagacaactagttttgaaacggcctattgttagatgactaactttgtaaggacgacgcaaattagttgtcttttttatttttaaatttaacacatgttgttatttttaatattttgctgatttattgtttctaagtaaagaaatttaaattgaaacgattgttatttagggaaaaaggtattttttgaaaaaagaatcccgtataatgattgttgtgcaaacgctatacaaaatgaaaaagaaaagagggatgtttatggaaaatgaacagtcggtcgttttaacgaattggaagagaaattatttgttctttttatcgggacagtttttgtcaggaatcactagtatggtcgtccaatatgcgatcatctggtatttgacaagagaaaccggttcggcgacaattttgagttttgctactttactaggaatgattcccatggttttactaagcccatttgtaggaccgctagtggatcgctgggataaaaaagctcttttgattgtcacggatattattgtagcgattttcgcgcttattttagcagtagtcggaacgatttcagaatccttcccgatttggctagtttttgtgtctttgtttatgcgttcggtcgcacaaacattccaaatgccaacgatccagtcgattatgccgacaatcgttccatcttctcacataacaaggacgaatggacagttaggaatggtccaatcagcgaatttcatcattgcgccagctctaggtgcggctttgttttcagtcgttcctgtcaattaccttattttattagatgtattgggggcagtttttggtgtcggcttattgatttttgtgaagatcccaaaagtttctcctgaaatattggaagttccgcttactatttttaaagatgcaaaatttgggctgcagcaattgatggataataaagggttatggtacataacgatcaatggtgcatttgtgatgctgttgttcatgccagcaatcagtctgtatccattgatgacgctagattactttggtggttccgttggacaggcgggagcagtggaagtagtctacgcagtcggaatgctcttaggcggtgcactgatcagttttataggaacatggaaagaccgaatgaaacctattattatagcctacatcattatgggcctgacgatcggtgcaagcggattggttccaaacgatagtcaagggttcttgtactttcttatcttgaatgcaggagcaggttgtgcaacgccatatttcaatacactgctgatggcaatgatccagcagagttatgaatcgaatgttttaggtcgtgtcttagggaacttcaactctttgatgaacctggcaggtccaattggattattatttgcaggaccattagctgatcgtttaggggtagaaaaaatgttcttgttttccggaatcgggattttattatgcggaatcgttttatttttaacgtcagctgcccgaaaatatgataaagaattacagaaaaaactggtaaaagaacaccatgagcaaaaagacgaatagtatggaatggagttgtgacagaagtcttgttacaactccatttctgatcctaatgttcctgtggcaataagcctactcaaatgaaaaatatgagtaattatctttatttgtttaatacttgatatagggcagttttttcacgacctatcgtacttcctctttgcttcatagatttctttgatttgttgctcagataacggagtgccaaatggtagtttttcctttaagagttctctttccggtgcgtctacgcctacattgacatcgttctcgataggtacgctgtaatgatggatatgtccatgaagattgcggatagtgtcgttaggcccgagcaacatcggataatgagtcaagtaatattgttgatggtcgaatttaacgatggcacctacatcataaaaataaaatttgggacttccgtcagtaagcctaggatcatttttttctaaataacggaaaaaagcgcgactgtcatggttccctttgatcaagtggattgttccttgcagttgagtgaccagttccaaaatttctgcatttgctttttcatattgcggatgcatagcaaggtcgcctagatgataaacatggtcggtttcttttattactgcattccagctagtgatcaactgttggttcatttcatccacatttgcaaagagccgcggagcaaagtcgttttttcctaataagcgttcatggaaaaagtgcatatcactgataaagtaattcatgtatcttttgcctcccttttttcttagagtaaacaaaatcacttatctgagcaactcataacatctaaaaagaaaaggttgtaaatgagacgtgcagctttaagcgataagaagcaattttgaaaaatagtttttcacaatttataaaattattccttattgccgaaaggctggccctttttatgagtatgccaattttttatatcgaatgctcaaaagatgagtgattttttggttgactatcatgtttgtgtactgaataggtccagtagaacagtatttttacgacttgataattaagggatgaaattttcagaaatatgacgtataatgtaaaatactgaaaagttgcgaccttcaactcgtagatgtttcagaatctaattgaaatgatggtgatatcatgacagacaacagcaaaacacgcgttgtcgtagggatgagcggcggtgtcgactcatctgtaacagcacttttgttaaaggaacaaggatacgacgtgatcggaatattcatgaaaaattgggatgacacggacgaaaacggtgtatgcacggccacggaagattataaggatgtagcgaaagtagctgctcaaatcgggattccttattactctgtgaattttgaaaaagaatattgggatcgtgtatttgaatatttcctagccgaataccgcgcaggacgtacacctaacccagacgtgatgtgcaacaaagaaatcaaattcaaagcattcttggattatgcaatggatcttggcgccgattatgtagctactggacattatgcgcaagtcactcgcgatgaaaacggcgtggtccacatgcttcgtggagtagacaataataaagatcaaacttacttccttagccaattatcacaagaacagctttcaaaaacgatgttccctctaggcggcatggaaaaatcagaagtacgggcaattgctgaacgcgcaggccttgcgactgctaagaaaaaagattcaacgggaatctgctttattggtgaaaagaacttcaaacaatttttgagcaactatctgccagcaaaaaaaggaaatatggtcactcttgatggtgaagtcaaaggacaacatgctggcttgatgtattatacgattggtcaacgtcaaggactagggatcggtggcggaggagattcgcaagaaccctggtttgttgtaggaaaagatctagcgacaaacacattatatgtggggcaagggttccatcatcctgcattgtatgccacaagcttggatgcaagtgaaatccactttacgacgaatgaaccaatgccaaaagaattcaagtgtacagcgaaattccgttatcgtcagcaagacgttcctgtgacagttcgcttattggatgataatcgtgcagaagtcgtattcgacgaacctgtacgtgcaatcactcctggacaagcagttgtattttatgatggaatggaatgtctgggtggtggtttgatcgaccacgcatatcaagaaacaaaagttttacaatacgtttaagcgatattaaatgaatcaaaacagctatggctaacaaaagaaacaccttttcttttggatagcatagctgtttttttgcaataaaattaatttttattcattttatacttgaaatacttgtgtaaaaagttcataatatccaataatatgaataaagttgctttttgttaagcaagagcagttgcaaaatagaagggaatcttttgcaagtgatttgttcaattttataagtgagggtgatggaaatggaaaagaaatcgacgggtattagcaaatggggactggttgctctggttgtcagttcgtcaatcggaagcggtgtgtttgggatcacaagtgatctggctagttctgcagctccagggccagcgatcctttcatggataatcgttgggattggtattttagctttggtattatcgctgaatcatttaggagaaaagcgtccagatctagatggtggtattttcggttacgcggaagcttcatttggtaaattaggtggcttcatcagtggttggggttactggttgtctgcgtggctgggaaatgttgcttttgcaacgatgctgatgagcgccatgggagaatttttcccgatattcaaaggtggacaaaatgttccttctattttatttgcaagtatttttatttggggtctgactttattagtaaacaatggagttgaaggagcgagcgtcatcaatacaatcgtgacgatctgtaaattagtgccattattcctatttttaatatttgtatttatcgcatttaaagtgaatatattcactgctgatttttggggtaacgtatctgataatctagtgaatggaacagggcagcaaggaacgatctggttgcagattaaaggttgtttgatggttatgatgtgggtctttgtagggatcgaaggcgcaagtgttttagccaaccgcgcgaagaaacgttcagaagcccagcaagcatcgatcattggtctgctttgtttattgtttatctatatccttgcttcgatcttgccatacggcgtcttatctcaagaagagttagcaactatttcacaacctgctatggcaaatattttaaaaggaatcgtgggaaattggggagcagcgctgatcaatatcggcttgattatttcgatcattggttcttggttgtcttggacgatgctcccagcagaaacaacgatgttgatggctcgagacggtctgttgccgaaaggttggggaaaaacgaataaaaaaaatgccccaacttattcgttagttgttactgcaatcttgactaatctattcttattgactttcttagttactgattatgcctatcaatttgcctattctttatgtacagcggcaattttgatttgttatctacttgtcgggatctatcaagtccagttttctttaaaagaaggaatcaaaaaacaagtagtgatcggtgggattgctgtagtttttgaattgatgggcatcattttagcaggattttcttatgtccttttatgtagtattgcctatcttcctggtttttgcttctactggatcgcttgtcgtgaaaccaaacatcaaattacgggaaaagaaaaagtaatgattgggctgatttgtgtggccgcactgctttcaatcgggttgcttgctgtaggctggatcaagatataagggggaaagaaacatgaaaatcgcaaatttcggtgtagaagaatggctaaataaatgggaaaagaaagcggtatatgatattgcacaaagctcgatcgaagcattgacattagacgaactcgttggcttagatgggactagcgtaagtaaatttttcgaaaaacgcaaaaacgaaccattggactatggctggatcgaaggatcagatgttttcaaacaagaagtcgcttctctttatcaaaccgtcgatccggaaaacatcttacaaacgaatggagcgactggtgctaatcttttagctctatacgcgttagtggaagcaggagaccatgttgtttcgatgcttcctacttatcagcaattatatgacatccccaaatctttaggtgccgctgttgactttgttcatttgaaggaagaagaagattggcagtttgatttagaacagctagaagccttagtcaaacctgaaacaaaaatcatctgtttgaatagtgcaaacaatcctacaggcacattgctagatcggaaaactttagaaaaaatcgcagaaattgctcgtacagtagatgcatatgtattgatagatgaagtatatgcgcctttaacggataaaggtgaattcttgtcgatcgtagatgtctatgaaaaaggtatagcaaccaattccctatccaaaacctactccattccaggtattcgtattggctggacagctactggacctgagttggcagaagtttttcgaaagtatcgagactacacgatgatttgcggcggagtcctgtcagatgatcttgctgtacatgcattgaagaataaagaaaaaatattggcgcgaaacaaaaagatcattacagagaaccttgtgattttaaaacaatgggtagccaatgaaccgaaagttgaacttgtcgctcccaattacgtctctacttctttcattaaattagccatcgaagaagatgaccagacattttgtatcaatttattagaagaaacaggagtactattagtaccaggaagtgcctttgatttaccgaagcatgcccgactaggttactgttgtaaaaaagaaaccttggaaaagggattattcctcttatctgagttcttgaaaaaacaggcctaaacaaaaacactgcaaggacagtctgtgacaactgttcaagcagtgtttttcatttacgcttattgtctatgagaaggagagtgccctgaagctatggagactcctgaagctttttcttctgcagtttcttgctgatggatctcttgtgtattgtgtcgtacaagcaagaagttgaccaaaacaagaagagaagtcgaaagaaagacgccgcgataaccaaatgcactggaaacactggagccgatcataggccctactacgttaccagttgcttggaaagattggttataactgaagatccgtccagcagcttgatgaggcgaatattttgtgatcaatgcttggacagcagggagcagacaagcatcagagataccaatcaaaaaacgtaaggcagctaattgccaaacattcgtgacgaatgccattgggatataaaccagaatcgcaaaacccaaaccaatcgcaagtattctttcactcccaatcttgtcacctaagcgaccaaatcttggagcggctatcaaagtggcaatcccaggtatcgaagcaatgattccgctgatcaacgtaacattcccatgtccatgcagcaattggcgaatgtacagactgatgattggactaatggaattgttggatgcttggatgatcatcgttgtgacgaacataccgatgacgacgtgtggatatttcaagtctttgaaaatctgtttggcagaaaccatgttttcttttttcactgggacaaatttttcatggacgaaaaacagactcaacaagaagacgaaaaataagatgatccctgtaatgaaaaaggtagggcgatagccaaacgctgaagcagagatcccgccaagaagcggtccaagtaatgttcctgtaacagaaccagttgctaaggttccaagaacttgaccacttttttcttttggcgtcccagttgcgacaagggcagtggcattactgatataaccagaaaaaatcccttgaagcagacgcaatgcgactaattgatacacactagtcacgcaacccatcaaagaaatgacgattgccattcctaatgaagcacgcaacagcatcaattttcttcctttttggtcggctaattttccccaccaaggagagataagcgtagtcaccaagaaagtagatgaaaaagtcaatccgctccaaaagttcaattgtgacgtactataattacctaacgtatctatgtaaagtgacataaaaggcatgactaaactaaatccgataccagccataaatgttccaaaccataagacaaacaagttttgttcccaagtttctcttttcctaaataatttttcctttattcttgcagccaattagactccttctttctgaaaattttcatctacagctctttattataaactacaatatgtagtttatcaatgaaagtctcttttttctctttctttttcgtggtaaactgaaagagtgaaggatttattttatgagaggaaacatggaaatgaaaaaaagaaatctgtctcaagagaaaatcatcgactgctttcgagaactagcagaagagatggatgttcagcaaataacctttcagcatttagccaaacgcttggatatcaaggctccctcgctgtataaccatttcaaaaatattcgtgatgtcaaaacagcgctaacagcgaaacttctgcaggaacttaatgaccagctgcgacgggctcttgtgggaaaaagtggtcaggaagcactgcagatctatgcagaaacttatcgatcctttgctttttcaaatcaagcagtgtatgagttactgatcagtgtaccgcataccaatgaagctgttttattagatggaatccatgaaacgaatcagatcattttgcagatatttgaggcttttcaattaacgaaagaagaaaaagttcatcgaagcagggaacttcgtagtatgatccacggttatctttccttacgttttttaggatactttacaaaagaaccaacaatcgatccagaagacagctatttttggatgatcaataactttatcgctactttgccttaaacaatcagattcatttgtaacaattttaagatgttcattaaatgacccttttataagagaaaattcttgcaactttcttgaaaagtgactaagatgagtctagaaaagctgaaagaaggagcacgagtatgtatcaagtaattaccatgttcggggacaatgagccttggtggttttttgaagactgggaagaagatattgaagaagaagaaacattcgagtctttcgaagaagcacgacaagcgtacgaaaaacaatggaacgaaatccatcaaaattatgaatatatcaatgcaaaaagtaactttctcagcgccttttggaatgacggagatgagcgctggtgtgaagagtgtgacgatgatttacagcaatacaagggacttgcgttgttgaaaaatcatcagcccatcacagtagaaagcagaaaggaattttatgaaacaactaattctagcggaaaaaccaagcgttgcgaaagacctaagcaaggtgcttggtgctaatcaaaagcacaaaaattattatgaaggacccaaggtgatcgttacttgggcccttggtcatttattaggattgaaaatgccggaagatctgaataaggaatggcagagctggcaaatggacacgttgccaatgatccctaaaaaactaggaatcaaaccacttcctaaaacaggacatcaattaaaagcaatcaagcagctggctcagcgaaaagatgtctcagaagcagtcattgcgacagatgccggaagagaaggggaacttgttgctcgctggatcttagagtatgtgcatttcaataaaccagtgaagcggttatggatctcttctcaaacagataaagcaatcaaaactggattcaagcaactaagacctgcgaaagaatatgatgcattgtatgaatctgctcttgcccgggcaaaagcggactggctggtaggattgaatgtgaccagagccttaactgtgaagtacgcggataatttatcagcaggccgtgtgcagacaccgacactagcattagtgagagaccaagaaaagaaaatcgagcagttccgcccacaaacgtatttcacgatcacgttgcaagctggaaaagaacaagccaaaatgcttcaaaaaaatcaatttgctttaaaaacacaagaagaagcacaaaaacttgttcaattgatcagtacaagcaaaggaactgtcacagaagtccaagaaaaattaaaaacggaatctgcgccattgccttatgatttaacagagatccaaagagaagccaatcaacgctatggctattctgcaaagaaaacattaagtcttgtacaaagtttgtatgagacccataagatcgttacttatccgcgtacagacagcaaatatctgacaaatgacatgaaaagtacgatgaaagaacgattgcaagcagtcagcgactttgctcctgaggtcaagcagtatttgaaaaacggagccatcgtccaacagacaaaagtattccaagacagtaaagtgaccgatcaccatgcacttttgccaactgaaaacagagcacgttatgaaaaattaagtaatgaagagcgaaaaatctatcaaatgattgtctctcgttttttaggactgtttgctcaaccccataaagtcagccaaacaaaagttacggttgaatttggtaaagaacgattcatttttcggcaaaatcgtgtcgtccaagcaggatggaaaggcgaaactgaaactgagacggaaacagtcaaatgggaaaaaggaatgagaatcaatcccgatttcgccatcaaaaaagaactatctgcaccgcctaaaccattgtcagaagcaagcttgcttggtcaaatggaaaaatacagtctgggaaccccagctacgcgtgcagagattatcgagaaactaatcaaatctgaactgatggaacgtacccctcaaggactgcaagtatctcctaaaggtaagcaattattagtattggtaaatccctctttagtaacaccagatttgacagaaagctgggaaaaagaccttgaagctattgctgcaggaaagaaacaagcaggaaccttcttgaatggaatcgaaaaagaaacaaaacgcttggtgaatgagatcaaatcaagcaaacaagaatatcaagatttctcgattacccaaaagaaatgcccagaatgtggggccaatctgcgcgagaaaaacacacgtgacggcaaaatctatgtctgcaccaattcagattgcaactaccgcagaagaaaagatccaaaagtctctaatcatcgatgcccgcaatgtcaccggaaaatggaaatcatcgaaggtaaaaacggtgcttatttccgttgtaaatacgatggaacgacagaaaaattgcttgataaaaaagagcagaagaagaaaatgaccaaacatgaagaacgacgcttgctgaaaaaatatgcacaagcagaagaaccagaagaaagcccattagcagcagcactaaaagcagcaatgaagaagtaataagatatgaaagaggttgtgatagaagtggtcagcttcaagaaataagaaggaatttacgaaaattgcttctcaaatttttgtgaaatttcggcttatttccgaagaagctacttctggaacaccatttattcggaaaaaaggactgtgacaagacttttgtcacagtcctttttcatttaaaaaaatgtttacttcatttgacgtatattattggtgaggcttcaattcatttggcttcactttttctgtttctcttatgatataaacaggacgctgtttcgtttctaagaagattttcccaatatatttcccgatgattccaagacataacaattggattccaccaatgaacaggaagatcgagaccatggaaggccatcctgatgtaggatcaccaaacaacaatgcccgcaaaataatgaacaaaattgcaataccagaaccgacacaagacaaagcgccgataaatgaagcaatcgttaacggtgcatccgagaagttcacgataccatcaatcgagtagttgaataatttccagaaggaccaagatgtttcgccagccacacgttcgcggttttcataagaaatatattctgttttaaatccgacccagctaaataatccttttgaaaatcggttgtattctgttaattctaggacggcatccaccatttgacgagtcatcaagcggaaatcacgagcgccatcgaccatttctgtatcgctgattttattgatcaactggtagaattttttcgcaaagaaactgcgtatcgcaggctcgccttcacgagtcgaacgccgggtgccgacacaatcgatatcagaagtagtgatccggttgatcatctcaggaagcagttcgggcggatcttgcagatcaacatccatcacggtcactaaatctcctgtagaagcttgcaatccagcgtacagagccgcttctttcccaaaatttctggaaaatgagacaaagcggacataaggataagctgaggctagcttcttgattgctgctaacgtaccgtcttttgatccgtcgtcaataaacaaatattcgaactcatgggcacctttgaatttttcaacctcatcaaaaaaaagaggaacagttttttcttcattaaaacatgggacaacaattgatactttcatcgtttctatcctttcaatcgtatgtttatatatggtttacattcaaaatttaataaaccttaaataacacctttaaaatttgattttacgtaaaagaacaggtattctttttgtaaactaacgtatttagtttaccatgtttcctcggtttatcaaacttttaagaacaatttttattagttggcaagtagttttggatagagaaaaaggaggaagttccagtctattgactaggagcaaacaaaatgaaaatacacacacctatcggctttttatggttagatgcagatgaatccggattgactgctgtatcttttcagccaatttcagaaagcgaatcagcgaatcagcgaattttaacgcgcacacaagaacagtttgaagaatattttgcgggaaaaagaaaagaatttgatgttcctttatctataaagagaggtacgccttttcagcaaaatgtctggaaagctttgtcgaccattccttatggagaaatccgaacgtataaagaagtagccgttgctgttgatagtccgaaagctgtgcgagcgattgggcaggcaaatcgaaccaatccattgccaatcgttattccttgtcatcgagtgatcgggcaaaatggaaaactgacaggatatatgggaaacgcaatagatggggttgaaatcaaacgccaattgttgttgttagaaggatatctgcaaaattaaaaacagttgtgattcggacattgttccatgcgagaatcacaactgttttttcatgttcattctaaactttgatcagccaaataaatagtaaagccatcactgtttggagaagcccgacagctaatccataagataagaagcgtgtaccttctttcatgaattttgcaaagtctaaacgcagaccaattgccgctaaagcagtgatctcaaaccagctgctgataaaatgtgccgattggtcaataactacaggtaaagaaaacaagctgttgaccaaacaaaagatcacaaaccctaatacataccaaggaagcggtaattttcgttttttctgcgtatcagttggcgtttcaaacagagctggttgtttcttgtgcatgaatttttcaaacagatagacaacaacaacgagcatcataatacgtagaatcttaaatagcatggcgaattcgacaacagaattgtcaagtaagcttgccccagcgactacttgaccaacagattggagtgtaccacccaaaagtgcacttttttcaatgagatttccaccaaacaactgtaatccaagaaaagggagagtcaacatcatcacagtacccagtagattgactagtgtgatgatctgtcctttttcttcctctttcgcatggatggaaggggcgattgaagcaatagcagaagaaccacaaacagcgtttcctccagccatcatcaaagaagaagtatcgctgaattgcagttttttaccaatcaagtaagcaccgatgatagtgactgacatttgcagtaacacaaaaacaattccttttacaccaatttgagcaatcgtttgagctgtgacagttgcacctagtaaaaaaacagagaattctaatagtttgctttcagcaaattttgtgccgattgctagaacaggctgtttaaaaaaagtatttcctaataaaatacccaataaaatagcaatagtcgctccacctaactgtggcagataaatagcaagaagcctgctgaaggcagcgatggcaaaagaaagcagtaaaccgggtaagatttcgcggaccgctgaatcctttacagattttattggatgtgacaatgatttcatttgatcggttcctttcgtcaataaatactaaaagcatactcgaacatagtagcactaaaccagtattttgacaaaagaacaagaggtcgtgacaaaagtcttgtacgacctcttgtttcgaataaacggtgttccagaagtagcttctacggaaataagccgaaatttcacaaaaatttgagaagcaattttcgtaaattccttcttatttcttgaagctgaccacttcttttacgacctcttggtaaacggtgttcaaaagcttgcatctgcggtaataagcccaaccagtacaaaaacatgaacagctgtttttgtttggccgttcttattacttgatgcagaacagctttttcacaacctattgaatcgattattaagcgatttttttagaaacaaattttccatgtttgctatgttctttaattaagaaacgtacgtaatgagcaagaacgtagaagacaactacacttgcaaacagacattccgcaacttttaagaaatccaatacgctactatagatacctaaactgttgaagtaatgaacagtagtaaatatagctgttgcagagataacaagcgggaatgtaaaggctgcatagcttggataaaaacgaagcttgaacaaacgtggaagcatagacagcacaacgaaatacaatacttgagataaagcgaacaatgctacgacaagataaaaattaggttcagcaaagtttttaagataacctgttaggcaaagagaaccaggtgctgcaacgatcgtaatcagcggacgtgtcggatgagccatatttcttacgaaaaagacacgtttgatgatgatcggcaataagaacgcatagcagatcaatgaaatccaaaagaaaatttttccaataagtgggaagaagttcccggcagttacagtgatgaccccaaatccaacgtaaatgataaaccagcttggataaattgcttcaattgaaagatcagctttgataacatggtgataattgaaataaaagacaaggatcacttggaagataacagcgcacagccaaatgaatttgacaattggtgcaatactttcatatgaaacaaaataagtacaaataaccatgagtgacatcgtaaaagttggtgaaacggaggcgatgattggatcatgcaacgtttgtttcgtgtgttcgaataagataaacaatttaacaaaaatgaatatcataagaatcatagagataccgccagttagattgcctaaagcaacatggtgatagtctttaaacagatttccaagggaagctaacccaaggatcaacccgcagatcgggatcggaataattttcaaaaagttcttcatatataatattctcctttttatttaatagattttagtaccaagatgaacgaatacattgtaaaatgaataggaatgtatgattacgagcaagcagacagctgattgtcttcatctaagttactagttggatcagcaactgttttgttgtacatttctattatagatggttttttgtatatttaaatcaaatagtttttatagtaattatcataaaaagttatggaagtggtgccatgtttaagttattaacgacttttcgagcagtatatgaaacaagaaatttttccagagcagcagaagtactgtttttatctcaaccagcagtctcgaatcaaatcaaacagttggagcgggaattgaatatcgatctttttcaacgtaacggaagaaaagagatgcttccaactaagcaagccgacttattatatgaacggacactggttttgttagaagaatgggaagaaactcagcaaaaattgctcaatgaacaaaatgaagaagaagtatgtcggatcgttgcttcccacacctttgctgtctatcttttgcctcagttgatgaaacatctgatcaaaaggtttcctaaagtgcattttgagatcgaaatcacgaattctcatgaatcattagaacaagtagcgaaacatgaatccgattttggttttatcgaaaagccattagagacttccggcgtacaaagatactctttgatggaagaccagctagtcatcgctggggacccaaaaagcaaattgtggcttgtaagagaagcaaactctggtgtttttcattacacgcagcgttattttgaagagatgaatatccaagataagaagatgatcgtgaaaagtaacgatgtaattgttgcgttgctgaaggaaggaatcggtcgctcgattttgtctaagcgctctgttccagaaaatgtgccaatgactccgttgaatttccatcgatatttttatttcatccaacgaaccaatctggtttctgatcagctgctagagattgccgaagagatccttcgatacaatgaaagcacagaaacttctcacagcgaggagaatctcagctggtagataattgcatgtatcaaaaaaagttctatgatacactaaagataagcagtaggcttttgtactgcatttgctcaagcaactgcacaaacggaaagttaatttttcccaaatgtctatggaaagactttccattatctaactggaccgctataataatcagcagtatggtttttaagaaaagggatgaaacatggaaaaaaaattaaaagcttcgaacgataatcgtattgattatggcgtgattttaccagtctttctgttatgtttgattggtctgctctcattatatgtagcacttagccatgatccgaacaatccagcagtcttgaaaggcgtagggatgcaagttgtctggtatttagttggagcggcagcaatcgttgtcatcatgcatttgaattccaaatggatctggaaactgactccttacctttatggtttggggttagtggtaatgggactcttgctcaaattctatgatcagaatttagctgcttcaacagggtctaaaaactggtttcgattcggtgcgtttactttccagccagcagagttgatgaagattgcgtacatcttgatgatggcactgatcgtaactaaacataatacgcaagtaaaagaacggacgatgaaatcggacttttggctgattgggaagctcttgatcgtgacaataccggttttagcattgatcatggcccaagatgactttggaacgatgcttgtctttcttgcgatctttggcgggattttcctgatgtctggaatctcttggcgcatcatcgcacctgtagtaatcttggcagtagtcgttggagcaggaacgatcttcttggttacgactgaaggcggaagagacttgctttataaagttggattcaaatcttatcagtttgcacgtattgattcatggctggaccctttccatgatacgtcaggaatgagttatcagccggcccaaggacttttggcaattggtaccggtggcttgtttggtaaaggattcaacgtaagcaatatctatgtgcctgttcgtgagtccgatatgatttttaccgttatcggtgaaaacttcggctttatcggtggtgcattcgtcattttcttgtattttattttaatctatcgtatgattcgggtgtgtttcgatacgaataatgaattttacgcctatatcgcaagcggtttgatcatgatgctgctgttccatgtctttgagaatattggagcaaatatcggattacttcctttaacagggatcccattgcctttcattagtcagggaggatcctcgattttagggaacatgatcggtatcgggttgatattatcgatgagataccaaaatgaagcacctgcaagatcttcaaggaggtaagaaaattgtacaccttttactggtacccgaaatgttcaacatgcaaaaaagccaaagcgtggttagaccagcatggcgttagttatcaaaccgttgatatgatcaaagaagtaccgaaggcctcaacgattgagacttggctagaaacgagtcaagtaccaatccgtcgcctgttcaacacaagcgggatgaaatatcgggaacttggactgaaagatcaagtaggcgagtttacggcttcaaaagcgagccaagtcttatcgacagatggtatgctgatcaagcgaccactgatcttacgagaggaccagcttgttgcaattggattcaatgaaaaaatttatgaaggagaactgatataaaatggcaggcaagcatttgaagaaaaaggacaacctttggatcttatttaatggaaaagaatactgtgttggtttgacaaatgaagcgcaagaagaacttggagacatcacgtttgccaatctgccaaaagcaggacaatcgctaaaaaaagatgaacctctgatcgaagttgaagcggaaaaagcggtcaatgaatttgccagcccgctaacgggtacagtttcttctgttaatgataaaatcggtgaagatatcaatatcttgaatgattcagatgaaatgaatgcgtggatcttaagtttcaaagatgttgatccaaaagaatttgacgaattataaaatcagaaaatcacttgaaaaaagttgacactgattcttccagttgctataatcataagcaatcctatatgaaacgagaaagctttgaaaagaagagtacatgtcacggacgtttgaagagagccctgtttgctgaaaatgggtaacgaaaatgagatggaagatggtcttagagcagagtaagcgagcgtaagcaaacttactacgggagtgcccgttacagcgcgacagtatacggaaagaagctaagtccaagtactggaagaggctgttattgcgaagtaacggtaaatcaaggtggtaacacggaagttcaagctttcgtccttttgcttaaggcaagagggcgaaggcttttttgtttgaaaaattataagagaaagatgtgaatggcatgtcattaatccaactaacgaatgtcaaaaagacattcaatgggaaaaacggaaacatccaagccgtcaatgacgtttcactaaacgttgaaaaaggggatatttatggaatcgtcggctattctggcgcaggaaaaagtacattagtccgtctcctgaatggacttgagcttcccacgagcggcgaagtgatcgtaaacgatcaagatattacaaaattaaaaaacaaagaattacgtacattccgaaagaaaatcggtatgatcttccagcatttcaacctgttatggtcaagaactgtacttgaaaatatccagctgccgctggaattagctggcgtaccaaagagcaaacgtaaagaacgggcagaagaactgttgcgtttagtcgggttagaaggacgcggacaagcatatccttcacaactttccggcggacagaaacaacgcgtcggtatcgcacgagcattggcaaatgatcctgagatcctgctttgtgatgaggctactagcgcattggacccgcaaacaacagaagaagtattagacttattgttagcgatcaataagaaattgaatttgaccatcgtcttgatcacacatgaaatgaatgtgatccgcaaaatctgcaacaaagtcgctgtgatggagttggggaaagtcgtagaagaaggagacgtattgactgtcttcagacaaccgaaaaaagaagtaaccaaacgctttgtacaacaagacatcgaaccagaagctgattcgacagaactattagctgaactcatcaaagaacatccaagcggccgtttggcaacttttgacctttagcgaaagaaatgccaacgagccagtcatttcccaagtgattcgcacgctcataacatcgatgtcaacgttgtgtatggaaagatcaaacaagtgaaagaaggttcctttggttcattgactgtcttgatgactggtgaaaccaaagaattagatcaagcagaagtgttcatcaaagaacaaggagtaggaattgaggtgatccatcgtggataaaagcttttcagaaacatatctagattttaaacaaatcaacccggaaacgatgaatcaggctatccttgatacactatatatgacattaatctcaatggtcttagtgacgatcatcggattagttttgggattgatcctttactctattggacgcaaaaacaaaccgtatgctcgaatcatttatggaatcgtatcgatcatcagtaatattttccggtcaacgccatttatgatcctgatggttttgatcattccatttactaaagcaatcgtaggcactatgctaggtgcgcaagcagccattccagctcttgttttatccgcagcaccattttatgcccgtctagtagagattgcttttcgtgaagtcagccctggtgtactggaagcagcagatgcaatgggagcaagttactgggaaatcatctggaaggtcttgatacctgaaagtattcccgcattgatttctggattaacagttacaacgatctcgatgatcggatttactgcgatggccggcgcgatcggcgcaggtggacttggaggtcttgcttggcaggaaggctaccagcgtggtaatctaacagtgacattcgttgcgactttaattattttactaatcgtatttatcgttcaaggaatcggtgatttcttaactaagaaaacagacaaaagataataggatatagggggatgtaggatatgaaaaagaaaatttttggatttgcagcagcgcttttgctgactgtaggattagcagcatgcggtaacaacagcgacagcaaagattcagcaaataaagcagacgacacgacattgaaagtcggcgcttcaccgacaccgcacgcagagattttggaacatgtgaaaccattattgaaagatgaaggaatcgatcttgaaatcgtcaaattcgatgactatgtattaccgaaccaatctttggaagaaggcgacattgatgccaattacttccagcatattccttatttgaacaaagaaatcaaagaaaaaggatatgactttgtcaatgccggtgctgtccacatcgaaccaatgggcttgtactctaaaaaagtcaaagatgtttccgaattaaaagatggtgcaacaatcattacttcaaattctgaatcagactggggacgcatcatcacaattctacaagatgctggcttagtcaaagtcaaagatggagtagatctggaaacagcaacattcgatgatattgaagaaaaccctaagaacttgaagttcaaccatacgatcgacccatcacttttagcttctacgtaccaaaatgatgaaggtgacctagttgcaatcaacgcaaacttcgcttacggcgcagggttgaatccattagaagatgccgtattgcttgaaaaggacaactctccttacgtgaatattattgcgactcgtaaaggtgatgaagacagtgacaaaatcaaaaaactgattgaagtgcttcaccgcaaagaagtccaagaatggatcacagacaaatggggcggctctgttaaaccagtaaaggctgatgcaaaataaggtatggaacaaaaaagatgagaaataagtctgtaatggcttatttctcatcttttttatacctattctaatttagaaatcaaaattgtttaataataaataaaagatatttgattttagtaaggaaggtcattgcgcttcattctcaattagtctaaaatgagtgagaacgaaagagaatttgggggtataatgcatgtctgtcttagaaataaaaaatctacatgtgtcgatcgaggaaaaagaaatccttaaaggcgtaaacctaacaatgaaaaccggagaaatccatgccatcatgggacctaacggcacaggaaaatctaccttatctgccgctatcatgggcaatccaaactatgaagtaacagaaggcgaaattttgtttgacgggaaaaatgttttagacttggaagtagatgaacgtgcgcgacttggcttatttttagctatgcaatatccaagtgagataccaggtatcacgaatgcggaattcatgcgtgcagcgatcaatgcgaaacgtgatgaaaacgacaaaatttctgttatggcatttttgaaaaagttagatgaaaaaatggctttactaaatatgccagaagaaatggctgaacgttatctgaacgaaggtttttctggcggagaaaagaaacggaatgagatcctgcaattgttgatgttagaacctacatttgcaattttagacgaaatcgattcaggtctggatatcgatgctttgaaagtcgttgctaaaggagtaaatgaaatgcgcggagacaatttcggtgcattgatcatcacccactatcaacgattattgaactatatcacacctgatgtcgttcacatcatgatggaaggccgagtagtcatgacagggaatgctgacctagctaaacgtctggaagcagaaggctacgctggtatcagtaaagaattaggaatcgactataaagaagaagaagcgtaagggggagcaagaatgaaagaaaaaaactggctcgattatcttgacgcggtaaatgatttttctttaagtaaaggcgaacctgattggatgagaaccttccgtcaagacgcactagcgaaagcagatgaactgccattgccgcatatcgatcgggtgaaattccatcgctggtcgttatttgatgtgaaagaaacacaaaccatcagtgaaacaggcacgattccggcatttgatgcaatgaaagacaatcctgtgcttgtccaacaaggttcatggacgatttttgaacaactgcctgtggaattagcagaaaaaggagtcatttttaccgacttgttcactgcaatgatcgaatatccagaactagtccaagaatattatatgaaaaaagcagtaaacatgaacgaagaccaattgactgcactccatgtagcttttatgaacagcggtattttcctgtatgtgcctaaaaatgtcgtgatcgatgaaccactcgagtccttattcattcaagatggcgcatccgatgagcacttcttcaagcatgtgttgatcgtggcagatgaacatagtgaattttcttatctggaacgtttccagacaaccaaagaacaagtagcaaaatcatcaggtaatatcatcgtggaagtcatcgctaaagctggttcaaaaatcaaatattcagccgtagatcaattaggagaaaatattacttcttatatgaatcgccgtgggcacattttacgagatgcttctgtcgactgggcaattggtgtcatgaatgacggtcatgtgatcgctgactttgactcagatttagcaggagaaggtgcacacgcagaagtcaaaatcgtggcaatcagctcgggcagacaaatccaaggaatcgatacacgagtaaccaataaagcccctcatacgatcgggcatattttgcaacacggagtgatccgagaaaaaggaacattgacctttaatggtatcggccacatcttgaaaggggcaaaaggtgcagatgcccaacaagaaagtcgtgtcttgatgctttctgataaagcacgtggtgatgcgaatcctattcttttgatcgatgaaaacgaagtaactgctggacatgctgccagtgtaggacgagttgatccagaagaaatgtactatctgatgagtagaggattgcataaagaagaagcagagcgcttagtgattcgaggattcctcggttctgtcttaacagcaatccctgtagaacaagttcggaaagaattagtcgaagtaatcgaagggaagttgaatggatgatcgatgctaaaaagctacgcaatgattttcctatcttatttcaagacgtcaatgatgaacctttagtttatctggataatgcagcgacgacccaaaagccaaaacaagtactccaggcattagcgtactattacgaacacgataacgccaatgttcatcgcggtgtccatacgttagcagaacgcgcgacccatgattatgaacaagcaagagaaaaagtacgggcgttcatccatgcaaaagaaacagcagaagtgctgtttactcgtggtacgacgacaagcttgaattgggtagccagaaccttcggcgaccgctatatcaaagcaggagacgagatagtgctctcttacatggaacatcattctaatgttatcccgtggcagcagttggcaaaacgaacaggtgctgtcttgaaatatatcgaactaacagaagaaggcttcctggatatggaggatgcagcgaaaaagattacggacaaaaccaaaatcgtctccattgctcatgtatccaatgtcttaggtgtcttcaatcctgttcaagaattagctgaacttgtccatgaaaacggcggggtcatcgtagtagatggtgctcaatctgccccgcacatggccattgatgtccaagcactagactgtgatttctttgctttcagcggacacaaaatgtgcggaccaacaggtattggtgttttatatggtaaacgaaaatggttagaagaaatggaacctgttgaatttggtggcgaaatgatcgattttgtcgaattatacgacagtacatggaaagaactaccttggaaattcgaagcagggacaccaaatatcgccggcgctatcgcattaggccatgcaatcgattatttgcaaaaactcggtatggacaatatccatcgatatgaagaagaactagccgcttatgtgttgccaaaattacaagcaattgatggattgactgtttatggtccacaagacccgaattttcggacaggagtcgttgcattcaatttggatgggttacatccccatgatgtcgcgacagctttagacatggaaggggtagccgtcagagcaggtcatcattgtgcgcaaccgctattgaagtaccttgaagtatcagcgactgctcgcgcgagcttttatttctacaacacaacgcaagacgccgaccgtttagttgaagcaatcatggcaacaaaggagtttttccaacatgggactatctaaattagacaatttataccgtcaagtgatcttggatcattcttcccatccgcatcatcgtggaagcttgactgactcgacaagcaagatcgaattgaacaaccccacatgtggagatgtgatcgaattgcaagtcgatgtaaaagacggaatcatcaaaaatatcgcctttgacggcagtggctgctccatcagtacggcaagtgcctcgatgatgacagacgccgtcatcggaaaatcaatagaagaagcagaacatttaactgtagactttctacagcttgtccaaggaaaagaagtcaaagatcccgaccaattaggcgatgctgctatgcttggtggtgtagctaaatttcccgctcggatcaaatgtgcgacacttgcctggaaagcactaggaaaagcaatggaaaacgatggtaccgcagctttccatcattaccacaaggaagaggagtgagaacatgggcgtaccagaattagaagaatataaattcgggtttcacgatgatgtcgaaccggttttcagtacaggagaaggcttgacagaagaagtgatccgtgagatgtcaagaatcaaaggcgaaccagaatggatgcttgaattccgtctgaaatctctagaaacatttaacaaaatgccaatgcaaacatggggccccgacctttcagacatcgatttcgatgccatcaaatattaccaaaaaccaagtgacaaacccgctcgtgactgggaagacgtaccagaaaaaatcaaagatacatttgaaaagattggtataccagaagctgaacgagcttatctagccggtgcttccgcacaatatgaatcagaagtcgtgtaccataatatgaaagatgaattcgaaaagttaggaatcgtctttactgacactgactctgctttgaaagaataccctgaattattcaaagagtacttttcaaaacttgtaccgccaaccgacaacaaattagcagcgctgaattcagccgtatggtcaggtgggacctttatttacgtgccaaaaggcgtcaaagtcgatgttccattacaaacgtacttccggatcaatgcggaaaacacggggcaattcgaacgtacgctgatcattgttgacgaaggagcaagcatccactatgtcgaaggttgtacggcacctacttattcaagtaacagcctgcatgccgccatcgtagaaatctttacaagaaaagatgcgtattgccgttacacaacgatccaaaactggtcagacaatgtgtacaacttagtaaccaaacgagcaaaagcatacgaaggcgcaaccgttgaatggatcgacggaaacctaggtgcaaaaacaacgatgaaatacccaagtgtttacttagatggaaaaggtgcacgaggcaccatgctctccatcgcctttgcaggagcaaaccaaatccaagatacgggtgcaaaaatgatccacaatgcaccaaatacatctagctctatcgtctctaaatcaatttcaaaagacggcggagaagtaaactatcgaggacaagtaacctttgccaaaaacagtgcgggttcgatctctcatatcgaatgtgacacgatcatcatggacgaatggtcgaaatccgatacgatcccattcaatgagatccacaacagccaagtctctttagaacacgaagccaaagtctcaaaaatctcagaagaacaactctactatctgatgagccgaggcctgaccgaatctgaagcaactgaaatgatcgtcatgggctttgttgaaccattcaccaaagaacttccaatggaatatgcagtcgaactcaatcgattgatcagttatgagatggaagggtctgtaggttaataactatttcattgctcgaaacgttgatattaaagcgtttcgagcgtttttttatttgtattttaatggttggctacgtttttggctacgtttggaattattcgcccataaattttgcaaatcggtcaccagttttcttaacagattgtggtgtgacatgagcatagatattcatggtagttttaatatctttatgacctaatcgttcctgtacttcttttatcgacgcaccactttcaaacaataagctacagtgggtatgcctaaatccatgtggagtaatttgaggctccatcggtgtctttttgtaaatccagtctaaccaatcgtttactacttgggggtagtacaacttgtttgtgtttgtagtgaaaagaaactgttttggtgaattcgtgttatagccatataagatcattattttcatttgttcttgttgccaaatacgcagttgtttaagtgtaaaatcatcaagctgaatcgttcttgatgaatttttagttttaggtacttgtagaactacttgattaaactcgtcttgagcgatagttttaccaattgttattgttttattgaaatagtctatatcttcccattgaagcgccaatgcttcgcttttacgcattcctgtataagctaataaacggaaaaaagtgtacagtttaactgaattattttctttagtattctgtaaaaacagttgtaattgatctttcgtgtaaaacttcaagggttgttcttcttcaatttttcttggaagcaatgttttagacataggattatccttacagacttccattgctactccaaatttaaatatttgagcagttgtttttctcaagaaaccatattgttttaatgttttgtgccattcattcacctgtttttggcaatagctaacacttattttatccaatcgtaattccccaaaagcaggtaatatatggtttttgcaaaaacgttgagcaacggcaacagaagacggttttactcttgttctgtagttatcaatccataattcatacaactcttgaaaagttgtaacattgattttaaactcttgtttttctttaaagtctacaagtagtctattaagtgctgtttgcgcctcagcttttgatttgaatcttctacgctttgtacgtatatcttttccagtcttgggatctttccctaaataagtttcaaatccccaatatttttcgccattttgtaatttataactaaaaaatgttgccatttgattctctccttacttcattattgcaggtagagaagttatttgaagaatcaattatttttaaatttatcgtgattatcagttaaaaattttgcgattatactatttttctcatatgggaaattgtattttttactaagatctgaaataaatttttctgtttcaaattggtttttagtaattttataaaagaaatcctcgacagatgaatactttgaaatatctttataggctaagtccatttcgtctaatagctgttttaaagaatcaatcattctttctttttcaccgtatttgaaatcaccatttcttatcttgtcttgaagtttactgttggctcttttgaaaaatagctctttagagatagagtgtctttggttagcgtactcttcaatcagaggattgatattattagcaagtatctcatttagataaatttcaaaatcttttgagtaatattttgtaaatatattttttattataggattcaataactcatagtctttatctagcgaaaacgtatcactatatctttcttgaatgtctttaaagactttgtgaggtatttctgggaagtccttaatatatagctcataccctatatcgataaggtatgaagttatatattcttctaaagttccccatttaatccagtcaattgttgaattagtgatagttgataataatttcagcttttgtggatttggtaaattggtcccacgttcccagttggatatggtcgcacgtggtgaattatctattttccttccaagttcttccatagtaaaaccacatgaaaggcgtaattgtttgattcgttttcctgcttctgaaggatttggcttcatcttttttctcctttttatttttaaagatagtatatcatatttataaaataaaagtatttaaaagtatttactttttatctggagtatgatactttattcttataaatacaaataaatacatttttttacgcaatttgtatttatttgtacttataaaggtagaggagttatagaataattaattaaaaaggagaggtttttgtggaagcaataaaattaatgatttcagaagaacaggaggaaatgtttctaaagcagttttatcaaattgctacaaaagctattgaaaaggctcaagaaaatgcggggatgacaagggaatatctcaatcaaaaagaaatggcggaatacttaaatgtgagtgaaaactttttaaaaaatgctgtgagaaatgagggattgcccgtagttgaattaggggcaagaaaattttattcgaaaaaggcagttaatgagtttatgtttgctcgaatgaaaagaggggaaaatattggaagatgatgaagtagaaattataaaaaaatgctttaaaaaaagaaaaaaagtgttcccaaaagtttgcagactgggggaacactcaataataaagtgctgagaaaactttatttatagctattatatcaaaaaagaaggtgaaaaggtgttttcttctggaaatgttgtagttgacaaacttagagaaataaattttgacggaaatgtaatccacacacatggtacgatcaattaagaaaaaaaacgaaaaaaggtgttgagaagccctatttgaatgcaatagttatcttagcagaaattacctattggtatagacctaaaaaaatttttaacgatgatggtcagctacttggttatcaaaaaaagtttcttgaagatattttgcaaaaatcatataagcaattaagcaaaaaaacaggattatcagaacgagctataaaagatgcaattgtgtacttagagaaaaaggggattatcaaaagggtttttagaaatatttattatgagaaaagagcagttacattatcaaatgttatgtacattgttttaaatgtacataaattgatagaaattacttttcctactttggattgcgaaaaaaaggagtatatgccgaaaattcgtcagaggggtatcgaaaaaaagagatatgtctctttaaaaaaaggtagaggtatgtacaaatttgtatatacgtatacaaagactacttcacagaacatatcaaagactactctcgttatggaagaagaggatattaatataaagaggatttacagtaagattagtgttctttatgacgcaaataacgaagatggtcgaaaattatttcaagtgtatcactatttgagaaacgctaatgtagatacagaagatatcagaaaaatcattgaatatttatctgaaaatactcagtatcttattgctgagtgtattataaaacaacatgaagcatgcttttttcaaagaaaaactgaagaagggttatacgattatgtaacatattttttgaatggacttcagaaaagatataaaagtcaatttttagaaaatgtagagcctatagatcagttcaaaaaagctttcgaaatcaaagagttacctgaaattactatgcataattggttgaaaggagaagaatcatgattaaaaatcgcttaatagatcaaatgtggtgtcttgatcaaaatacagatactctcgaattaatcgagagtatctgcttcaacacagtagttctcgatttaagagctgaaaatgacaattgtgtaactcatatcataattaatcaaaaaatggctcagcagctctctgagagcctaagaaaatgggctgaaggagaaaactatgaaagcaattaaagaaaaaatcgttagtagaaaaataaactggttagcactcagtgtacttgttttaatgattagcgttgtttttacaagtaatattgttgaagctagcattttcaattggtttgatgacacaaaaagtcaaacagagtttttgaataattctctttatagaccttacctaaaaaaatacaatggagatttccttagtcagttcgggatttggcttggatgggctgtggtaaaaggcatgtttactgtgactgattcgattcaaaatatgattccagatgtgttggatttgttcaatttcattgaaagtacagggctaaataatgtttatcaatcagtcataaatacaattgtcgttggattaatgatcctttcattgatgtttgttggctacaagatgattactggaaaaggaacaatagatttaagatctgttggaatgaatatagtgatgtctgtagcgttaattcttttaatgccaacaatgatttctagcggtattcaatttgccaaaatattttacaatgatgctactacgattacaaattcagatgacggagtcgcttggtcattgataaaacaaggagtaacagatctggcatatattaataaaacagatcaatactcaagcattgataaaacggaggatcgaaataagttaacacgaaaaaattttcaacagacagatttaacacaagtgttgacggataaagtgattgataaattggaaaaagaaaatccagctgcggataatcttcgctatgaattagttgaaaattctaataatgaatttgttgccacaaagttttctgataacttcttatcaacattttctgatagcttgaaatcaggttattatcgatatcaagcaaatctttgggggatttcgattgggttgacagcgttggcaatcgcctatgtgttcagcgcgtttgtgatcattacagcaatattagaacttgcatttaaacgtgtgttaggtgttcttgtttttgcgacagatattgaaacaggacaacgttcaaaagttgttttatccgatattttacaatgttacttaacagttggatttcaagggtttggactatctatgtttgctatgtttatcaattttttaaatgctggacaaggtatctccacaaatatttttataaaaacaattgcttatatctgtgctgtgtttgtgctgataaaaggcagtggaacagtcatgagatactttggtgttgatattggactcaaagaaggctatgggcaacttgcttctgcttttggtatgggcgcaatgctgtttagaaaaggatcaactggatttaatcgtgctaaaggaagcggaaatggaaatggatcagacagtggagaaggagaagatcgaaaaccagaaaagaatttcggcgaaactctatcaaaaaaagctggcaaaactggaagagctttgggatatgcccatgaacgtggattatcaggtttagcttcagatggagctacaatggctagtgaaagagcaataaaaccatttaagagtatgcgtgatatggctaatgataccaagaataagttcaaagaaggtttagatgatggtacagtgtccgctattaataaaaatagcaaacctatgttagctaaaaataaagaagatgaaactggaaaatatgctgattccatgccaacacgtctttcggatagaaaagatggtgctaaggttgaaaatgccgatagaattatgtctagttctgaacgtatgcgtgaagcaatgaaaaataatgctgaatcgaataataatcctgtaagtgcaattcagcaaaaagttcaacaagatattgaagaacgtaaaaatgctatgcacggtcaagctaagtctgctgaagaattaattaatcagaagcgacaagaagctaaatacacgcctgaagcaatgaatcgtgaggaaatgttaaggaaacgtgtagaagggcgtacaggagctaatacggacgaaaaagaagcgttgaccaaagaaagaatccaagaagctaaaaactcaaataccggattagaaaaattggtcaaagaaaatctacaaaattctacaagtagtcaaggtggccgatcagtagatgtccgagaaaatattcaaggttcattgaatggtcatgtcggacggaatgttgatgtaagagagaatttacaaagctcttcaaatggtcaaggtactaagacaattgatgttcgagaaaatgtacaaaattctacaagtagtcaagggtttaaatcaatggatgtaagagagaatgtacaaaattctacaagtagtcaagggtttaaatcaatggatgtaagagagaatgtacaaaaagatagtggagaaatgaaagaaaaaacacaaaaaatcaatatcgttgaagacagaaagtcagcgaaaaaatttgattcaaatcatgaaacagtgattattgatagtgaaatccgtgaaaatgataagggatcaaaaccaagacgaagatttacctatgaagacaacgagttattcagagatacacttaatgatcctaatccgcttttcgataatctattaaaaaaataaaagggggaattgtcatgaaattaattctaaagattagtacgcatgatttcttagaacttgacgaattatgtgaatcagtaaagaacgcaacaaatgaaaaaatcacggtcactaattatattgaactgatgattcaagaagaattaaagatgaaacatgagataaaaaacaacttgaaatattgttatctagaaaaaagtgaagagataatccatgaattaaatggcttttaaaaattgtatttgacatgaatttacgacaaggaattagtggggattaagcgattattctcttccactttagagaaataatgggttaaaaagccagaatacgtagagcaatattgacaacctataaaggagctattgttgaaaattgaagtaacaaaaagataaagagaggtttacatctatcagattaaaagtgatagtacacccatgaaacctgcaaaagagttgaacctaatgtatatcggtttaactctttttatttgcaaattaaaaaaatatcaccgaagtgacgaatgaaactatgaccaaattaagcaagaaaatatatcttgcaaataaagtagtataaaaagatattgataaagccaatcaaaactttgaatttcaaacgttagataatcaaacagatacaaaaaatgaaatcagttctacgcgtacgattattaaaaataataaattttcactagaagaaaatggaaataaaatcaaataattaggaagaaaaaacaaagcaattagaaaagcctgcaagcaaatttgagtaatcgagatccaatttttttaaggaagtttaacaaaaatatgtaattctattatcactattaaagagaaagttggagcggaatataaagaaaagagaaaagtaattaaacgcaaaaaaatgtagaacttaaaaaatataaagaggaacaaccgttaaaattaggaatgatgttgtgtaaacattataattgctatgatataaatgaagtgttaaagaaagcaaatttaaaccaattttgtgaacagaaaagccttagtcactatgaccaaaactacggacgaaactatgaccaaaagtaggtactaaattatgaccgaaaataggtccaaaatggatttttttatgatatcaaaaattatgaaatgattttgaaagaaaaccagttggcacagccaacttagccaccttcctgtaggaaggtgctatcagttttcccttatgctcttttctttcttttttgtttcatatgtcaaatgccattttgaaatgtaccatcttaagaaatttatccttaaaaacaattgcgttattggataaaaagatgctacattatcttaaaaaaggaatcaaatatgatgaatttagtggctagcatatcgtgtgattaagatactttatagtgtaagttgaaggagaaaaaatatttaaaatatacttcccatttcagtgggaagtaaaattaatcttgttgtttctactagtaatgtatctttttggaaactatgtaacgatgtaaacaagatttttttcagaagaaaaaacgataaaagttgtgataaacgatttaaaaaataggagaaaatatatcaagcgcatggtatgaaacgcacatttaaaaagattcgactaactaaaaaaataagtttacaaagcattgttgtgtattacaagtgatctatacactgaaaaatgatagagaaaatctgatacgtccgcaacaatggacaattgaaaatgaaagtgaggaaattggaagaatggctgatgaaaataaagttgttccgcttgaaacactagtgataaataaggaagagtttgagcaactttttcttgatttttttgttcaatatgacaggatttatgattttagttcgtcactagatttatttgaattagaggcagaaataatagaaaacagtcgagaggagaatggtaaaatcatcatttcagtagaaaaattcaatgaattattctcagaaacatttgaaatagatacagattattatcaaccacaagaagttttccaatcatttagaaatcagattattcgctcaggtaagaccgtaaactgaaaaacaataaaagaaacgttgaaagaataattattccttcaacgtttcttttttagaatgttttaatgaccaaagcagtttcattgtcaggcttaggtaattcatgaaatcccgtatttatagtgctcaattgatcaactaaccatgttttactttttgaattgtagataaatctaaaattaatatcgttattatcgtgttgaaggggcgtctccaaataatctgctgtatattcatagtcaacgtaacctgctaatacaaaagagagtatccctttatttaatgttagatttaatggataatcatacgactttatttttttcaacttcatattgtacatatcttcagccataaaagttgagttcgtgatttcatcttgggtctcattaaaaaagttatccgaataatcgcttatttttgaaaagtctttattggcaccagcctcaaaaaattgttcaactttttcagtataaagttgtgctaacgctcctttttcaatattaactttaatattttcatgtctatcaatttgtgtgctgttcagtaagggaagatcagcttttagttttatatcgtcttgatttctttcaatttcaattggcaaaatcttttcagtagattcagtttctgataaaggaacatctagttttttatcatgataataagcttcaaatccatctggaaccggaaaaaaatgtattgggtaattcttttctgaggttgttgtactagtttccgtacttgtagaacttgtgtcagaagtggtacacccgcttatagttccgatgagtaaagcgcaagttagaatgattgcaaatttcttcaaaaaaattcctccttaaaattgaatatggactaatactagtcccattgtagcataccgaatctttaagattaataagaaaaaggactaattttagtccaaaaggtgtgctattcttgaaagaggaaaaaattattgataaagaaaatgtaatcggtagcaatattagacgagtccgattagaaaaaggaattggtcaaaccgagctgattagagacctacagcttcgtaaaattgctataactagggaaacgttggttaagattgaaggtggccgccaacacattaagttggatcaattgaaagccatcaaagatattctacaggtgtcttatgaagatttgcttcaatgactacttgtagtcatttcgtttgaaattattatgttacacccttatgtgtcacgaagaaatactggtataataatgaatgggatatgtaacgatagggtatactgttatgttgcctaataaattgtggatcaaaatacaagaatggagggatatccttgtataaggcatatgaattggattttacaaatgctgacttaaatgcattctcctcaagctcgcaatcatatacacatgtagtaaatcaaatagatcacaaccaaaaatctattaacaagagaatagaaaatctatttgaaagtgaaaatgatttagttgattattattctaaggacagcaaaattctagatgcagacgaaattattaaagattggtttccaactataaaagcagatatttttatatctcactctcatgctgatgaaaaattagctatacgttttgcatcatggctatttgaaaattttggtcttactgcatttattgattcttcggtttggggatacagttctgatttattaaaaaaaatagaccaaaaatattgctataaggaacaaacaaaaacatatgattatgataaaagaaatgtaacaactagtcatgttcatatgatgctttctacagctttaaataatatgattgatagtacagaatgtctgttttttcttaatacacctaattcaattagtttgagcaatgaaatcactaatgaacagaaatttacgtattcgccatggctatatagcgaactgacgacagcttcaatagtggaaaaaaagaatccacgattggaaagtaatcctcaaatgagcaccgaggatgttagaagcattataaagcactattcttcgcaagaaaatctgcaaataaaatattctttaaatttaagtgaattaacttatttacgaaaagctgatttgaaaaaatgggctttagatgctgtggaatgcactaaaggaagtaatacattagatattttatataaaaacaccattttcactaatctctaatcaatttactgaatcgaaaggaaccgggtagaatggataagaaagttttaataaagaggttctctgaagctattgaaaaaggaaatgcagcaatatttgcaggtgcaggattatcgatgtcacaaggatatgtaagttggccggaactacttaatgatcctgcaacagaaatcgggttggattctaaaaaagaaacagacttagttactctggctcaatattataaaaatgaaaatggtggatcaagaggaattttgaatcagatacttatggataattttggtgaagaattagaaatatctgaaaatcatcgaatactagcaagtttacctattgaaacttattggacaactaattatgatcatctaatagaaaaatcaatccgagaagcttataaaaaccctcaggttaagaaaaattatactcagttagcaacaactaatccaaatgtggatacaattgtttataaaatgcatggtgatatagatgatgtcagttcgacagtaataacaagagatgattatgaaaaatatgatgatgattcgtacgcgttatttaaagaaactttaaaaggagatttgttaacaaaaacttttctctttttaggatttagttttacagaccctaatttagaaagaattttatcagatataagatgggttttgagagaaaaccaaagacctcattattgtataatgagaaaaatattaaaggaaaattttgtcgattctgaggatttttttgatcaagagagatataattatgaactgacaaaaagaagactacaaatcaatgatttgtccagattttcgataaacgttgttgaagtagatgattattctgagattactgatattttgaaaagtattagaaaaaagtatttgagaaaaactatttttatttcgggaagtgctgttgattatactccatttacatctgaatcgaaaggattaaaatttgtcgagaaattagcatataggctttctgaatccggttatagaatagtatcaggttacggacttggaattggtaatagtattgtttcaggagttctaaagcagagaagaaatttaagaaaaaataacatacaagacgtactttctttaagaccacttccccttgatatgcctcatgagtggagaagatatcgagaaaacattattgcagagtctgggattagtatttttgtttttggaaacaaacttgaatcaggtgaaatagttacagcagatggaatgattgaagaatttgaattatctgttcaaaatgaaaatatagtagttccgattggatttaccaaaggtgcaagtaaggttttgtttgataagattcaagagaatttcagtgattattttgatgattccttaaaaagtaaatttcaagcgctagaaaaattagatactgaaggagaagtagataaaaaagttgaacaaattgtcagtttaataaatagtattcaggaggattaatatggtgagaagggttttttttagtttccattatgcagatgtaacaagagcaatggtagttagaaacagctggactttgcgaggaacaaaggaagctggttttgtagataaggctgaatttgagaaagttaaacgtaatggagatattgctataaaaaactggatagataatcaattaattggaacatcagtgactgtggtgctgataggtaaagaaactcttgatcgagaatatgttaaatatgaaatccaggagagttataagcgaggaaatgctattttggccgttaatataggtaaaataaaagattttaaccagatgacaactactagtcaatcagtaattaaaataattgggcaaaaaccagatggagaatatttgtggtttgacgaaattattgatggccaatatgattatataagtgatgatggatacaacaatttaggaacttggattgacagtgcagcatacaaaaaaggtaaataaagagttggaactgtctactatctaatgacatgttatttttttacttacttatccctgtatctttaaatagtagatatttttttatcagttaattcatcaaactgaattaggaacagacataattctatagataagtaaaactctatgataaaaaatgtttaatccttatatttctttataaagaacagttatatattttctagcaaaagcacgccacgcaacttgaatacgattataataccaatcaagatgaattagcatcaataaagtgattaactctatacaaaaattattgaaataccaactatctttatttttaatgaacttaacttcatggttgaaatagaataacttgaatcctcaaatagcttctctacctgctgttttggatacgatattggctacgttcccgatgacagtacctgctgatatatactgtcagtctaaagtaatttgttagatgaaatatctctataaagcctgattctttcctctgattcccaaaagagtcattggaaggcagtgttgggtaaacctgttataggagctagaacccttgatatataagggttctagcttttttgttttgcctgtatactagaaatgaccagattttgaccagctcttttactgatgagccatcatatcagcaaagtcttgacctgttttcttaggtgcattatttgtaatatgtgcatagatgtctaatgtcactttactattttcatgccctaatcgttgttgaactaccttgacagattctcctgcttctaataataaactagcatgtgtatgtctaaacccatgaggtgtaatacgaggcaagttatattttttcaaaatatatcttaaccaatcattaacagtgtttggaatgtatagagtgtttttaactgttgtaaaaacatgttgctctttagagctagtattgtatccaagttttaaatactcttctttttgctgtaatttccagttgttgaggatagaaagagtctcagtatctaaagagataactcgtctagaagctcttgttttcggagattgaattataactttaccaaattcatctacagcaagagttttattgacatgtagttctttattaaacgtgtctatgtctttccactgtaaagcgagtacttcactctttctcatacctgtgtatgccaataatctgaagaaggcgtattgtttcatgttaccaaaatctttaaaagcatccagtaaattattaagctcctcttttgagtaaaatttacgatttttctcatactctttttttcgtggaagaagtgttttttccataggattattgtcaatatattgcattgcaaccccgtagcgtaaaatttgtgcagtctgttttctcatataatcgtaactttcatatttactgtgccattcatctaccactttttgacaatatgggacagagatattcgatagtttaagcttaccaaatgctggaagtatttgattatttgcgtatcttactgagattgcgattgttgaagctttaacactggtacgctgatgagttatccattcattatacaggtcttcaaatgtcatatcaggtgctttctttttaacaccgtataatatttgatgtctgtactcgtcataatctttttgagcttcttgtttgctactaaaacctcttctcgtagtatttattttttcaccagttcgtggatcggtggcaatgtgtcctttatacatccacgccacttgaccgtttttctttttgtactttgatatttttgccatgaaatcatctcctcttagtttacaaggagtacttaccactagatggtatcacctcccttcatttttttcttagtgtattttttcccaattgatgaaatcgtttgttctagcttgtttatattatcagtaatttctctcacagcttcttcgggataagacatgtctttcaattgaataggtagccattcatctaccattctttctagtagttcttctatactgctagtgaggaaaagaatgttattgtcaaattcttctacaatagcattgatgaataattcttctatttttaagatattgaaaagactaattttttcatttttaactttattacaagtcttgttagcaataaattcttgcatctctggttctaatttggaatatctatccagccatgtatctaaattagagtgtactggtgggaactgttgacgaagatgctggaacaggtttttatctggaaatgttataccatctagtacaatgctatctctataaagaataattcccaaaatatattcttctacattgccacaaactaactcctctatactcatatttcccaaatcagcaattcgggataatcgctctggtattggtaaataggttcccttctcccattcgtagatagtctttttgtcaattaattgaccgttgttaatcataagaccaaatgctggttgtgttaattttttactctttcttatagcttttatttttgttccgagtatcttttttcgttctaaataatttattggtggacgttttatcatattgaccacacctcctaaaattagtatacctcaaaaaaggggtgttgtaaataaattttacaaaactattgacaccccttttttatcgaggtattatgtgtatgtcgatgaactggtaatcattttttgtttgattaatcggttaataacaaaatacttttattttgagcaaaaaatacgaagataattcttagaaaatttgttcaagcaatcacgaaaggagggggaaatatgtctctacaaatcattgatagcattgtttctatacaagttgaacaacaagtgaaagagataattacagtgctaaagcctatgctagaagacattatttctggagtcactctagagtatatggactatcagcaggcaagtgaatatctaggtgtatcagtaggaacgattagaaaatatgtttctcaatacgggttacctgttataaaaattgatacggtcattagatttaaaaaatctgatattgatagtttcatggaacggtataaaggttgagtaaacaaataagactaaaacatatagtaataaagagtttgtttttattatctgtatgttttagtctttaacagaattttataaggaggaaacacaaatggaaacatcaatgattaatattccaatttatgtagataaagaaaaattattagagaagccagttacaaaaaaagaaaaaactgatgtaagagataggtgtttagataactatagagaagttacaagagatgagtttgtagagatactaaattcatcacaatcatttattccaagcaagacaaagaataaaggcaatgacaaggagagttttgtggaaaccagagtaattattctggatgtcgataacactgttaaagatgagaaggggaaggtagtagatttgagtaaagatgatagtagatacttaagcatagaaaaggttttatctatcaatttagttcataattctgcgtttgcgatacaaaaaagtattcggtactctgaaaatctagaaaaatacaagattgtctttctattaaaagaagcaattactgactatggtaaaatggttgctgtttacgaatacttgaaaaagaacatccccgggtgtgatgacaatgtaaatgcttcgaatagaatgttttttggaggatataagtcagatgcagtgataataattaatgaagacaacatgttagatattactgagcttccgattgattttaccatgacatgttctaaaaattgtcaaagtgattcagggagagagtatgaactagtcaatgaaaccgattttgttaagttgataaaaaatgacgacaaagaagaaatgaaacagtggtttaaagactgcctgtttgattcctccgacatgtcttttaatgagatttatgaaagattgttaaccattgatatgaataaattacttaagtcaagtaaaaacttaagatgtctgtttcacaacgatcataatccctctgctagtatttttaccagtaaaactgggcattccattttttattgtcattccagtaattgtgatatcagtgaaaattttattggagttgtgatgctaattttaaagaaagacagtcgggtagaaacatttaattggctattagagaacctagacttgtatcctacacattttcgaaaattgaaagaggaatcaaaagtactttttgacactcttgaatcaatgaaagacaaacttttcaggacaataaggaattatctagaggaaatgcgacgtgtctatgatgtcttgctttctgatgttaatttttttgatgatagtaaggaaagtgtgacttgtattttgtcgggggaacaattagctaaaaaaatgagttcttactatggtaaaacttatgacatagataaatgtaataagttactatcacttatgacttttataggattgataaaaaaattagatgatgaagatgttcctttgaagatgctcgaatacctaaataggttaaaggaagagaaagcgttaggaaactttaaacataagagaagcaatgtctatcgattagacgtttttaatgcaacttctgtgattcaaaaattgaatgaagatatccttccacttctggaaaaatttcattttacatatcaatatttttcttatgaatgggttaagatatgttttaacgaaaaagaggctaaaagagtatttcctcaaaattcccgatcagaacttagcaaggaaaaacaattgattttagatgaagcacatgaagttttacagggcttatcgtggcaagggacatatctaatgacagaaaaagaacttattaacactgtttgtgaacgcctacgaaatgtcagggataacagcgtgaaaaatgctttaatagaaaacagaggctactttgttaaacaaggattcactcttgaacgagcttctaaggatattaagaaactatacaatgtgaaagcaagcagtagttttttagtatatctagcgaaaggggcagggatagatgaagtaataaaagaattgatattatcaggagttgaattagttcctatttatcaatttacaagtgtaacaagagatgatggacggagagtaaggaatagaagagacccaattatattaaactagacaggttatccatagctcttaatcttatttcatctcaatacacccaccgttaaagttcggtgggttatttatttttcaatctttcaatagctgattgcgttcattttcttgcctttttaatagcttcatatagtcaattgttcgaattgcatcttcagtactaagagagcgatagagagccaaaaactcttcctcataatctatgtcaacattgtctagaaaatggcttacaggggttcctagggctctagaaagagctgttaagctatcgaggttaggttctgttacagaattttcccatcttgctactgcctgttgtgtagagaagatttttttagctaattctttttgtgtccacccgagtgcttttcgcttttctctaatgacctttgcatattgcttctgtttcattaatacaccccccttctcagtagagtacaacaagttgttgtatttgtaatgacatttgaagtatttatatattttatgagttgaaatacatcatattgttgtatataataaaacaggaggggagaatcatgaaaaaagtaagtaatctcagccgatacagaaaagaaaaaggactttcccaaactgagttagccaaaaaaatgaatgttacacagcaatgtgtaagttcgtggcaaacagggagaacgattcctaaaccctatcaaatgaaaatgctttctgagatattaagtgtaccaataaatgagctgttttctgatgtatttaataaagtaaacagttagctaataagcaattgaatgattttaggaggagaagacatgtattgtagaaaatgtggtaaagaaataacaaatgaaagtaagtattgccagttttgcggagcattacaagaaacagatgagacaaccggaacagacacagtaaagaaaagtactgagcagacaattaatgaaatgaaggaacaaatcgtacatggacaagagacagggaagctgtatttgattattggttggatttctatggtagtatcattagcatttattcctgtggtatttggtgctgttgctgttattatgggttacttatatcgagagaaagatgaacaaatgggtacgattttgatgatagcaggggtagctggagccatctttggtgtactattggggatgtcaatgagttactgatgagagaaaatcattttggagataggagataaaaagttgaataaagtaaatatgaataagaagtttgtcattataggtatcgttgtattggctattataggtataattttttcaagaatgacgggttcatctggactagagaagtcatctgtaccattggtaactcagattttacaagaacagtataacttaaatcggacatgtgatgatgtgacgatcactcatgataatggtgataacacgtaccgggctaaagctacgttagacaatggaagtgctatcaatataaatgtcgagtactatccaaaaaaagaccgtgtatatgtagagataccatatactgaggtgttaatgttaaattgatttaaatgtattatgcataccgttcaaacaggaactcctaaaggtgtaagcttactaaggagtttttttgattccctgtaaataatagtctgatgattgctgggaaaatctttacattagtcactgttataacagcagtgtataggaggaaaaatgaaaaagaaaaaattattatggatttgtttggcaattttattgataattggaggaattgagatatttaccacatatagattaaaaacgaatcagcctaaacaatatgtatcagacatgttaaatattattgaagaaatagactcagaaatgaaagctttctcaaaaacttctatggatttgggagaaagatatgattttaaggggtttatggaagataaaatggacgaggtatcaagtagggaaattccagaaggcacacctaaagctgttagggacaccaaagatactcttcttgaagcgattgataacgtgaacacagctttactaactaatgatgtaaaattattagaacaaggccagctttgttttagtatagctcaagccatatatacagagtttttagatggaaatataaaagagaagtcacttaatgaaaaacttaattcatttgtagaaacatacacagctataccacctacttggaaacttgtaaatgaagataaaggaatcacgataaatactgatacagagatttctacagatgctcaatctttatcagatttattagctaatctaacaggtatcagtaatgcagtgacagagaaagttggtaaagatattccacttcggttacttgaaaatgggaaaaaagattattctgtggtatttaagaacggacaggtaactgattacaacgaagtatttaaaaaagttattgaataatgattcttccatctttttcatttatttaccctaccccgttgttatatgaccgtacttatacatctccagtagcttaggataagctactgggggtattttttttcggatttggagcccgactatatttatttgtatctgaaatgaaacggagatagtttcattaaacgttgatatataagtgttttagactgtttcaggtagtgattttagtgaaaaaatttttaagaaatttgtatattttatactactagacagtactgtttttttatgaaaaaatcatatgtaattgtttcatatgtatctgaaatggttctaaagataactatgtagaaatataaaaaataagttaacgatcagtctaagttatatcaaacaacgttagactcctttcgcgtagtttattagcaagaataagtttctttctttttttttttgctttttctaaaagggagtatgctaaaataagagggtatatagcaactttaaataagagataggagtgtatctttttgggtgcagaattaaatcaaaaattatttagtgcggcagataatctccgtagcaaaatggatgcgtcagaatataaaaattatttattgggactgattttctataaatatttatccgaccgtttgttggaacaagtggttcttttagcagatgaatccttagaggaatatgatacggtaagcaaacaaacgatgttgtatcgcgaattactttcagatgaagaatcaaaagaagatctgattgcaacaatcgttgatattttggggtatgcgatttcgccagagtatcttttcaacgtcttagcggatcaagcaaaacaagcaacgttccaattgaatgatctaaacaaagcctttgtgcaattggcatctacctacaatcaatttaatgggttatttgatgatgtggatctccaatcaaaaaaactaggaacagatgagcaacaacgaaatgtgacgattaccgaagtcattaagaaattgaatgacgtggaagttttaggtcacgatggggacgtgatcggggatgcttatgaatttctgatcagtcaatttgcttcagaagcagggaagaaagccggagaattttacacgcctcatatggtttctgatatgatggcacaaatcgtgacgttggatcaaaaagaacgacgattctttagtgtttttgatccaaccatgggttcaggttcattgatgttaaatgtgcgtaactacttaactcacccagataacgttaaatatcatgggcaagaattaaatacaacgacatacaatctagcaaaaatgaacttgattttacatggggtagatgccgaagaaatgaatctccgcaatggggatacgttgaataaggattggccaacagatgaaccttacacatttgatgcagtagtaatgaacccaccttattcggctaattggtcagcagatacgaccttcttagacgattctcggtttaatcgttatggaaaattagcgccaaaatccaaagcagattttgcgtttcttcttcatggtttctatcatttgaaggaaacagggactatggccatcgtcttgccacacggagttttattccgtggcgctgcagaaggggtcattcgtcaaaaattactagaagacggcagtatttatgctgtgatcggtatgcctgcgaacttgttcttcgggacatcgattccaacgacggtgattgtattgaaaaagaaccgccaaactcgagacgtattattcattgacgctagtcgagaatttgtcaaaggaaaaaatcagaataaattatcggaagaaaacattcaaaaaatcctcgaaacctatgctgaaagaaaagatgtcgagaaatacgctcatttggcaaactttgatgaaatcaaagaaaatgactataacttaaatattccacgctatgtagatacgtttgaagaagaagaaccaattgatatggttcatgtcggaaatgacatcaagaagatacgacaagaacagcaagtgctagaaaaagaacttttagaagctatctcttccctgcaaacaacacctgaaaatgaagcgtggttacaaggtgcgctggaggtgttcaaacatgagtaatgatatacaaccagaaattcgtttcccaggatttacggaagcttgggaacagcgtaagtttgaatgcttacttgataaaaaagatggagtaaggaggggaccatttgggagtgccttaaagaaagaattctttgtatctaatagcaattttgttgtctatgaacaacaaaatgctatttatgataattacgaaacaagatataaaattactgaaaaaaaatataatgaattaatcaaatttaaattagaaccaggcgattttatcatgagtggcgctggaacaattgggagaatttcaagagtaccaaagcaaataaaaccgggtgtattcaatcaggctttgattagacttagaataaataaagaaatcacagattcagaatattttattcaatttattcgtgcagattttatgcaaagaaaactcacaggagctaatccaggttcagcaattacaaatctcgtaccaatgtcagaagtgaaaaaatggatagtacaatttccaatattagaagaacaaaagaaaattgggaacttcttcaaacaactggacgacactatcgctcttcaacaacgtaagctagatttattaaaggaaacgaaaaaaggattcttacaaaaaatgttccctaaaaacggagcaaaagtgccagaaattcggtttcctggatttacggaagattgggaacagcgtaagttcaaagagtttagtaagaagactggaaaaaagaacacgaaagatttagacttccctgcctattcggtaagtaataaagcaggtttaatttctcaaacagaacagtttgatggtagtaggttggatgatttagaaaaaacaaattataaattcgttgaaccaaatgaattcgcctataatccagcaagagtaaacgtaggatcaattgcatttaacaatcttggtatgacggtcattgttagctctctttatgtagttgtgaaaatgagcgaggacttagataatgagttcatacttcagtttatcaagtcaccaacatttatcaaagaggtcaagcgcaacactgaaggaagcgtacgagaatacttattctatgagaatttcgctaatatcaagtttccttttactaggaataaagaggaacaacaaaaaatcggcgctttcttcaaacaactcgacgacacgatcgctcttcatcaacgtaagttagatttgctgaaggaaacgaaaaaaggcttcttacaaaagatgtttgtttagggagggaagataaatgaaaattagtcaccgtgaggaagcggaagtcgaagaacagttgatccgtgtattgggggaagggcataatcagtggacgtatcgtcccgatctaaaatcagaagaagatctttgggtcaatttacgccaaaaaatcatctcaaataatcaagcagaactgaatgattttcctttgaccgataaagaatttgaaacgatcaaaacagaattgttactacgaacgaaaaccccctttgatgctgcgaaatggttaaaaggtgaaaatggaatggctcggatcacgattgaacgggaagatccgcaactgggttctgtctcgctcattctttattctaatcaagacattggtggaggaatctctacctatgaagtggtccatcaaattgcaaaacgtggaagtaacatagaagcacgggatcgacgttttgacgtcaccttactgatcaatggattaccgattgtccaaatcgagctgaaacaagtaaccgcaaaagatagtttttatcaggcgtttaaccaaatcaaaaaatatgcagaagaaggtatgtttcggaacaatatcttttcgaccttacagttgtttgtggtttccaatgaacaaaccactcggtattttgcaaatgccttaccaaaggatttgcatcctaagtttttatttagttggcgaacgaaagataataaaaaggtagaaaacttatatgagttttgcaaacaagtgctaaatatcccggatgctcatcgcttgattgcggattatacgattgtcagtgaagatcaagacaataaaatcctcatggtgttacatccttatcaagtacatgcgattcaagccttgtttattgctgcaaataaacatcaatcaggatatgtgtggcatgcgactggttcaggaaaaacgttgactagttttgtatctactaagcttttagcacgaaaatcggggatcgatcggacgatcatgttagtggaccgcaaagatttagataatcaaaccaccacagagtttacgaaatttgcttcggaatttaatactgggatttcttccgggaacgccaaagcgaatagcttgatcgtgggaacaggaagtgccaaagagttaagtgaaactctgttggcagatgccaatgcaaatgttgtgattattacaacccgtcaaaagctagatgcggcgttgaaatatgcaaaaaaacaagaagagaaaaaaggaaccaatcgcttccaaaaattaatggggcaacatatcgtgtttgtagtagatgagtgtcatcgagcgttaagtgctgaaaatatggaagaaatcaaaaaaatgtttccgaaatccacttggtttggctttacaggtacaccgattttccctgagaatcggaaacaagccaaagggcaattggcacgtacgacccatgatcagtatggagaggtcttgcatacctataccatcaagaatgcattagaagatggctcggttttaggatttcaagtagagcatgaaaacaccgtggagccgacttcattagagaataaaatctatcggaaattaaaagaagtagaaacatatgcagagtattcaccggaacagatcaatcgtatgattgatcaaatggagcctgtcaaaaaagaaagttatttggaccctactgtttttgaagcagatgaacatatccaaaaagtcattcataaaatgttccgtccagacaatgcctatacaaaatttgattttcgaaatggccgtccaacgaagtctgcgatcttaaccacgagttccattgacatggccaaaaagtattatcgagcgatcaaagaaatgacgaaagaacctgactggttaacaaaagagtttcctaatcagcccattcgtgaaggaagaacgatggaggatcctgattttccacgaatcgctattacctattcattagaagaaaacagccgagattcaagtgtccaacaagaagaaatgcaaaaaattattgaggaatataatcagtattatgatacttcctggtcattagcagacattgagcgttataacggagacatcaataatcgtttggcacgaaaaagagcggaattcaaacaatttgggaaacaaattgatttagtgatcgtagtggatcgtctattgacaggttttgacgcacctacgattcaaaccctatttgtggatcgtaatctagagtatgcaggattgatccaagctttttcacgtacgaaccgtacgtatccagaaaaaacaaaaggactaattgttactttccgaaagccagccacaatggagaagaatgtcgaggatgcgacaaaactgtattcagaagcaaaagaagaatcgggtttgatttatccaagttatcaggaatccaaaaaaagattcaagcaagcatatggtaagttaaaagaggtttcatccatggaatccattgatgaacatacgccacttgaaatccgtatcgagtacgtcaaagcattccaagaattgaatcgtgcttatgaatcgttagtgacttatgacgattacaatgatgacatggtgaaatcttcaaccttgaacaatcaaattcaacttttggaagaacaaattggcgtgtacgagaccgtgaagggttcattaatagaggaagaaccagaaaaagagggagaagatttttccacgatcgaattttatagtgaaaataccacgaagttgtatgatattgattctacttatattgatcaattactaggaacttatgcggcgaatagttcagatgcacgagaagaaattgaaaaagctttggctaaattgaataaaacagaaggagtcaaagaagtttaccgacaaattttaaatgcgtttgatgtggggactttagatagtaatgaagatatctttgtcattaaacgtcgctattttacacaagcgagtgatgatttgattcatgtcttttccaatgagtggtttgtttctgagaaagaattacatgcttctaatctgcaatatatgccaggtgaagatccaattcctaatatgaaagcaattatcaacagtaaggattacgaaggatataaagccaaccatccagaagcgaagccatttaaatacccacaagaaatgaagcgagcatggcgtaaaatgttagatgatgagctgattccacttgaaaatgaattgaggtaaacgagaagagttaagaaaattgtacgattcaaagatggtagtaaagtggaagtgtagaaaatagggatagatgtcttttatttgttcacattttataacgaagtatttaagacagctattgaataatgtttcctccacctttttcattcatttaccccaccccgttgttatatgaccgtgttttgagaggaaccaataaaaagcataggctaactaggggttcctttttcttttgtttttttggaatccgcttaagtgaaatgtatctgaaatgaaacggagataaagtgattttttgctgtaatgacaaggttttagctgtttcagataccatgtaacccaaaatagtttattgagaaaataggagagtatttgatactaactagtaggaaaaaatgagataaaaagtaaatggaatcatttcaggtaatctcaaataaaaaaatatacagtcctgtggcactttacctatgggactgtatatattttttactctcagcgggcttgttttgactccgtgtctgactccgtcgtattgattttaaatgatattcgatgaccatttaacaggtcatttttgaaatttttgtctctatatgactcagtttgataattattgatagatcaatttgggtctatatcgaacaagggaataatccaataaaaaatgatttagaatatcaaaataacaaaaaagaggactacctgtattagtcctcagactgtagacaaaagctgttccaaactcgtaactcgagcttggaacagctttttatctacttcgtttcgaatttttgaacaaaaaaataaaggctccttgcctttccatagccaggtggctaatttctttaaattcattgcagcaaacactagcatcgtatgcgtcgcgactttttccaagcctcgatacttggtccaacgcatcccatgcttttcttttgcatccgcaaatattcgttcaatcgtttgtttccgttttttgtaaattgatttattcagatctgttaggcgaagatgttccacttcatccatcagatctccccaaacatgtctcgtgatgactcgttgatgatttttacttatggtacattggtttagcagaggacagttcacacattcttttggattggatttgtattctcggtacccttctcgagtaaccgttgaaaaagcgagcatttgatcttgcggacaaatataacaatcaaaatactcgtcatagagaaactcattttttgataatagcccctttttccctttgggccttgaataaggcaaacaaggtcgaaggttcaaatgagtcaaaaagtgaacaaacttaggtgtcttatacccagcatcagcgacaacacaattgatttcaggaaaaagtctcttcgattgtttgacgagctgaaaggcgacttgactgtcataaatatttccaggagtgatgattgtgctaagaataaatccattgtcgtcgcatgaagtatgggcagaataagcaaattgtttttctcgttcgcctttgacgtagtagccgctttccggatcagctttacttatttttctttctttcagcttcacttccttttctaagtccaaagtaaaagggcgttttccagcctctattcgttgacgattgatctcatcttctaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaaatatcctcaaacaccgtcgtttctctaaatcggcgaacataattctttccaaaagttgagaaatgggggattttctcctcgaaggagtagcctaagaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagatatcatccataaaatggactttgtctacagtctgaggactacctgtattagtcctcttttttgaccagattttgaccagtctattttacattctaatatattcatatgagctaattttatgattaaatggtaagtgtttccttgtttgttttagtttaaactagtgtgtaatttaaaaatctatatggaagggtctgtggggtaatacttaaataaaggctaggaacctgataacatcaaggttcctagcctttttataataaaatgaagcgaaaataatttcttttaaagagccgagattatcagctatataagagtgaatttgatgcaaaaaacagagccgaaacagtcttggtgttcgtagctctgcttatatgtttcgaatttaagacaaagagttggcaaaagatgttgataaggaagataagataactgtgttatataaactaggtaactaactgtaacaagctaattttaagagattcttattagaagacgtttaggaatataactaagaaaatgattatacaggtaattgtcatttcaataatgttttctaattttcgcgtctttgttttaagaaaaaggccagaatcagttggaaaaaagttcgtacgatagtgaagaggggcaaaatttcctactaatattcccactaacaagagataaaacggccaggttggtgtgattcctctataaaaaaatgcccatgctaccgaaatcccatagattaacaactgaacaatttttacaatgaaaaaattgttctgccattactcaaagtctcttcctccttgtatcgtttatttgtttcattttatcattatgataggcgcttgaacaatccattttgtattttattgagtactcttggataaactaccagcgattatcatatttatttatgttactgtaagccatcatataaaagtaaatgagcagatcatagaaatataaaaaagaactaaaattgatctaaattatgtgcagcttgactacgtaccaatctatattacttactagattggtcgttaatctattcggatcgaatgagcaaaatatttttgtgaatgtccatccttgattatgattccaaaaagaatcattgggaggctgtggcgtaaatattatactataagccagaaatacctatcattctgaacttttttatttaggaactttcatctcaaggctttttcaattaatttgtacccctgttttttggataagatcatgtgcattgattttttctatctctacgttcatctcctacttaatgcctatctggctcctgagggcttctttttaaggcgtcgtcatagtcttggctgaggatttcttggtaatctgagggaatggcttcccaagtgagcaggcgaacgttcatgacgtgttttcctttgtgtttgattacagcatggtttttctctttttctacctctccagcgtgaaaagacagccatgtaccatggccaaagatatcattacatacccaacgttcgatggaattgtccacgtatcctacagggagtgtggtatagccgatttgtggtttcaaaaaaggattgaatcgatcgatcgtttcatttttgtattgataattgataagaaaaagatagaccaaacaaaagacgagcagaaagaaagatagtgtctttttgagtgagaagggttgttttgatgaataagatttcttgttaacaagaggttcatctggcaatgttggttctattgattcggtagctgattcaatagaaggaaaatcaatcggcagacctaaagtatgatgtaaaagtgacagcatttcaaggtctggcattgtacgagaattttcccaactagaaatcgttttatcggaaacaccaattttttcgcctaattctttttgcgtaagcttacaatttctgcggtaagttcgtattttttctccggtgttcatcttcttctcctttcgattctacagtatatagatttattctacatgacctatacacttgatagatacgtttttttgatgaaaaacggtatgattttatcaaagaatcatttaagtaagggagagtggtgataatcaaaaaaaagttcacagttttactcacaatcatagtgaccggtatcatgagtggttttgccttggttagtataaataaacaggtactctatcggacaaatgaatttttccatcaaacagatacttatactccgattcgattgccacaacattttattgggcaagaagaatatgagcagctaatcatggtatttgaaaatgtctcatcagaaactgagctttcttatatgaaaaaaacagtaaatgaatccaatgaagtagatacatcttggaacttcaagatacagccaaagcttgaaatgacattgtattatcaaggggatgtcaaatcttctcacgagaaggtaccctattctaatacctcctttcgcgtaacgtccattgaagaatcgatcaaaataaaagattttgaaggtgaatttttcttgatgacgagagaaaaagaagcctatgaacggttcatttcactattcactgatcgattcaatcaagcatttcacactgattatgccactaatatttttgaagactttgaaaatagctattcgtattcggttatttcaaatacagacgtatataattatcgagtgtatttaactattggattgattcttttattccttttgttatcatcctttttcttattgatgaataaagaaatcagtttattgttgaataatgacttttcattacatcaagtattgtggtgtttattggggaaaaagaaaatcattattacattcataattgcaggaatcattggtggttttatttttatgtattataaggagcaatttctttatttgttccagatgtacgttttcttgttcagcggaatatatggtatctctttgatttctcttttattagttgaaaaaatcgcttcgttaagagaagcgttcaactatatccaatacattctttttacatttggattgttgttttctcttcttttgaccgttgccaatgtcgaattagcaactatcgttttttcttcttcacagttagctgtttcccatgaaccaccaaaagaaatcgctggtgaggactatcatgtattttatccagtaaccatcgggaaaaaccacgtggattttatttattccaatcgttttgcatcagcagcagatcaggaattatatgaaactttgaataaaaacggaagtatattagtcaatgtatcagattacttgaatgaagaaaatgaacagtttggcagagggataaaaataaatctgaattatcttaagaaatttcctttgattgatgtctctggaaggttgatccaaataaccgaaaaagaaacgcaccctgttatattgatccctgaacgatatagacatacagatttaaaaaatgacctggcgcaaataacagaatattatcaagaaatcagtgaaaaagaaccgaaatttctatttataaaaaacaatcaacccatttatacatttattccttctatcccctggatcgaacattatccggttgttgaaatactgacattgaaaaacagtatgtatttggaaagaaatattctcagcggagaaatctatccaccgttaaagatcaagataggctctttgtcgaaagaaaggttatttgagctgattgaagaaagtcagttacgtgataacttgcagttatcatttccgtatactcagactgaagagatagctgtcaaagtgttaagcagatcatttcattacttgatacagatatttttactcactttcttttctttcttcttgttgagctatgtcatgttatgcatatattttgtctacaattgtcggaaaatcgctatctttcgttcaagtggttattcgctctttgaaacgtataaagatttcttcatgatgaacctcatcaaatggggaacgacaagtgtaatcttcctttttcttatagaaagagagcctaaatatctttttaatatttttttctttagcttcattgattttattctttcagttgtttttattttgtctacagaaaagaaaagtcagttattgctgatgaatggaggttaacaattggagccgttgatagtgataaaaggtgcgaaaaaaatcattcgaaacaaaacgattcttcatttggatcgtttcactgcggatgctggggatcttgtgactgttgttggagaaagtggagcaggtaaaagtacgttattgaatatattaggattgaatgatcagttcagttcaggacaattctatttgttcgatcaagagacgaaacaattaactgggagagagaagcgcttgataaaaagaaataccatatcttttctttttcaagattttgggttgattgaatatgaaacaatcgattttaatttagatattggattgaagttttcgaatttaaatgtttcagataagcgaacagcaaagtatgaggcattgaaaaaagtaaatataaacaagaagctaagtacgcctatctacacattatctggtggtgagaagcaaagaatcgcctgtgcgagagtcttattgaagaatagcaaaatcattttagccgatgaaccgactgggtcattggataaaagaaataaggataaagtagttgaaatcttatcgcaacaagcttcccaaggtacgttagttatcgtagtcacgcatgatccatatctgaccaaaataggaaacaagaagatcatgctttaaaaatcaaaaaggaaaggatgtcgttttatgaaaaaagcagttattatttgtgcactagggataggttttgttggaggaaacgctatgtcatctgaagtggaagcaaattcagttcacggtgaaatctattacaaatctttaaagccaggagagattcattttgatgctaaaggtaatattattaagtcaaatttaccagtagaccgggaaatttctagaacagcaattaatcatagctctggaagatgggtttattatagtgatacaacttgtacgagaaaaacaggtcattctaaccactatagtcgtgtctataatcgtcacggtgcaaaagcgaaagttggaaactctattcgatcagcaaatgcaacaaaaggagtatgggcctatgcaagtgcgacaggaaatagaactgacacattctcatgttggtacaatccaaccggttggtattaagtatccaaaagtttatataaaatagaaaaaacatataatgaaacagcgttaaaagttatttttggtagttttaatatattcatttttagttgtataaaaatatatcataataaaaacaacaaaaaaatgtctggaaaatcgaacataaaagtgtctgatttgaatatcccagcagcggaagaagaaaaacaaaatcgataacatttgttctaagaattagttacgttaaatacggaacgcaagatagacttgaaaaacggtaacaaaagaagtagtatattaaggtgtgatgtgctacttgacatttattctgctgagcgaactttctggattgtgtagccttatatctattcaggacgtatcgagcagattagtaaaggtgttcttgatgattttcatcttgaacacctttgtttttagcaattcgcaaaaaacgaaaagtaggagaattgataaatgaaaaaaagatttttagcacttgccatcgtactaggcactggcttattgtcaggctgtacgaatgccggtgaaaaaacagccgttagttataaaggcggtacaatcagcgaacaagaagtaatggatagcttgaaaaaaatgcaaggagcagattccgctgtgcaacagttgatcgtttatcaagtatttgaagataaatatggagatgacgtatcaaccaaagaaatcgattctcaatatgatcaaacaaagaaacaattgggtgattcatttgattcacaattgaaatctgcaggttacacagaacaaacattcaaagacagtatcaaacaaagtctagcctttcaagaaggtctaaagaaacatatcaaattgaccgatgaagatttaaaaacggcttgggaatctttccatccagaagtggaagctcaaattatccaagtagcaagtgaagatgatgcaaaagatgtgaagaaagctgctgataagggagacgatttctctaaattagccaaagacaagtcaactgatactacgacaaaagaagatggcggaaaagtgaaatttgattccactactacaacggttccggcagaagtcaaagaagcagcctttaagttgaaagatggtcaagtttctgatgtgatcacttctaccaatgcttcaacttatactacggaatattatgtggttaaaatggtgaaaaaccaaaacaaaggcaacgacatggataaatacaaaaaagaattgaaagaaattgcaacagacacaaaattaagtgacagtaccttccagaataaagtaattggcgaagtattgaaagacgctaatgtaaaaatcaaagacaaagactttgaaaatgttttgagtacattcacttcagattctagtacagcaagtagtaaataagcggtataaataaaaaatatgaactatttaaatcaataaaactgttcatctaaatctttttattagaactaaatcaacagtagtttaattactacttgatttagttctttttattttaaaaattttttttacttagaatccagcgaccctagatatttttctgtataatcttaaataaagaaaacaatatcaaaaaatgcacgtagaagtagataaatggagtggttttgcaaatttcttttatttctagaagttattcacgtatacggatttgtttttctcacaaataaaaaggcaggaagtacaatggatcatttgtatataaaatatattcatcaattttccgttttggtgttaggcacactaattatagcggggattgtcgcatttattattcaaggccgtgacatattaacagtacatcaagagtttttcagttatgcatttggtattcctctgatcgctataaggtctgataacaaaaagtggaagaaacgctattacattctcttgctatttttgtgtttttatctgccacctaagatttttactttattaggtatacaatgcctatcattttcttttatttcctatatcattgttttaattttcctcagtttcatagtatggatgttttatcttgtcaaaaaataaatgaatgtttcatgaacagtacttcatcacagcctaatttttttctttatgctatcgttatattaaagaaatcaatcagaagggaaagaaagtgatgaaaaaagttttattagtggtaaaccccagttcaggcggtgaacaagcaaaggaatttgagcaattagcgatagcaaaattggaatcggtgtttgatgaagtggtcgtcttgcatacaaaaaaagcaggggatgcaaaaaactttactcgcgaagcggctacggaagggtatcatagtgtgtttgtcatgggcggagatggaacagtcaacgaaggaatcagtggaatcgctgaacaagaacatcggccaaatttcggatttttcccattgggtacggtgaatgacttggctcgagcattagggataccgctagaacctgaggaagcgatcaatcatttttcgattgaatcagtcaagccattggatattggaaaaataaatgacgactattttatgaatgtcgtcgcaattggctctatccctgaatcaatcaatgatgtagatgcggagaagaagacgaaatttggaaaactagcttatttcatgtcaggaatcaaacagttagcttccacacaatcctactcgtttcacgtagaagttgatggaaagaaggaagaaattgagagcagtaccttgctgataggactaactaactcagtcggcggttttgaaacattacttccaaatgcaaaagtggatgatggtaagctccatttggtttatttaaaagattcttctttgatcgatacgcttaaaacattgccagacctattaaaaggagtagatgaatctacgaaaaatctagcctaccttacttgtgagcaattagttgtgtcattagctgatgaggaagaattgacgacgaatgttgatggagatgaaggggataaattacctgtgacaatcaaagtattgccctcacatttacaggtttattgttaaaatggaggttgtgaccgaggagttggcgggagaacaccgcttgttcgggataagggactgtgacaagacttttgtcacagccttttttttgtacaaaaaagaaatttacacctaatagaaaaatttttccataaaaatacatattttaaatatgaaagtacaattggaaatagattaaaacgataaaataaaattgtcaaaacgtcagagaggatggtggagaatgaatcaatgtgtaaaaaagctgattgcgtcgattttgtttgtcttccctctcttgatggtgacatccgtttttgccgatgtagagaaaacaaacgaatcaacgcaatcagagaatcaaagttttgacaagactactttttcagaagaatcgattacttctgaaactacagaatctcaaagtgaggcttctactaataaaaggcaagaagaaaataagacaagtgagacctcagaagtagctgaacaaacgtctgatagcagtgaagcggcactggcaagagctgtttcagcggatgggtacagcgaagctgccacaacagaagaactggcgcagcttctcgcagacgaatcagtaactaagatccgactgattcagcctttgactttagacagggaattagagatcaaacgagatatcgttattgattttggtggattcgctcacaatttcggcacacaccatatttatatcaatgagatacctcagtcgatcgagttccagaattttaaaggaacagctgcacatccaggtggattgacaccaaatatcgatggaaatgccattatcattgcttatatgaccgatttttggggaagcagatatcattttacgggagaaataaaatttaccgggacacttgatttgtatgatgggtccaaattaggactgatttacgctcctcgtgcaactgtcacattagatggtgtttccggtgtgttggatgtccaaccagtgaaggaaggactgaatgccgctccgggtaaagcctatttttgtagaagctatcaattgaatgtgatcaatggtagtcaactttatggaccgtatctagggaaattctacggttttctagattcaggagatgagactggtagtggaaaaacagcgccaggaatccatatcttaagcggttcaaaggtctctcttgattatgatcgggcagatggcgttagcgatgaaggagaggcagtcgatacgctacctggtaatgtcatgtttgaagtcagtggttcgggaagcgaattttcggtaaatacaaagatcaatattaccaatgacaacaatcgcggaatcatccaaatgagaggttcaggatcgaaagtcactgtatcgaatggtgggaaaatcaccatcaatacagcaactacgggcggatttcgcttgcaaggagattctagtcaaatccatgtatcaagtggtggacaaatctcggtcaaaatggctggagatgacgatcaacccgggaacaatgggatgcgttttgtaggaaaaggcctttctttgatcgtagaaggagccggatcagttatcgacatcgataagcagagtgggcgttccagcgcagttcgttttgagaatggtacgcaaaagctgacagtaaccaatggaggctcattgagggtaagaaatacaggtgatggcaaatcttacgtgaacagactcaatcaaggaaatcaagcgatccaattttatgacgcttctggttttctagaaagtccaggttcagctgattttacagtcactggagaaaaatcaaatatcgatatacgcgcagattccggagcaactgtagatacaactggagatattgatttaaattttacggcaggtgaaaaaacttatttagtcatggtcgggaaaacaggggaagataagaccggcatcatcagtggggatgtgttgaatgtggacttagaatctcctacctattttgatttccaaaacaaacggattggaagcgagaccaatggcataggcggctgggtattccaaggaaatggagattcttctttaaagatcgcccattcagaaatcgctttatggcgaaaaacaggcgcaacattcgataactttgaaaaagacccggattatttttctgatatgacagacttatcgatcaatgggaccgacttaggcaatttcgtatcaagccctagtgcaggtttaacaaatgaatttgctcagacaggtgccggaatgaaaaattataatcgaatcagtgccaataatcagctcccgatgattgaatccttaagagtgccaacgaatgcagataaaaaaatctatgggcatgtcgttgttcccgaaggtgtcgaggcaaagccaagagatgcttggacaggcgaagtagaagtgactttacgtattacttacgcagatacgacgaaatcatctgtagaaattactgctctcacgcaaggacaaacagatgaaaatgaaggggcaggatataacccatggggagaaggcgaacaaggcggcttgttcgaagttcaagtacccaatgatgagagattaaaaacggaggatcaagtgcaagttgttgctgctaaaaaagtaagaggtggccaagaagtgacagaactggactctgccaaaacgacagtcgatgtgattcctcctgaacctgctaatttaagtaccacattgatcaatgcagcttctcgcacgatcacaggtacaggtgaagcaggagccttggtttcattgaaaaaaaatcaagctgttttgtcagaaacaactattgatgatacaggggaatttgttctttctatcccagaaaatcaactttttgcaggagatgtattagaaattgtattaaacgaccaagcaggagaagctactgctaagggtgtgcagaacaagccaagtaccaacgatgaaattgggaatcacaatccaagtgatacgccagttgtttatcatgatgccccgccttttgcacctgctacgaagatcgtagtagaaggtggtctctcatttcttgccccttccaaactcgattttggtcagatcaaagcaactggtttgacacaagaagcatttggccaaatggatatacaggaaaaattatggatttatgatcagcgagaaacgaaaaatccgtggatcttaacgataaaattatctcagcctttcacaaatgatgcaggattttctatgcaggatgtcctatatttcaagaaaggagaggagtatcaattagtgaatgaagaagaactggaaattgtcagaggacaaaattcaacgaatgtgcaagcagattattcagaatatttaaataacggtcgggcgtttaaacttgtcttaaccaaagaaaatcagatagctggtaattactcagcagagataacatggacattagcagatgcgccgacagaataaagatcaaggaggatgattgatgaatcgaatatggaataaaagtcatcgaaacaactgctctttacttatgatccttctccttggattcatcctttggcagacacctgtccatgcctccgaattcaattttgcggtagattttgaattaccggctaatcagattgataagaacaaaacatatataaatgtaaggatggagcctgggaaaacacaggaaatcccctacacggtctttaaccgaacagataaatcagtaacagttgagacattgatccactccgctacgacgaattcaaacggtgtgatcgaatatggagaatcaaaaagtaaatttgatgaaacattaagttatgatatgaaaaacttagcaaaaacagtgggagaaataactgttcctcctcaaagtgcggtcactgagacactttcactgaaagcgccagaaaaagagctggctggtgtggtcgcaggagggatcacgtttcaagaaaaaaaagagaacgtttctaacaaaagtacagttggtgtcgtcaatcagttttctcaagtgaaagcaatcttgatttgaaatagcgaaaaagagtcttccccagatttgaaattaaaaaaagcttatgcggatcaaagcgatggaagaaatgtgattaaggcgaatcttcaaaatccaaatgcttcttatatgttcggcttgactacatcggttgaaatctacaaaaaagaaacaaaagagccttacctttcaataaaaaaagaaaaaatagatgtagcacccaatacaaattttgatttacttgtcccattagaaggaaaaaaattagctccgggacattatcaagcggttgtgaagggtgcttggaaagaaaaacgctggaatctccataccgattttgaaataactgatgatgcagcggaccaattgaatgaaaaggatattgatttaaaaaatcagccagaaacatttgactggcgatggctgatacttgttggagtcattcttattggcttatttgctggattatttattttaaaagaaagaaggaaaaagaaatgaaaaaaacaattgcattaagtaccgttctagctggaagtctattattatgtacacaaagtgtttttgctgagaataagagctcagccactacagaaggaacgatttctgtgaccaaaccagatgctgcaaatcctgaagacgttgttccagttcctcctgttgatccaaatgatcctgatactccttttacacctgacgaaccaaatcagggaacatccggattactgacgattgaccaagctccagatcttgattttggaacaatcaagttaggtacagcaaaaacagtatatgctgcattacaaagcggaacggacagtactggagcacaaacacaagtacagaatttcgtacaagtaacggataaaagcggaaattatgccggttggaaattatcagtcaaacgaacagaatttattggtacaacatctgatacgaataaactaactggttcaaaggtgaaattcaaaaacgccgtgattcgaaatagcgcaactaatagcagtggaatgccatctaccgtttctggaactggcgctgaaggaatcgaaatcccagcagatcaggcagtagatctagtaactgcaggagcaaatgaagggattggcacatggatttattcattaggagagaatgtggaacaagggagacaatcagtggaattatttgttcctgtatccaattatgctgtagacaactacgtttcaacattcacatggtcgttaacagatgctcctacagaagaggaagcgtaaaatcatatcaacgatttcagggagtggagccgattcaaggcccactccctgaaatctgctatgcttacgtctcagctcttattcatcaactcgaagcagttttttggaagtcatggaaacgttcctttgtcttttcaaagatctttcgaccaacgagtaaggagtcaccgttgaaaaattctaacacataatgagcagaatcaattttctgcaattgcgataagttgatacagtaagattttaaaagtaaaaagtaagcatacttttctaactctgtcttcaattgttttaaagaagtattcactaatttatcttctgtagttgttttgaccataacttggtttttcaaacctttgatactttcaatatataaaatttcccgaggatacaggacgagacttccacctttttgatcaataaagattttatcgacatttacgatctgctgttctttccaattgatctgttctagcacttgacgaatttgttcagataaattcctgtcttttctgatatatccaatcggaaggattttccgattgatgatctctactgcaaaattcgtataagcggtgaaaaaaacaatattactatgtgcattttttttacgtatttgttcggcgacatcaatacctgtgagtgattgcttcaagtcgatatcgataaagaaaacatcgtgattatcaatagtgcccaactggatcaactgattgatttgagagatagaagtgagctgcacgatattctcgatatgatgattgaccaattctctgatgatccattcgctgtgaaactggttatcttctatgataaaatactttttcatatgcaggctcctattaaaaaaatatgtgtacattttgaaacaaaacaatggaggaataagatggtcgcaacagtgacactttatttgacctttactttgattttagatttaggtatctatttattcttttcgaaacaactgctagtaaaaaacagctttggttgtatagctttgatggtggtgacacttttacttcctatccctaaagtgagctttccttacctagttggcttattattgatgtttcttttttattttactacgaaaaacctgtttatcagctgtttgatcagtaatcttttttttgctatcactggactcagcttttttctggtttttgatctgatggattatttaggaaagagacatcttggaacagcaagtttttttgcactacttatcgcatttattttctatctattagtaaaaagtatagacaaacagacgagatttctcaacttgctttttacttatccaactgaacactattttggaggtatttgtattttattaagctggggcgtgatttacttggtattgggaagtgttcacttccgctcatctaattatctgcttctatctcttttgtcgatagtcatcagttttttttctttgtttttttccattatgttgatcagtttccaagtaaaagaaagacaacatcaggaatcgcttcaactgtatcaaataaatgaagaatattaccatcatctagaggaattcaaacatgattataaaagtctactgttttcattaaaaattactcttcaggaaaataaaaaagaaacgttggaatttttagaaatattagaagatcattctgcagctatttttgaaaaaccgcaaatacaacagctaacaaatattgtatccccagctgtcaggggtgtctttttaaaatttctagaaaaagcagaatcggagaaaatcccgatccaagtagttattcctgtcgaagtgaaaacaatcccgattgatctggttgtttttattcgctgtttatctatttttatttctaacgcattcgatcatcgtgtagccgatcagagtccgattacgatcaatctgctggaagaaaaagagggatcacgttttagtatagcgaacaaggcaaatccaacgaatttgacgctatcggagatggtcaaaagaggaaaaacctctaaaaaaaatggcgggttaggtctatacagtgcgaaaaaaatgttggatgtttacgaaaatgcagaactaaaaatcgaattttcaaaacagaatcactatttttttgtagaaatgtatctggcatctagaaagagcaaatcagcctactgacttactgtcaaaggataagtttgaggaaagtctacacggagatagagacaacaacacagcatattcaaaagaaacagaagcgtgatgaccgttgtcacccttctgtttcttttgctatgtagttaaacaaagtagttgacacttccgctacttagtattagtacgaaagtatacttcatgatactaagtagataagaagtgaaaagcggaacccacgatcgtcaaaatgctaactgctttgcttacaccagataaagggaagagcaatatcgcttattttaggcgtggagaagcaagcaaatccctacgatcacaaaaaaaatgctgacccagcagttaagagagttagaacaagatgaaagtatccatcgaaaagcctataaccaagtcccgcctaaagtagagtactcgctcaccgaagaaggaaaatcattaagagagattctagtagcgttgtctgtttgggaagaagaacgtatcgaaaaacaaaaagcctcaagggaagaagacacgctactgcatacacatggtggctacctaaattattgattttctatgacatttattttaaataaaagaaaacaggagtttttttaaaagcatcatctattttttatgtaaaaaaatggtatgattaatcaagtaagaagtgattggaagaaggcaagcaaatgaatagtatggaaaaagtcaaccagtttagagatgaacgtaattggcgacaatttcataacgaaaaagatttggctatctctatttctttggaagcatctgaattgttagaactttttcaatggaaaacgccggaagaagtaaaagaaacacaattagaacgaatcaaagaagaactggcagatgtattgatctattcatacatgatggcagacaaccttcacctggatctagatgagatcattgaagaaaaattgatcaaaaataatttgaaatatcctgtagaaaaaagcgcaggtgtacgaaaaaaatacacagagttgtagaaatgtgtcattcggctgttggaaagagcaaaagaaaaacagtaaaatgagtctggagggagagaaaatgaaaaaaaaaggaaaagcaaaaagatggctagtcaatatcctcttgttcctcttgttattagtaggactagctttgattttcaatgaacagatcaaggattattttgtcagagagacaggagataaatatgctatagcgaatgtaacaaaagaagatctgaaaaagaataacgataaagatgtcagttttgactttgatgcggtagaaccaatgacgacagaaggggtcatgaggtcgcaaatgagaggaacagatctaccagtgattgctagtatcgcagtcccttcagtttcaatcaatttaccggttttcaaaggcttggataatacgtcactactttacggagcaggaacattatctccagatcaagaaatgggaaaaggaaattatgccttagcaagccatcgtgcaacgaaccctgaattgctgtttacaccgctagaaaatttagagatgggtgccaagatctatttgacagatttagaaaatgtgtatacatacaaaacattttttaaagaaaaagttgctcctacagatacccaattactgaatgaagtcgagggaaaagaaattgtcacactaattacttgtggcgacatggacgccgtcacgcgactagttgtacaaggagaactggaaagtgttacatcgataaaagatgcgacagatgatatgagatctgctttcaatctagagacaaaaacattttaggatactgggacataagtcgttacagattaaaaacagccaaaggatatgaatcgataaggaaaaaccaatttgctgaaaaaaagagaaacgcaaagaggtgcatctctgatttggttgttttctagatagacttgtgttccagtttttttattttttatatgaaaaggcttgcataaataaaaattcgatggtatgatgattttgaataagaaatggattgttactgtacggcaggcaaaaccagaattcagctaagaaacagtaggcgaattctaggtttttttatttttcttgagagggcgaagcaaaatgaaaattgataaaattttgaataacaatgtcgtcatttcgaaaaatggattcggggaagaagtcgtttgtatgggaaaaggactagcttttcaaaaaaagattggggacgagatttcgccagaagcggtccaaaaagaatttgttttaagagattcttttgctaaaaaccaattccagcagctgatggctgatattccggcagaggagatcgaatgggtcaaacaagtagtcgaactggctgaagataaactaaaagttgaattttcgcctaatatttatctgacattgaccgatcatcttcattatgcgatcacacgagcaaaagaaaatatccaactgcctaatccattattatttgaaacaaaaaaattttatccgaaagaatatcaagcagcgaaagaggctcttttgttcgtgaaacaaaagacgggtgtggaactttctgaggatgaagccggttttattgcctttcattttgtgaatagccaacaaggaaacgaagacatgcaagtgacgatgaccgctaccacaatggtaagagatatactgagtatcatcagtaaattcttcggcatcgtgttcgatgaagaatctttgaattatcagcgtatcattactcatctgcagttttttgcccagcgttatctcaaaggggaaggatctgacgagcaagatgaatttctctacgcattagttcaaggaaagtatccaaaagcgtttcattgtgtcgaacggatcaatgagtatcttcgacaaacgcaaaaacaggaaatggggatcgcagagcagatttatttaacgattcatattcaaagagtagtaagtgagaaaaaaagcatccaatcataaggattgttactgtatggcaggcaaaacctggattgaaaaaataggttcacgaatgtttgtgactgtttttttcaatctgggtttttattttttaaataaaaaagaaagaaggaaaaaacaatggataatcaagcagttggtcgtcgtgtatgggaagcggtaggaggacaaaagaatgtcaaaagtttagtacattgtgctacgcggttgcgattcagattaaaagatgaatctttagcagatacgcaaaagttaaaagaagacccggacgtgatccaagtcgtacaaagtggcggtcagtatcaagtagtgattggcagtaatgtagcagatgtttatcaatcgatcgtggatgaggaaggtcttgcagtttcggaggatggaaaagaagagtccaaaaatattttgaatcgtctgatcgatattatctctagtatatttacaccttttctaggggcgatggcagccgccggggtattgaaaggattcttatcattggcaacggtgatgggctggctgacagctgatagcggtacttatcaaatattgtttgctgcagcagatggtgtctttaccttcttacctgtcatgcttgcttttacagcagctaaaaagttcaaagccaaccagtttttagcagtagcaattgctatggcacttgtgtatccagctatcacagcagttgctggtgcgggagaagctatcagtttctttgggatcccagtgattctttcaccatctggttatacttcttctgtcataccaatcattctagccgtatgggttcaaagtaaattagagccattcgtaaaaaaagtgattccgcaatttctgcaaatgattttagttccgcttgtcgttttagtagtgatggttccattaacatttcttgctttaggaccaatcgggacggttgccggtaatgctttaggcggtctcttcaactcgatttatggatttagtccaatcgtagcaggtctaatcatgggaagtttatggcaagtattcgtgatgttcggcatgcattggggattcgtaccgatcatgtttttgaatatcgaacaatatgggtttgatgtattgatgccaatgcttcttccagccatctggcacaaggtggggctgctttagctgtagcattgcgaacaaaagatacgaaacttcgagcattagggatttcttctacagtgacttcgttatttggaatcactgaaccaactgtgtatggtgtgacattacctttgaagaaaccattcattgccgcttgtatttctggaggtattggtggagctattatcggattttccggagtaaaagctttctccagcagtttggtcagcttattgacgattccgactttcattaatacggtggatggtgtagagtcaaatgtgacagtagcagtaatagctacaggaattgcttttgttcttgcattcgtaggtacattgattttaggatttgacgaacaaacacaagacaatcaattagaaaacaaacatgcgaatgcaggagaaccgattacttcagcacggcataccttaaaaagtcctttaacgggtaaagtactgccattgagtgaagtaccagaccaagttttttcttctggcgtgatgggaaaaggtatcgctattgatccagaagtaggagaactagttgcacctgcagacggagagatcacgactatttttccaactggacatgctgtagggatcacaacgactgacggagcggagattttgattcatatcgggatggatacagtagaattaaatgggaatggctttgagatcttagtcaaacaaggggatctcgtcaaagcaggagatttattgattcgttttgacatcgaagcaattagagcagctggctatagcgtaatcactccagttgtcattacgaatactgatgcatttgccgatatacttgaattagaccaaaaagagattattgcaaacgaagatgttctggcaattgtaaaataaggaggaaatcaggatgcaatcacgtttttcagaaaaatttttatggggtggagcaactgctgccaaatcaattagaaggggcttatgatcgagacggaaaaggactatccgttgcagatgctatgcctggaggtaagcagcgctttgcgattatcggcagtgaagaatttgactggacgattgatcaagaaaaatatatttacccgaatcatcgaggaatcgatcattacgatcgtttcaaagaagatcttgccttgtttgcggaaatgggattcaaatgttatcgtttttcgattgcctggacacgaatttttccaaatggagacgaaggtactcctaacgaagcgggattagaattttatgatcagctgattgatgagtgcttaaaatatgatattgaacctgtgatcacgatttctcattacgaaatgcctcttcatttggcaaaagaatacggtggctggaaaaatcgaaaactgatcgacttctatgaacgatttgctcagacagtattagagagatacagcagtaaagtcaaatattggatgactttcaatgaaatcaattcggcctttcactttccagctttaagtcaaggattagtaaaaagcaatggagccaggagagtaccaaaatattttccaagcatggcataatcaattcgttgcaagtagcaaagccgtaaaaatcggccacgaattgcgttcggatatccaaatcggctgcatgattatctatgcaacaacttacagcatcgatgccaatccagtcaatcaggcagcaacaatgatccaaaaccaagaattcaattttttctgcacggatgtccaagtacgtggagaataccctgcatacacagcgcgtacccataaaaaatatggagtcgatccggaaaaattagagcaaacggaaaaagacttccagttgctaaaagaatatccagtggactacatcggatttagttattatatgtctacggcaatcaatgagactgatccacaagcagcaacttcagaagggaacttgctgggaggagtaaaaaatccgtttcttgaggcaagtgaatggggctggcagatcgatccagaagggctgagaatcgcattgaatgaattatacaatcgttaccagaaaccattattcattgttgaaaacggtcttggagccattgatcatatggaagaggatggcacgattattgatgattatcggatcgattatttacgtcgtcatatcgaagcgatggctaatgcagtagcagacggtgtagatttgatgggctatacgccttggggatgtatcgatcttgtcagtgcatcaacaggagaaatgagtaaacgttacggctttatctatgtggatctagacgatgaaggaaatgggacactgaatcgatcaaagaaaaaatcttttgattggtataaagaagtaattgcctcaaatggcgtaaacttgtaattaaagcagctgaatgaaaaagaacacacttctcacatgtgatttgtgttctttttttattttttatgtgctattcttttagtaatagtaaagcaaagggtgacgttatgaaaaggacacgtgtactatacttggaagtcgcagataaaattaaagaagatattttctcaggaaaatatccagtcggttcgatgttgccgacagaaagtgaattagaagaactgtttcaagtcagcaaaatcactgtccgaaaggcaatcgaactgctggcatcagatgaatatgtcgcaaagaaaagtggtcgtgggacgacggttctaagcaatcgtccttacaatcgattatccaaagcggcaagctttacgcaaatcttggagaactcccgatatgaagtccggaaagaaacgctggatttgcaattggtccatataaagaaggaagatcctttgttttcctttttcggtgagcaagctgtttgttttaagcgcttatattatttgaacaatcagccttatatttattttgttcattatcttccacaagaaatgatgcaattcagcagagaagaatttggcaaagaatctttgtatcgtttgctgacgaaaaaaggatatactattgactcattttctgatgatttctcggcagtatttttaacagaagaagaacaaggaattctgaaaacagacgcacagatcggcatcaaacggatacggaaatcgtctacgcaaattggggaaatgattgaatattcggaggcggtctaccatacggagctgcatccttaccatattgattatgaaacataaataaaaaaagaggttgtgaaaaagctgccctgcatcaagtaataagaacagccaaacaaaaatagcttctcatatttttcgtttggttaggcttattaccgcagatacacggctgtttctggattaccatttattctggataagggggtgtggcacgattttcagaaggaatctatgaaccaatcactgtattgattttagcttcgatggtaaccccattcggcttgacgatcgcttatttcttagggaaaatcattcgtaaaaatatactcaatcgtcaagaaatcgatacattgaagaccgcttttcctatggggatctgtcagatcacagagggatgtttccctatcgtattgaacgacttggcacgcaatgtcatagcaacgggagtcggtgggacagtaggtggcggattaagcatgttttggggcgcagatagccgtattccggcatcgggaatgtttgcagtcgctacgatgaccagaccatgggcattcattggtgcattgttagctggttcttttgtcacaggaataaccattttattattgaaaaaaccagtagatccgaatgcagaaatcatccaagaagaaaaagaggaagaagacatatcttgggatgatttgacaattagttaggagaggcagaatggattacaagaaaaaagtacaatagatgtaccttgaggcaggaatggtatgaaagaatcagagttagaaagaatcgaatatacagattttggtttaggagcgatcgaaactgtccagagcatcggcaccctccttgaaatgacgatgaaggaaaaatgagaacctttcgttgtcgaaagggtctggtataccttatgtcgaaggaaaggaaacaaaaaaactttcctgtactattccaaaaaggaaagaaagttattatacagtaaaaaaagaaattattcttcatgctagagatcagtacacgttcgagcccaatatcaaacactagttccaggcaggcgcaacaggtgcggttatcactgaattttcttccagcagtgacgattcaagtgatatttttacaaatccagctatttatcgttaacaaaaagatttttaggagaagctgatgaacaaaaatgatcaaattttgatcgtttagttcgtcggcttttttatttagagaaacatcatttatcagtgaaacataacacgagaacaaaatgattttttcgttaataaaagaaacaagtatttgttgtttaaaataatacacgttattggcatataggacgaaatcccagtatcttctataagtaagtcatttcatatcgatgaaaacacgttatttatttttgttttatctataaaatggctgaaaaatgatttttttctaaatactatatatagtggcgtctatcctatataccactaaaaaactacaaaatctagtcttttattttaaaaaaacacgtgtagaatgaagatagacttttgagttagggagtgtttttttatgaaacttactgttttttgcggttcccgttttggtaataaagaaagttacaaatttattgcgcaaacgttaggaaaatacatggcacaagaagaaatcgaactggtttacggtggttcatactccgggattatgggagtgattagtaaaacagtactggaaaataacggaaaagtcacaggtatctatccgaatgggctttttgaaactgaattgcctggaaaagatgttactacatttattcctacagaaacgatcgatgaaagaaaggtattattatttgaaaagggagatgctgtcctcgttttccctggaggtctaggtacattggaggaattctcacaacttctttcttggatagcaatcggtctgacgcccgacaagccaatcggaatattgaatattggcggttattacagcggcttgcaacaattattagaaacttttgcaaaagaggattttatggataaaaaatggttggatcaagtaatcttttccaacaatccattggaactggtcaatgaattacgagcagtatctattaaaaatcagttattattgaaggaggcaaaataatgagtcaaatatatttagcaggaccatttttttcagaggagcaaatcgatcgagtaagtcgtatcgaaaaagcgttggaggaaaacaaaacagtcacaagtttctactctccacgtcatcaccaagaaagcaattatgaactattcagcgctggatgggcgcaggaagtatacgaaaaagatatggaagaactgacaaatgcagaatttgttgttgctatccttgactttgagcatcaaacaatcgatccaggaacggcttacgaattaggtgtggcaactatgttgaaaaaaccgatgatcattgtacaagaagagacggtacctacgaacttgatgattacacaaagtctccatacgtatttaaaatcagaccaagctgtacgtgaatatgattttgaaacattgcctgttgaaacttacgtaggcgagtacttatagaagaggaagggttgtatgtcagtgattttgatttcaggaacgattggtgcaggtaagagcagtttgacggatatgcttgcaaaagagattgattctaaaccattttatgaaaatgtcgaagataacgaagtattgccgctcttttattcaaatcctgagcagtacgcttttttattgcaaatcttctttttgaacaagcgatttttagcaatgaaaaatgctttagtgaacgatgacaatgtgctagaccgatccatctatgaagatagcctgttgttccatctaaacgctgatttaggtcgggtaacggatatcgaagtacagcagtacgatagcttattagatacgatgctaaacgagttagatgatgttgctccaaaaaaacggcctgatttgatggtccatatcaaagtttctttggacacgatgctagaacgtatcaaaaaacgtgggcgtgactatgaacagctagaaagcgatgagacgttatatacctattatgaaacgttgaacacccgctataatcaatggtatgaagattttgatgtatgtcctaaaatacaagtggatggggataaattcgattttgtagaaaatccagaagatgcaaaaaaggtgatccgtcagatccaagaaaaattagctgaattggaaggaaagcctgctggaaaatattttacggataaccagcatgcaaaaggtcaagaattaggctaaaaataaaaaaccaaacgacgggaaagaaaaattactacgtgatgtagaataagcctttctatcgtttggttattttatattcaaatatttgaaataaataaatctttactctttgatttgtaaactgaaatgatccactgtttgttttactgatgaagcttgatcaaaggaagaagctgagtttgaagttcataaaaatcagccatagtgagttttgcttggatttgtttatcttcttctactttttacataattttgaacaggataagattcaaatgttttaaatgaatctttgactagtttgtgacagttgtcgcatatgctcaagcttccttggtcattaaattctgtatggatatttttgttgttattacatgtacaataatcaggactatcgatcatccatttcgtctcctttacaatcatcttgcttctttactatagcagaaaagaaggggagaaacaaaagaagatccaacagacggcactatagactgtagatgttgccatcctcatccttcaaacggtaattaccgatttttgtaaatatgactgttgtttcttttttattttcttttcctgaaataatatattcgtcatctttggtagtgatcttgatatctgtcagcactgttttttcttcagatgattcagaagaatcagttccttgtgtctgatacgtgcgtgtccattccatttttttatctgtaaatgtcaactgtcccgcggataaatccatatctttacgtacttttagcgtatatacactgttggtggtatctgctttttccgcttttaagacagaagaatcggttgtttcgtccgaggattggtcagagccgccaaacaaatcacagccagtcaatgtcaaaagtcccgcagacaaaataaatagtacgattaatttcttcaaaatacttcccccatttgataggataaagaaattataccattggaatgtaaaacttcaaacggatggaagagaaaaacgcacaaaacacccacaaatagagtaaattttagaataaaattttaaaaaggcaaaaaatccgccactttcagaaagcgttttaaaaaagtgttgcaatcttttaaaaaaatgctatattaaaaatgaaccggttcaaatacttgtttaagtataattaatagtgagaggaagttgctctactgaagactttagttatatggatattgatgacaagcaacactatgcaaagaatgcggtcatcataatcgaacaacaagaaagagaaatcaaatgtaactggcaggagtgagaatgtatggcatcgatccgtgatgtggctaagatggctggtgtttcagtgggaacagtttcccgttacttgaatggtcagcaactgaaggaaaagaacatgaaaaaaatagcagaagcgatttcagcgttggactataaagaaaacatcattgctaaagggttgaagaataatcgaagcttctctattggacttttgataaacgggatttccagccgttttgggtcggaagttgtctcagggatcgaaagagtagctgaagaaaatgggtatagcttattattaagcgggtttgccgatcagccagaaaaaattgaacaaaaaattgaatacctgatgaagcatgtgatcgatgggctgattgtcttcttatccgaagaagagtggtctggatttgaaatgctcacaaaaatgagtattccagttatcgcattgaattgtccagaaggaccagcaggtattgatacaatattagtgaatgatcgagaaagtgtagcaaaagtgatcgctcatcatggtgaacaaggacataaaaaaatcggatttattgctgccactcaaacagactacgtagcaagagaacgtttagcaggagccaaagaagcggtccaaaatgatccatcgatccaattagaggtctttacaggagactattctagaaaaagcggctattacggggcaaaagcattattagaaaaaggggcaactgctatttttgtcagcaattacaatatgtcgattggtgccatcgaatgtttcaatcaagaaggtgtcagaatcgggaaggatattgcgttcagtcactatgattatttagataaaaacgatctgagtatccttccgaaaatcacgatcacgccaccaacagataaaatcggggaacgagcagcagaacagctgttaaaacgaatcaaaaaagaagaggaagaaaatgaaaaagtgattgtgatggaaaatatcatacatggaatcaactaaaacgaactaaaaaagaaaaagaggtgctttgatgaaaaaatatcaatttccagcaaatttttggtggggttctgcagcaagtggcccacaaacagaaggaaggatttcaggcgatggaaaaggagagaacatttttgattattggtacaaaaaagaaccgcaaaagttctttgatcaagtaggacctgaaaaaacctcgcaagtttatacgaagtatcaagaggatgtacagttgatgaaacagactgggcataattcatttcgaacatctatccaatggagccgtttgatacctgatgaatctggaacaatcaacgaagaagccgttcgtttctatcatcgttattttgatgagttgattgaaaacggtatcgaaccctttgtgaatctgtatcatttcgatatgccgatgtatctgcaagaaaaaggcggatggttgaaccgagaaacggttgaagcctatgaaaaatatgccaaaagttgttttgaattgtttggttcgaaagtaaaaaaatggtttactcataatgaaccaatcgttccagtcgaagcaggttatttatatcgatggcattatccagaagagtcagatatgaaaaaagcgatccaagttggctatcatgaagcgttggcttcagcgttagccatcaaatcttaccatgaaatggagcaaggtggtgttattggtatcatcttgaatctgacaccaagctatccaagagacgaatcaaaccctgaagatgttaaagcagcgcaaatagcagatgcgttcttcaatcgttcattccttgatccagctgtaaaaggcgagtttccaagtgaattgattgagatagtaaaagaacttgatctcatgcctgtgatccatgcagaggatttgacggttatcaaagaaaatacagtagatcttttaggtatcaattattaccagccacgccgggtaaaagcaaaagaaacaccaatcgatactaaaaacggtccaatgcctgaggattatttcgacaattatgaaatgcctggtcgtaaaatgaatccttatcgcggatgggagatctatgaacaaggaatctatgatattttgatcaatgtacgagatcattatggaaatatcgactgctttatttctgaaaacggtatgggtgtagaaaacgaagcacgatttatcaaagaagatggcatgatccacgatgattatcggatcgaatttgtccaatctcatctgaaatatgtccatcaagccattcaagaaggtgccaattgtttaggctatcatatgtggacatgtatggataactggtcgtggaccaatgcatataagaatcgatatggctttatttcagtagacttagcacaagatggaaaaagaacaatcaaaaaatcgggtcattggttcaaagacgtatcagataaaaacggatttgaggcttaagaaagaatagttgagagcaaatgcgtgaaattctccattcttaccattttgtgaaaaagaagttcaattatttacgatctttttcaacttttttgtctttctatttcattttttgtatataatagaatagtcaaaattaaataggagtggaggaaagcatgaggaaaaaaagaccgtttcttctcttttggttattcggttttttcttactgcttattttatccgcagcattttcaggaaaaatgacagcagatcttgctcagaaagaaacagaaaaaatcgtagcaagcaaagaatcagtagataatttcaaaaaagaattctcaacttattggtgggcggagtataaaataactgccaattacgaaaaaggcgaattggacatttatttgccaaaaggaaaagaagaaaatcaatttattaatatcgatgacgtacttagtgcgatttctctcagacaatatcaatttaaagacaagcatttgaccgttttgcttttgactcatgatggcgacaaagtagcccgtttgaaaaatggaaaagtgatcaccgcttattctgaaaaagtagacaaaaaagtggtcgccgatcgtttagcggaatggaaaaagacaaatgaacaagtcaagaaaacaactgtctcttctcaaaaaaacgagtcgacaggaacaagtccttcagattctggcagtggacaaacgataacgggaagtgaagaaaatcaagcctcaattattacgaatgagtcatcacaaggacaatatcaatcctatggacaatgaaaaacagaggttgtgaaatcagcgttttgacctgagtattagagaaacaaacggcaaaatagttcctcatattttgccgttttttgagctaataccgaaggtcagctgattgaacaccgtgtatcaagaggtcttgagcctgccgtttaactctgagccacaaggagcaatttcaaaaaatagctccttatatttttcgtttggttgggcttattaccgcagatgcaagcttttgaacaccgtttaccaagaggttgtaaaattagcgtcctgacataatctaataccgagggtcagctgattgaacaccgtgtatcaagaggtcttgagcctgccgtttaactctgagccacaaggaacaatttcaaaaaacagcttctcatgttttataaatattgtgacttgtggccgaggagttggcaggagaacaccgtttaaggaagaagttgtgaaaaagctgtcctgcatcaagaaataaggagctgcgacaagaattttgtcacagcctctttttttgtacgaataccgagaaactggcttttgaataccgtggagtgaagcggtcaccacaagacttttatctcttcattagtttaatcgcttacatcgcagcggttttatgctgtgaaaagtggacggaataatctttagaaagaataaaaaaatcttaagataacaacttttttaggaaattttcatttttcaggagcaaaataagaaaaaatgtgaatagagagaagtgatatacgtgacacaacttaaaaaattgtgccaaaatcgtttagcaatcgttttgacagctgttttctttttctggctgaagacgatcattgcctactatgcagatttttcattaggtgtggaaggtacgatccagtactttatcttgtggatcaacccaattgcgactaccttattgttttttggcctttctttgtatattaaaaagccaaagccagcgttagctattcttttgatcattgatattttaaatacgcttttgttgtacttgaatattattttttatcgggaattcacagatttcattacagtcaaatctgtattaggcttttcgaaagtgtcgcaaggattgtcaggaagctccttttctttgatgaagccccatgatgtcatctactggctggatatcgctgtgttcattgggctactggtttggttgaaggtcaagaaaatacctatcaaaagcaaccctgtcggcaaaccgatggctatcgctgttacctgtctttcagggcttattttttcaggaaatctagcgctgagcgaagccaaccgtccacaattgctgcagcgaacatttgaccgttcatatattgtcaaatatctaggaatcgatgcgtatactatttatgacggaatcaaaacaggaatgactagcagtgttcgcgcgcatgcaagcagtaatgggattgatgaagttttagattatacaaagaaacattatgcagagccaaatcccgaaacatttgggatcgctaaagggaaaaatgtgatcgttctccatttagaaagtttccagcagtttttgattaatatgaaggtagacggacaagaagtcacaccgtttttaaatagtattttccagaatcaagcaacgatcagctttgacaatttctttcatgaagtaggacagggaaagacaagtgatgctgaaaatatgttggaaactggcacatttggtttacctcaaggctcattattcacagaacttgggtcagacaatgtctttcaagccgcaccagcgatccttggacaaaagcaaggctatacaagcgctgttttccatgggaatgtagctagtttttggaatagagatcatgtatataaaaacttaggttatgacaatttctttgatcgatcttattttgatgaatccgacgaaacgttaggttatgggatattagataaagatttattcagagaatctgcccaatatcttgagcatctacaacagccgttttacacgaaatttctttccgtaaccaaccacacgccttattatacggatgacaagaatttcgactttccatctttgaatactggcaatagcacagtagataattatgttcgaacggcacattatctggatcaatcattggaacaattttttacgtatttgaaaaaatctggtatttaccaaaattcaatctttgtgatttacggggatcattttgggatctcgaatacagataataaagatttagcaagcgctcttggtaaagatccagatacatgggatgaatttgacaacgcacagatgcaacgagtgccattgatgatccatatgcctggttatactaaagggacagtcaatcatgaatacggtggagaaatcgatgttttgccgacattactacatctattgggaatcgatgataaagattatcttcattttggtacagacttattatcttctcagcatgatcaagtagttgcttttcgaaatgggaactttgtgacacccaaatacaccgtcctaggaggaaaagcttacaataatcagacaggagaaatcatcgatacgaaagcagcaggaatcgatgaggaaatctccaaagatcaggaaaaagtcaagactgcgttaagtctttcagataagctgaatcaggaaaatctcttgcggttttatgtgccaaacggatttgagacgattgatccgaaaaaatatgactataaaaatgaagcggaacgtaatgaagcaatcgaaaagcaaaaaggcgaacattcgacaagtgtcttttcaaaaaatggtaataaaacaacaaccaacttatatccagtaacaagaacagacgttgaacagcaaaaaaataatcaataaacaatcaaaccaaccttcagtagttagacaacattctaatgcttgaaggttggtattttttatgaaaaaaacatttttttatttttttcgtgtatttttcctttttaacgtatctatttattgaatgtggaaaaatttaaattaaaaaggagaactattatgtatgatggtgaattgatcaagaaacttcgagtcaacaagaagttgacacagtcccaattagcggaaggaatctgttttaagacttctctagtcgggattgagacaaattcagtgaaaaaaatgtcatttgtaacattgagatcatttttagagcgaatgaacatgacacttgcagaatatgaatggatgcgaaaccagctggatgaaccaataaagttaaagaaaaaaagacgaatgctagatcgggtacaagaagacagctttgatccttataaagagatcagcaataaccgtaggcattttaagaaaacagaagatctgtattatttggttttgaatcttcacatggtcgaaaaaacagaagtatctgagacagaatttgaatttttacgttatgaatgccgaatcattgaagaatacttgatgcagataccagactatggtcaatttgaactatctattctagctgattttccttggatattcagtgatcggttcattgagaacaattatttgaaaatcaaaaaaagaatgcgacgattagcacagttgaacaatcatgagcagtatctctttacttttttaatgaacctgacttcgttttatatagaaaatggtcggttgaaaaaggcacgtagtgtgaatgaagatatgaaacggagcttagcacataaagaaagaagtacagtgatctatgaaacattgatggcagattattatcaaagattgatttctgctgctttaggggaagaaaagacgaaagactaccaagaattcttcacagtgctcgaatatatgttaggaaagaatcaacggaggtccttagagaaaaaactgctggccattgctgaacccagcaactagaccagcagtttagaatttgtatcacttcgccgctttttcagacggtttgtttatatcgaatggcgggaaaaagcgggcgatctcttttaccgcagcatcacgggaatcagaagcgtgaatgatgttttcagtccccggcagcgcgtagtctcctcggatcgtacctggaacagcatcggcagcttttgttgctccaaccatcttacggacgatatcgatcacttcctcgccgaccagcacaagataaacgacaggaccggaagtcatgtaatcgatcagttcatcaaaaaaactgcgctcagtcaagtgctgataatgttcttttgctaattcaggagtcatagtttcaaacttcatttcagcaatggccagtccctttgcttcaaaacgttggatgatgcttccgactaaatggcgtctcacgccgtctggcttgataataacaagtgttctttccataacagcacctcgtttcctactatatttctattatagcgggaggtggaaaatgagacaaataaaaccgcgtgagacaggaatataacgtgtgtattttaaaaaaagtatgaaaaacatggaaaattgatttgacatcctcttttttagttgttatattaacgaaggaaaaccgaataagatttgttaggtgaggctcctatacaaacataggctactgcccaaaaacgtcgagagacgccaatgggtagaacaggaattgtcgagataaggcttttcataaggtagctaaaagcaggtatctgctttttacgttgtacagtgtcaaaactcaacgatgagatctgagaagctttttttaatatgctttttcaaacctttcgctgagtatttggcgagaggtttttttgttgccgcaaatccccatcggtgaaaaataaaaaggaggtggtctaattggaaaaataactattcgaaaaatgattggaagtcatgaattaaaattacttagtaaaggagatgagaacaaatggatgacagtcattcgaaaaacaaggatctagaggaaaggccagggctattatctatctgttctcagcccctttcagttttttctctatcgatccgatgaatagctaaagaccaaaagcagcgagaacagctgtcttttggacacaaaggagagattgagatggaaaaaaagaaagatacacaaaaaatctatgcagcttttgctggaaaaacgaaacaagaattatttgaactattccatgcatcagcaaatggattgacagaagaacaaatcgaacgttcaagagaaaattacggtgaaaatgcgatttcatatggcaaaaaaacaccattcattgtagaaatattgaaagcatacatcacgccatttacattagtgttgatcgcattaggaattatttcattcatcacggaatatgtattagcagctcctggagataaagatcttttcggtgtagccattatcttcactatggttatcgtcagcgggacaatgacgttgattcagtccgtacgttccaatcaagcggctgaaaaactgaaatcacttgtgaaagtaacggcagctgtaaaacgtaatggaaagtacacagagattcctatggaagaaatcgtctgtggagatcttgttcggctttcagcaggggatatgataccagcggatatgcgtttattgtccgcaaaggatttattcatttcccaagcagcattgacaggggaaagctatccagtagaaaagcatgcgaaagtatgtgaagacgatcagcaaagcgaaacaagttacgaaaatcttgtctttatgggaagtaatgtcatcagtggaagtgcggaaggaatcattgtttctgttggaaatgaaacactatttggtcatgtagcagaaacgctatctgaaaaaccaattcaatcaagctttgaattaggcatccataaaacatccatgctactgatcaaatttatgtcattgatggctccagcagttatcgtcatcaatgggcttacaaaaggggattggctagaagcttttctttttggactatctgtagcagttggtctaacacctgaaatgcttccaatgatcgttacgacgaatttggtcaaaggagcaagtgtgatggccaaaaaaggaacagtgatcaaaaatttgaatgccatccagaactttggtgcaatcgatgtgttatgtacggataaaacggggacattgacacaagataaaatcattcttgaatatcatatggattgtgaaggaaatgaagatgatcgtgttttgcgccatgcgtatctaaatagctactatcaaacagggctgaaaaatttgttagatgtggctatcattgatgaagcaacagaaactttagatacagataagatcaattatcaaaaagtggatgaaattccttttgattttgaacgtcgtcgtatgagtgttgtggttgctgatccagctggtaaaacacaaatgatcacaaaaggcgcgattgaagaaatgctgaacatttctaaatttattgatcttggcggtactgttacaccattaacaaaagaacgaaaagaagccgtacttgcaaaagtacagtcacttaatgaagatggcttacgagtgattggtgtcgcacaaaagaccaatccaagcgtcgttggagaattttcagtcaaagatgagtcagacatggttttgattggttatcttgctttccttgatccaccaaaagaaacaacgaaacaagcgttgaaagctctgaaagaacatggtgtagctgtaaaagttctgactggggacaacgaattagttacacgttcagtgtgccgtcaagtaggtctagagatcaatgaattggttaccggtgagaaaatctcggaaatgagtgatcatgaattagcacaagtagctgaagaccatgaagtattcgtaaaattgaatcctcagcaaaaagcacgtttgacgacagctttacgtaaaaatggtcatactgtcggatttttaggagatggtatcaatgacgctcctgcaatgaaagtggctgatatcggtatttctgtagatacagctgtggatattgcgaaagaatctgcagacgtgatccttttagaaaaagatttgacgattttggaaagaggccttctttctggacgagaaacttttgggaatatcatgaaatatatcaaggctacagcaagttctaattttggcaatatgttttccgtgctgattgcaagtacgttcctgccatttttaccaatgctgcctttacaacttttgtttttgaatctgatctatgatgtttcctgcatttccttgccatgggatcggatggataaagaatatttggacgagccaaaaaaatggaatgcatctagtattggggaattcatggtttactttggtccaacaagttcgatatttgatattactacttacttgttgatgtattttgttatttgtcctgctgtagtgggcggaagtttccatacattggatagttcacagcgagtgattttcatcgcattattccatgcaggatggtttgtcgaatcactatggacacaaaccttagtgctccatgcactgcgtacaccgaaagtaccatttatccaaagcaacgcaacatttgccatgtttgttatcactacattaggaattattgtcggttctgtccttccttttacaagttttggtgctgaattaggcttgatgccacttcctggcaattactggttatggttatttgctacagtcatcgcttatctggcgcttgtgacagctgtgaagaaaatctatatccgtcgattccaagaactcttataaacgagaaggctggttctttgcttctgttctttttggaccagtcgtgctaaactatgtgtattgttttggaaaggattaatgtatagatgaaaggtgcaatatttgatttagatggtttgttagttgacacagaaaaaacgtatcgtgatggctggctttggggatttcagcaatttgatatccatatcccaaaagaaatcgttgacgcttggggcggaaaaaactggaaacaaagttttgatattttagtgaaagcagcaggtagccctgaaaaagtacaggaagtccgagcgaagcgtgaagaatatttttatcaacagctgacaagcggagccatccacttaaaaccatatgcaaaagaaatattggcagacttaaaagaacgtcatatgaaactaggcattgctacgaccactgttacgaaaagagcaacagatatcttggatcactttaaattagctgattacttggacacgtttacattcggagacgaagtgtcggagaacaagccttcaccgattccttatctgacagctttggaacgaacaggattagaagctagttcagcctttgcagtggaagattctttagtaggagcaacagctgcttcacgagcaggattaggcgttgttttgatacctgattccagttttgtccgaaattataccgtcgaagaaaaggaaaaattgaaacttcttgcggaaggaaaagatcttcgaactgttattgaaatgttaaataaaaaaacagaaaaataaatatagaaaaaataatttgaatttcgtacttgacttttcagttttcctcatgtagattaatcccaacaacaaaatatcgatttcgttgaaaaggaaagtaagtttggaaactttgcagagaggctctggctggtgagaagagtcaagtaagaaaagctgaaaatggccttggagaataatttgtcgataagtaggcaaattcggaactgttcgaccgttaaaacgaacgccaatctctctttttgagatgttgggcttgagggaaggaaacttccgaaaaaaggtggtaccgcgatacgtcgtccttttactgacatagtttatgttagtaaaaggactttttttttgaatattatttgcattgaaatggtaagtacgatagaagaacctttgacagagagcttcggtagctgagaagaagcaaggaacgactattggaaaatggccatcgagcaattcatcccgagcatagatgtaaggcgatgacggctgcgaccgatatcttgctagagtatgatcgtacttgaagaggagttgtgtgtgaacacagcttgaacatgaggtggtaacacgcaaaaaagcgtcctcaagaaaatgacattttcattttcttgaggacgctttttttagataaggaggaattttaatgattgaattgcgagatgtttctgtatgtttcaaacaaaaagaaaaagagatacaggcagtagattctgtagatttaacgattgaaaaaggcgatgtttatggaatcgtcggttactcaggtgcagggaaaagtacgttagttcgtgtgatgaatttgctgcagaaaccaacagcaggagaagtcattgtcaatcagacgaatctgagtcagctctctcccaaagaattgcgaaaagaaagaaaggccatcggtatgatctttcagcatttcaatctaatggaaagccgaactatttttgacaacgttgatttttctttaaagtattctggaaaatcgaaacaggaacgtcgtcaaaaagtgaatgaactactggaacttgtcggtttggaagaaaaagcatctgcttatcctaaacaactgtcggggggacaaaaacaacgagtagcaatcgcacgagctttggcgaatgaacctaaggtattattatgtgatgaagcaaccagtgcacttgatccgaaaacgacccttcagatccttgcattgttaaaaaaattgaatcgccagttaggtttaacaatcgtcctgatcactcatgagatgcaagttgtcaaagaaatctgcaacaaggtagcggttatggaagatggaagaatcgttgaaaaaggtagcagcatccagatcttcagcaatcctgaagaagaattgaccaaagattttattcgaacagctactcatcttgaccaagcattagaaacgatcattgcccattctgcttttgccgatcagatcgccaataaatggctggtggaattaagttatattggaaatcagacgaacgaacctctaatcgctcatctgtacagcaaatatcaagtaacagcgaatattttatatggcaatgtagagttattacaagaaacgccgttagggagtttgatcgttactttagctggagaaaccaaacagcggaaaaaagcattggattatttgatcaaatctggtgtaaaaataaatattttacaaaaaaacgatttagatagtcgtatcaaagtgatcgaaggaggaagataaaatgactgatttctttaaaacatatttgcccaatgtttatttgattccggatgaatttgtcgaagcgacgaagcaaacactatatatgtctttttggacagcattcattggcgggatgattggaatcatcttaggtgtgacgttagtagtgacacgccctaatggattactagctaaccgtctgctatttgaaatacttgataagctgatcaatatcattcgttccatccctttcattatcttgctttctcttttagcattgactactcgtttcttagttggaacgacgattggtgcgaaagcagctttagtgccattgatttttggagttgttccgttttttgctcgtcaaatcgagaacgcactgctagaagttgatcctggggtgatcgaagcggcagaagcgatgggaaccagtccaatcggtatcattttacgtgtgtatttgttagaaggtttgcctggtatcattcgggtctcggcgttgactatcatcaacgtgatcggactgactaccatggctggagcagtaggtgcaggcggattagggaatcttgctatatcgagagggtataatcgattccaaacagatgtaacgattgtggctacattattgattctaatcttagtttttttaagtcaatttatcagtaatcaactgattaaaaaaattacacattgaaagtggaggagaaaaaatgaaaaaaattattcgttttgtagtcattacatttgtagcaattatttggttggcagggtgtagccaaggaaaagcagatacaactgacaaaaaagaaactatcgtaaaactagggattattggagaagatacagatgtatgggacaacgtgaaagaccgtttgaaaaaggagaacattaatttggaatacgtgaaatttacagattacaatcaaccaaatgtggctttagcagatggatcgattgatttgaattctttccaacatcaattctttttagacaattacaataaagaacacggaactgatttagtatcgatcggaaatactgtcaatgcaccgctgggaatttattctaacactttgaaggatgtagctgatatcaaagacggagcaaaagtagcaatccctaatgatgttacaaatggcggcagagctcttctgttattgcaaactgctggattgatcaaagtggataaggcaaaaggacaagcgcccactgtttctgatattaccgagaatagaaaaaatctagacatttctgaattagatgcttcccgaacagcacgtgctttgtcagatgtagacatttcagtgatcaatagcggtgtagctgtagatgctggatttaatcctgcttctgatgccatcttcttagaaccagtggatgaccatgcacgtccttatgtgaatatcatcgttgcaagaaaagaagatgaaaacaataaaacgtatcaaaaaatagtagacgcttatcaaacagaagacacagtcaaagtaatcgagaaaacatcaaaaggatcaagcgtgcctgcatgggaaacattcgggagaaaataagaaaaatgactagcataggaggaattttttatgacaacaacaatctcaacaaaccaattgaaggatctaatccaatatcgtttaccagaatatcaagcacttgctctagatatccacgaacatcctgaagtaagtaactatgagttttattcctcagcagcgttgattaaacaattagaaaaagaaaggttttgggtagaaaaagaagtagctggacaccgaacagcctttgatgcacgttatatttccaataaacccggtcccacaattgcctttttggcagaattcgatgctttaccaggtattggtcatgcatgcgggcataatttgtttggtacttactccgtattagccgccagcatagtgaagcaattcattgatgaaactggtggagaaatccgtgtatatggcaccccaggggaagaagggggcgagaacggatcagctaaaggcagctttgttcgagaaggtttttttgaggatgtcgatgtagcgttatgcgtccatccagcttttcgttatgggaaaacgacagaatctttagcgaatgatccagtcgacatcaaattttacggtgtcgcttcccatgcagcagcagcacctgaaaaaggagtaaatgctttggaagcattgatccaagtgtttaatggaatcaacgctctacgcttgcaattgccaaaagatgtcaatatccatgggatcattacagacggaggagtagctgccaacgtcattccagattacgctgctggacgtttctatttacgtgcaggaaatcggcaaacattagataaagtatatgaaaaagtggaaaatatcgtacgaggtgctgcgataagtacgggcacgacttttgagtttggattgttccaaaatgcagttgatgatgtcatcgttactccttcttttgatgacttattcttccagcatgcaaaagaagcaggtgttccagatgaagaaatagaaacggaacaaagaacaagtctcggttcttctgatgtaggaaatgtcagccaagtcataccaacaatccagcctacggtagcaatctctgagacatatattgccggacacacagaagaattcaaagctgctgctaaaagtgacaaaggccttgcttctattgcgattgcagcagaactactcgccaatacagctcttgatctgttgaaagagccaaagctattagaaagaatcaagcaagaacatcaagaaatagtagcaagaaaaaaacaagagggcgctactttctagtaaaaaataaacttgtgtgtgaaagttataaaaataattttcagaaaaatgaaaaaatattttctttttcattgacaaatgatcttatggaaggtaaacttcgtacaagtcaacttttcacgcagtagcggttaggtgttttgttcagaaagtcggtggtcgctgtgaaccgatcaagcctaattgacgaattacatggaaagtccatacatttgaataaaagtttgaaagtgaaaaacagatctgtttttaattaaggtggtaccgcggagtcattcgtccttagtttaaaacaggtctttttatttttataaaggaggaatcgcggatgaattgcggcggagtaatccgatatcttaacttttttagaacataagaacaactaaaaaaggagagattatcatgggaaaaaaaggaacaccaagttttttagaagcaacacttgtattaatggttattgttttaggcattgcgattggcgttgtcggattaaaggtctcacctaatatcacgatcttagcagcgatcggaatggtcatgttgtatgcagtgataaaaagatacccgacagattggctgcacgaaggaatcatcaatggcatcaaaccaggaatcatcccaatctttatttttattttagtcggttcattgattgctgtatggatacaagcagggatcattccaactctaatggtcattgggttcaaattgatcagtgtccagtggtttgtcccttctgtatttgttgtgtgtgcaatcgtaggtagcgctgtagggagtgcctttactgttatgtcaacgattgggattgcatttttcggtattgggacaacactaggcttaaatccagcgctggttgttggagctattgtttcaggtgccgtttttggagataagatgtctccattatccgaatcaacaaatctagcagcagctattgttgatgccgatttgttcaaacacatcaagcatatgatgtggtcaactgtcccggcatttgttgtttctttctttttattcatgattttaggacacacaagtaaagccgcaagtctttcatctattcgtgaagtgactgatgttctagaagcaaactttactatttcaatctggtcactgattcctttatttttaatgttactgtgtgcatggaaaaaggtgccggcaattttaacgattttgttgaatatcgctgtagcagtaggaatgatttttattcaaaacccacaaacttccttaacgaagttggctggggtcatcgaatcagggtttgtttcaaatactggaaaccaacaaatcgattcactgcttagccgcggaggaatcgaaagtatgatgcctactgtgtcattgattattctaactttgtcattaggtggattgttgatcgaatttggcttgatctcaaccgtgatggaacgagtatcaagaaagatgacgaacacaccaaatttgatttttacaacattgatgacaagtatcggagtaaatatttttattggtgaacaattcctatctgttattctgcctggtaatgcatttaaagaaacttatgaaaaagcaggatttgatccaactgtattaggtagaacgctagaagatggtggaacagtaatcaactacttagtgccttggggaattgccggaagtttcgtagcaagtacatttggtattcctacactcacttacttgccattcgtatttttcagtttgctttctcctgtgttttcgatggtcagtgccttcacaggttggggaatctcaaaaaaatttgtgaaaccgcaagaagcagtaagcaagacagcgcaattagaacaataaaaacataaaaagggattgtgacaagacttttgtcacaatcccttttacgaataaacggtattcaaaagccagtttctcggtattaagccaaatttatacaaaaatgtggaaagccatttcacaaaatttttcttaatacgcgaaactaagcgactttttcacaacctctcgataaacggtgttcaatcagctgaccctcggtattagctcaaaaaatggcaaaatatgaggaactatttttccatttgtctctctaatactcaggtcagaacgctgattttacaacctcttaataaacggtgttcaaaagcttgcatctgcggtaataagcctaaccaaacgaaaaataggagaagctatttttgtttggctgttcttattacttgatgcagggcagctttttcacaaccccttattcacggcgttccagaagtagcttcttcttatttcttgaagctgataacttctggaacatcctctttttttatttggacggataatggtcattccatttctttgatcatttttttcattttgtcgatctcttcttcttgtgcctgaatgatttcttccgctaatttttttacttcaggatcttttaaatcagctcgtttacttgccaggatagcgatagaatgatgaggaatcatggccttcatccaagctgtgtcgttgacagtagtttggcttcgtaccataaacaaggaaccggcaaaaacaagaagactagcggctaagatcataacatttatctttttgttttcatacattttccacatgaacaacagcatgatgactgccatgactgcacccatcatcaacgccatgaatactcgtgtacgactgaagaagatatgatcgagcgcatagacattcaagtacatcataccaaacataactaccgttgaaacaccgatcatcaacaaaaacttccaatactttttcatttaaaacaaactcctttttttcattcctttcttctatcatgtcatgagcatggagaacaatcaattattttgcacagagggtttttgaacaccgtttaccaagaggtcatgagactgtttattcggaaaaaggagttgcaacaagacttttgtcacaactcctttcttcaatagctccatctattccacataaataaaataaaattttctatcgatttcattcattcgtcaatacgaacgcatcattctttttttgataactgaaataaatgaacaggtaaagcaggccagtcaatacagttaccccaatggagttcgtgaacaggataccaaggaaaatcaatcctaagacagctaatgcaaaaaagctgattcctttatcccataatgttccttttcttagtgccagtacaaaggatgccgcactgataatgatccagatcaataatactgtatacgaaagggaacctgccagatagccaaataatttgtcaccgacaaaataagaaagagctacaccaagataaagaacactggtacaaaataaaacagcacgttgcggtacttgatgcttgtttaaaacagctagttttctagaggaaccttttcgatccttcaaacggaagaacaaaattcttgaagatgcatacacacccgaattgatagatgagaacaaagcaaggacaatcacaaaattgacgatatccgctgcaaatgggatattcattttttcaaataccatcacaaaaggactgacattcgtgcctgctaaagtattccaaggaaaaagaatcaaaagcaaaaacaaaggaatgatgtaaaaggaaatgattcttcccatgacacctttgattgctttaggaatcgcacgtttaggatcatctgcttcgcttaccgtgatagcaatcagttcagaaccgccgtaagaatagataactacaagcaaagaactgatgattcccttcataccatgaggagtaaacccaccatggtcagtcaattgctgaagggtagggaaaacgcctgtgcccaacatttgctgaccgacaagataagtagcaaaaatgatcagtaagataatgacactgattttagcaaaagccagccaatattctgtttctgcgaataaccgtaccgaataaagattgatgatcgtagttaaaacagccaacataaaaacaaatacccaggctggaatgtgcgggaaccacaactgcaaaaaggaagcagctgcaacagcttcagcgatgatattgataatccacatagaccagtagacccaatcagtaaaatcagcagaatgagcacctagataagggcgtatcaaaccagataatccgtgatgcgtgtcgccaccgcttaaaacgatttttcccagacctttcatcacgatatataaaatcagcccaccaatcaaaaaagcaatcaatacagaagggccggcgatcccaatcgcttcgccacttcctttaaatagacctgcaccgattgctccacctaaagctaacatggtgatatgtctggagctaagttgttttttcaattttttatcttccataaatgacctctttcttttaaattcacaatcaaaatttatattaagaataaatagcaatatttaacaatgactaatgataacaaattttcagacaattacaactattcagaaaacttttaggcgaattttaatagaagaatgatttatttcatcatattttcatacaaatgttaaattttcatacaaatataggaaacgttttactggctttttactatttaaacaggctatcataggaaaaagtgacagagaaagtgaggcggaaaagatgaacaaaaatgacgtactgctagttgcaaaaaataaatcactttattttttgccttccatccgctctttagatgtttggtccggaaaagatttactacagtcggaattcattaaatcagctagacaacagttggcaaattatcagctgatcgtttttttagattatggatttgatatggagatggctcgacgcgtgcgcccatttaccaatgcaaaaattgtgttatttttttggaatcacttcaaagcagaacacgaggcgatgctgaagcaggcacaagatgaaccggcaatcgatgagatttatcattttgattttttggaagcaaaagaacttgggctgaaacataatagttcattttattcgaaacatatgaatttttcttctagcgaaccaaagacggatctattttttggtgcaacgaataatgggagaaaagaacgagcagaaagctataagcaggaatttataaaaagagatgttacgaccaactatttcattcttccacatcgagggaatgaacaacctggatatcttacttatgaagagtacctgaaaaaaacaggggaatcgcgcgggattctggaactgttgcgggagggtcagcaaggagtgactttgcggacatttgaatccatgtattttcaaaagaaactagtgacggataatcaagcgattgctcattatcatttttatcgtcctgaaaatatttttttgcttcgagaacgtgatttagatgaattaccggaatttctgcatacaccatttaagccaatcctatcagagctattggaattttatgatgcagaaaattgggcaaaacgatttatcactaacgattccactatttatgagcaatacgaatatgacctctcctctgttgaaaacaaataaaaaacctacattttgaagagattatgtactgaaacaaacaagcacaattcttatggcatcatgagagttgtgttttctttttgatcttttattgggcttaaaaaaagagaaccagctgctgattcagctgattctcatcagagagccttttattctgcgccaaggattccttcttttgcatggactaattgggtcaaaaaggcacaatatggtgtagcaatatcatatttttgtccttttcgccaaatggcaccattgatgtagtcgatttcagtcaaacgatggtttttgatcaggtcttggtacatagatgggtaatgcaacccgatgttgtcaggatcataagtagaagcaatatgttggtacacttcttcttgatctagtatgattccttcttttgctgcgatagaagcaaattcagatacgattgttcgaaccatgctctctgccgctttttgcgcgcctagttcagcaatattacaatccaaaatcgtgcataaaccattcaatgttccatttacacaagcttttcgccaaatggaataacgaacgttatggctatagatcggatttaaatttgcttcttgaaagacttctacaactttttttgtaaatgcttcgccttctggttccaagttctctagttcgatttctccatcacctaacaatgtgacttttccgggaccagctagaccagctgtccacatcgtgatcccaaataagatatttttctttggcacatatttttccagtacatcttcatgacctaatccatttagtaaacacaaaacataagtattgtcagtaataatggattggatcgaacaaaacatatcatctaattgattggcttttgttaatgctacgatcaagtccacgtgttcgttgctttcgatgatttcttctggtgaatagattggcagttttgcgaccacttctttaccgttaaagtcagcaatcaacccatttgtacgaatggcttcaatgtgagcaggccaacgatcgatcaagaggacctcatttccgctttgatgtagcatcaatccgattcggctgcccattgctccggccccagctattgcgattttcatgttttttctctcctttattcaatgagttcccttttagtatatagaaaaatggaagaaaatagcattgttttgtttgaaaaaaatgaaaaaaagtgtcttacttaagaagaaagtgagggatacagatggatattttggcggcaattgattcatttaaaggaagtgcttcttcatttgaactaaatcaggcagttctaaatggctgggaagatcgtaaaggaagaaaaatcaatgtgccgattgcagatggcggagaaaatactgcagaagcaatctattacgcgctcaggggaacatggcgtaccattgatgggatggatctcttattccgtcagcgaaaaatcagctatttattgacaacttggcaaggaaaaaacaccgcagtcatcgaatctgcacaagcattggggttagatctacttgataaaccaacggatcaaactatccgacttgcttccagttatgccttaggagaacttattaaagatgcactgcttcaagaagtagaacaaattattgtcactttaggaggaagcgggtgtagcgatggtggtctaggattactccaatccttgggtgcttctttagaagggtacacagaaggaaatcctttattatctactaaaaaacttcattttgatcgaagaaacgttcttgtttctaaagtaaaattgattatcgctgcagatgttaccaatccatatacaggtcaacaaggagctgcttggcaatttggaagacaaaaaggaggaatagatacgacgctagctttcttagataaacaagcaggaaagattgctcagcaaataaaagatttctgggaggtggatttagatgatattccaggaagtggagcagcaggcggtattggtggagccctttttttgttgggagcgaagatggtttctggtttcgatttagtcagccaaatcactggattggaaaaaaagatcgaacaagcagatgtcatcattacaggagaagggcggatcgatcagcaaacgatccacggaaaagttccatacggtgtagcagtgcttgcaaaaaaatatcgaaaaccaataatcgctatttgcggaagtagagaccaagagctagaaggactttctgattttctcccaattgtcttaagtattcatttgggtccaataggtttagaagaagcaatggaacacaggcaaacattagaaaaaacaaaaatcttaggacagacacttagcagatttttcaccatcctcccgaagtagttgacaaaatcattttctttatgctatcgtaatttcaaatataggacaaagtgagggatccgtgcattgaaaaattaagtcgattgatgaaagctgcattcagactgtaccttgtggagacaaggaagcagtgtgcagattttcgggattggcttggttttttcgatgtatgggtctttttgtgtgtatccaacccttgcatcctctttagccagttctgaaaataggactggtctttttttacgaggtgatggaaaatgtctaaaatcgaaataaaaaatctgacattcggctacgacagccaaggcacattattatttgaacaagcaaatctaaattttgacacacaatggaaactaggacttatcggacgaaacggtcgaggaaagacaactttactgaatattctacaaaacaaactaccttatcaagggcaagtaatccatcagcaagaatttgcctatttcccgcaacagacaaaagataaagaacgtttaacctattacgtgttaaatgatattacggattttgagatatgggaaatcgaaagagagctccaattgatgcaaacagatcctgaaatcttatggagagaattcagcacactatcggggggagagaagacaaaagtcctactggcacttttatttgtggatgacactcatttcccgttaatcgatgaaccaacgaatcatttggatatctctggtagaaaacaagtagcggcttatttgaaaaagaaaaaacaaggcttcatcgtggtcagccatgaccggggatttatcgatgaagtagtggaccatgttttagcaatcgaaaaaagtcaactggaactttatcaagggaatttctctatctatgaagaacagaaaaaacttcgtgatgaatttgaaatggctcaaaatgaaaaattgaaaaaagaagtcagtaggctaaagaaaacagcagctgaaaaagccgaatggtctcgttcccgagaaggagataaaacaaagaaacaagtcggattcatcgatactgaatctagacgagtgaataaaggagcagtgggtgctgatgctgcacggacgatgaaacgatccaaagcaatcgtgaatcggatggagacccagatcagcgagaaagaaaaactattaaaagatatcgaatatatcgattctttgacgatgaatagccaagcgtctcaccataagcgacttttaagcgtagaagatcttcaattagggtatgaaaatctgttattcgagccaattcattttacaatcgagcctcatcagcgggtggcgatttcaggtcctaacggtgcaggaaagtcatccattatccattatcttctgggggcattcaacggcaaggttataggagaaaaataccagccaaaacatctgagcattagttatgcaagccaaaattatgaagacaatcgaggaacgttggcggaatttgcagagaaaaaccaagtagactaccaagcatttttgaacaacctccgaaagcttgggatggaaagagatgtttttcataacaagatcgagcagatgagtatgggccaacggaaaaaagtggaattggctaaatctttatcacagccagctgaactatatacatgggatgaaccattgaattatttggatgtcttcaatcaagaacaattagaacaactgatcttgaacgtgaaacctgccatgttactagtggaacatgatcaaaccttcctggataaagtatctactgagattatttctcttgagagaatctaacccttgtaatctcaagaacaacaaggtatggttaaggggaactttgccaacgaaggagagaatcacatgctttatgtaacgagacacggagaaacaacttggaacgcacaaggattagtttgcggacgggcagatgtgccgctgactgaaaaaggacagatgcaggcacagaaactagcagaaaaggtagtagatttgcctgttccaatcacgaaaatcatccattcccctcttcaacgagcaagagatacagcacaagcagttgctgatcgtctcagcttgccgctgaccgttgatgaacgattggtagaaatggattttggggattatgatggactgccaagcaaagatgagaactttcaaaaagcacgtttagcgttcgctgtacgattcccaaatggggagtcagtcttagatgtgtatgcacggatcgttcctttattgaaagaatgcatcgaagacgaagaaaatgtctatctgttagtttgccataatgccttgataagagtgatcaatgcttattttcatccgatgcctaatgaggggttctttacattcatggtagataatacagaattggtttcttatgagtaattatgtttttgtgttatttaaataaaatatttcaaggcactgcttttgcttagcagtgccttttttaggttatgacaattcttttgataatataaactcaacctttagaaatgaaatttaattattttaataaaagtattgaaattttgtttctttagatatatactctagtcatagaaatgaagacggatacagaaaaagagggataatatgtttggcttttcaatatttatgaacgattctttgtcagaagagaagaaacagtatatccgccaaatggcatccaatggctttgtcggtattttcacttccatgcatataccagaagatgatgtttcggcatatcaaaagcgattgatcgaactaggaagcgaagcgaaaaagaataaactagaattgatggtcgatatttcaggagaggcattggaacgagcgggtttttcattagaagatctaacgcctttgaaagcaattggtgtaacaggtttaagaatggattatcatatttccaatcagcagattgccgactggtcacatcaattgaaaatcagtttgaatgctagcacgatcacgcctaaagatatcgatgaattgaaagaagcagaagctgatttctcacagattgaagcttggcataattattatccacgtcccgaaacagggctggacaaagaatggtatcagaaaaaaaatcaatggctcaaaattcaaggtctccttgtccaaggttttgtaccaggagatacagagttgagaggcccactatatcaaggattgccaactttggaagaacatcgagggatccatcctcttgcaggcgctctagatctattagcaagtaacacggatattgtttacatcggagatgcaggtctgtcagaaaacgttcaggagcaatttgcttctttccaaaaagaacagacagtcttgctccatacggaacctgtagatgaagaattttacgaatatatattagggaagcatacgaatcggcaagacgatgcaagagatgtcatacgaagcgtagatgcacgttttcgagagattccgcctatcccagcaagaaatacagctacgcgtatgaaagggtctattactttagataacgaaaagtatttgcgctatatgggtgagatccaattaaccaaatatgatttgccagcggatgaaaaagtgaatgtagtagctaaagttatcaaagaagagctaccattgatcaaccaaatcaaagctggtatgaactatcaatttataagaaaagaaggaagataaaaatgagcaaaatcaatttagagaacctaacaacggaacgcagaaaccaagaaacttttggattagatgagatgagtatttctcaagccgttcaactaatgaacaaagaagatcagaaagtggccgctgcggttgaaaaagaactgacaagtatcgaaccagtgattgctaacacgattgagtcctttaaaaaaggtggacgtctgatttatatgggagccggaacaagtggaagactaggtgtgttagatgctgctgaatgcgtaccgacattcggtgtagaaccggaaatggtcataggtctaattgctggtggagaagaagcaatgactgtagctgtcgaaggggccgaagattcttatgagctagggcaagaagatctaatcaagctgaatttgacaaaaaatgatatagttattggtatcgcagctagcggtcgtacaccatatgtgatcggtggattagattacgcaaaatcgatcggtgctgtcacaggaacgatttcttgcaataaacaagccgaaatcagtaaacacgcggatttcccaatcgaagtcgatgcaggtccagaatttttgacaggctctactcgattgaagtcaggaacagcacaaaaacttatcttgaatatgatttctactatcagtatgattggtataggtaaagtattcaataacttgatggtcgatgtcaaaccaacaaatgaaaaactaatcgaacgctcaaaacgaatcatcatgcaagcgacagaagctgattacgaaacagctgaaaagtactttgaagaagcagatcaaaatgttaagctggctatcgtcatgattttgacaaatagtgataaagaggaagctcaagcaaaattagctgaagcaaacggatttgtaaaagggaccttatgagggggaaaagaccatggcaaaaaacgaactgactttggaagaactggcaaaacaaatttataaaggggcaggcggcatgggcaatgtagaaagcattgtccactgcatgactcgtgtgcgtatgaagatcatcaatgatgatcttgtaaatgtctctgaattaaaagcgattccaggagtgcttggtgtagtagaagatgaacagcttcaagtcatcatcggacctgggaaagtgaacaaagtagcacagcaaatggttgatttggcaggcgtgaaattaggagaaaaactttcttctgtaagtacagctacagcaaattcatcagcatctggaaaagaccgtgtaaacgaacgggcacaagaaatgaaagcggcacaaaaatcgaaacaaaaaccatctaaaatcaaatcggtattaaaagacatttctaatatctttgtgccaatgattcctgcatttgtcggtactgggatcgtggcagggattgccgcagttttagcaaacttagtcacagccggaacacttgatgcagcaacatggcaacaatatatcgatgtgatgaacatcttgaaaaacgggatgtttagctacctagttatctatacaggtatcaatgctgcacaagtttttggtgcaacaccaactcttggtggagttatcggggccgttgtgatgctgacagggatgaatccggaagcaccactgaaaaacttatttactggtgaagctcttgcagctggacaaggtgggatcctaggtgtcatcttcgctgtttggctattgtcaatcgttgagaaaaaactgcataaagtagtacctgatgcggtagatatcatcgttacaccaactctttcattgattgccatcggtctgattgaaattttcttcatcatgcctttagcaggtttcatttctgatggcatggtcggtgggatcaactgggtacttggcgttggtggagcatttgccggcttcgttctaggcacattattcttgccgatggttatgttcggactgcatcaaattttgactccaatccatgtgcaaatgattgatgaaactggtcgtacgctattgcttccaattcttgcgatggctggtgcaggacaagtgggtgcagcattggcattatggattcgctgcaaaaaagataaagaattaacagaaatgatcaaaggagctttaccagtcgggatcctaggaatcggcgaaccattgatttacggagtaacattacctctaggacgcccatttattactgcttgtatcggtggaggtatcggcggggcagtgatcggaatgatcggaaatgtcggggctatcgctattggaccttcaggagccgctttgatcccattgatctctgacggtaaatggttaggctacatccttggattattggcagcttatgctggtggcttcgttgctacattcttcttcggtattcctaaagaccgtttagaaaaagaagaattagcgactgaaacagccacagtaaatgaagtgcctgaaaaagtagtacctcaaacttcagctgaaagtgtgactatcctctcatcagttgctgacggaacagttgtttctttagataaagcaagtgatccagtttttgcacaaaagatgatgggtgaaggctactttgtagaaccagaaaacggacatatctattctccagttactggggtagtcagctctgtcttcccaacgaaacacgctattgggatcacaacgccaaatggtttagaaatcttgcttcatatgggaatcaacacagttgacttaggcggtacgccatttgatgtgaaagtaacagaagggcagcaagtgacacctgatacgcttgtagcagaagctgacttagaagcgatcaaagcagcaggcaaagaaacatccatgatcgtcttggtaaccaatatggatcgtgtaaaaaactttgtcttggaaaaaacaggtaaagcaaaagcaaaagcacctgtgatggatgtcaaagcttaatatgatagaaacaatagaaacgaaagaagaaactgaaatctatttttcagcttcttcttttttattatttattgttttctgctaaaatctgataaattcgtgtcacatcagatggtgttccccgtaattcataatctgccaagaaaggaaagccaaatgtttgtgcatattgtttggctgttagacaatactgattattgaagtttttatttccgctaccgactacaccaagacaaagtttatgattgtcttcatgttccagatattcacgcatcgtttcggtcaagatttctgtatcaccgttatctaaaccatttccgccgtctaaataagtaggaacgaaagtaaaaaatggttctgtttctttcgtaaaatcactattttcatggatttcttttaaagtaacttcaggattgacaggatcttctgcatgcattttttcagcatattctgctagatgtttggcaaaggcacgcgtatttcctgaaatcgatatatataaaatgttcatggatcatcctccaattctttccttttagtatagcatcttttttaagttttttggtggtgtaatttggaaagggactaggcgctttgcttgtataatgagaaaaaagccggtagaattatatttctattaaagtttttattaattaagtaaaaataaaaaaggtttgttatactttttgataaaagcggttttattttggaggatgcttacatggatacagagcaacagaaaaaaggaattggtttaattccacttgctgccttagtaattggttcagcgattggaggtggcgtatttggtattatgacggacatctccggatcggctggcggcccagctattttcagttgggtactcgtaggaacagcaatgttgatgctctccttgtcgatcaataatatcaataaaaaacgtccagatttaaaaggcgggatctttagttacgcagaagaaggttttggccgtttcgctggttttatcagcggttggggttactggctcacatgctggttaggcaacgtagcttttgcaacattgttgatgagcgcattaggatatttcttcccagtatttgaaggtgggcaaaatctggcatcgatcgtgatgagtacagtctttttatggggatatgcatggctagtgaatcggggagtcgaaaatgctagtttcgtcaatgctatcgtcacattctgtaaattagtgccattatttttatttattgtagtagctatcagcacgttttcgatccaacaattcattgataacttttctagcgacattatattgaatgcgaatggacagccgatcccgttttccagtcaagtattgagttgcatcatggtgatgctttgggtatttgttggtattgaaggagcctctgtcgtaggttcacgagcaaaaaaacaatcagatgttgggaaagcaacgattctagggatattcggcttgattattatttacgtcttggtttccatgcttccatatgggacaatgacgatgaatcagctgcaaacgatcaaggcgcagcctgctatgggctatgtgtttgaaatgatggttggtaaatggggagcagtcgtgatcaacggcggtttgatcatttctttagttggtgtttggctctcatggacgatcttaccgattgaaacaatgggaaacatggctgaagacggacttttgcctaaagcatggggaaaactcaacaaaaatggggcaccaacttatgctatcgtattgacgacgttatgtacgaatgtctttttactttcattattattcactgacagtgcttataactttgcttacacacttggtacagcagctattttcttcacgtggcttttcttaggattgtaccaaatgaaactttcttatcagcggaaagaatgggtccaatttttagtagggcttttagcaagtgcctttcaagtatgggctatgctagtcgtagcctttaatgaagtaatgcttgttcttgttcttttcttgccaggcatttatttttacctcaaagcacgtaaggagcaaaacgagcctgtacaacatatccacttagataagattttacttataggtgtgacgatggtcggagtgattgcaatggttttatttgccactgggatgcttcacgtatagaagtataaaagaagtataaagagaggttgtgagcctgtcgtttattcaaaaacatactaggaaaggagctgtgacacaaatgttgtcacagctcctttttcagaataaacggtgtttaagagacagccaatcggcaataaggctgaacgtctctttcacagcctcttttttgatgagtcatcatacattttttcgcttaaatacgagatatcctaatgctaagaacaaaacgatgtaagctaaattaccgaatagcatttgattagtagaaagatgagtcaattgcttcatgatctcttcgtttccaatttggttttgcagattcaacatactgatcggattccatttgatccactcccatttttggatgagtgcaataaggataccagatatgattgacgaagcaaaataaaagacgattcctgctgagatggatgcgccggaactattgataaagcaagcaatcatcaacactaaacttaaaatcagccataaaccgatataactacccaaagtataagtgaacaagctttggatcagtgtttgaccagtagaaaccttctccgtgaaggaaatcgaagggaaaagaatcagtttcatcaacacagtgacaataatagctaaaaggtataaataaacagaataaataactaatgtgatccatttgcttactaatatttctcctcgagaatactttcgataaaggagatttttcaatgtaccatattgtgcttccatcgaaatgatcgtgcttgcagctgcaatcatgataaagacaatccaagatgtggcactaaaaagctgagcagtcatttcaactggatcaatgatcgtcgtgtattttttggctagaagtgctgttcctatgagcaaaacaactaatagaacagataaaacagcagttgactttttcttgatcaatttaaataattcttgttttacaagcaatgtcatttttcttcttccccctttactgaatccagaatttccaatagagaagattccaaatcattcgtcagatgctggacgtctgtcacatggatattttgtgcagacaatagctggatcacggttcctaataattcttcgttttcttttaaaagcttgattttatcaggatcttccaaagtatatccagcttctgtcaagatcgttcgagcagctagatcatttgttgtagagataacgatgaaatcttgcgctgtttggttcaattcagccattgtacattgtttgatgatctttccttgattgatcaggatcagctcatcgaccattttttcaagctcgctgagtaagtgactggagatcaagaaagaggtgccctgagtagccaagtcggtaatgatttttcgcacatctcttgttgcttgtggatccaaaccgttcatcggctcatctaaaataacgatagacggatggttcagtaaggcaagagcaattcccaatttttgtttcattcccaacgagtaggatttcgcttttttgtgaatgtacttttccatcttgagctgattcacgatagtgtcgatagcagatacatcgttggtttcagagaataacttcagatgatcatagcctgttaagaatggatagatacccgggtattcgatcaatgctcctacttgttccaaccctttatgactagagggagaaatctcattttcaccaatacagattgttccatctgagtaatggatcagtcctaaaatagctttcatgatcgttgtttttccagcgccattaggacctactaatccaacgattttgccaggggataagctaaaactgacatcgctgagggcttgtttgtgaccaaagttcttggataattcttggaccgaaagacttttcaaaaatattcactccttttctatagatagtacaagcatacacctgatgagtggagaagtcgctaggtcattggacttatttcttattttttcataaaaaaattgaatattaaataaaaaggcttattttttctgatcagtacttattccaagtgtctagtggccgctagtaatcttgatgccaatgatactgatgagtagcatccccacaaagaaccaagtggaaagattcagcttatcatgaaacaagaccacaccaattatgaccgaaccaactgcgccaatccctgtccagataggataagagagactcatcggcaaacttttgattgcctttgacaaaaagtaaaaactagcaatcatgccaatcactgtgtaaaaagaataattgattttagaaaaaccatcactccatttcatcatcgttgaccagaatacttccaaaattcctgctatgattaattccatccatgccatacttacattcctccttaactataaaaaaatacacaaaaagaggaaaatcatcccttcaaagacctaatggaatgatcatcctctttatcctacccggtggcagattgtatatctttttctgtagtatagcacacctatccagatatcggcaatctcatactttttagtaaagtgtaccaagcactgacggatatatcgttagcggaaaagaagatgaatgctttgcaatttcatagaaagaagttgttatttattaatcatttaaaaaaaacagtaactagaccttatttctatatattatcgggcaataaattaaaaaaagctttaccttacaataagtaagataatttttgtgataaaaaaataacgaaaaatatttaaaaatagtgtctatttcgtgagaaaacaactatattttttatgtgttttgctttataattaaaaaaatattgtcattttatggaggaaaatatatggaaaattatcttagccttttaggcgtcttgattgttattctcgggtttgcatttaaattagactcgatattgatcgtaatggttgctttagttgttacagctttgactggcggtcttggcattcaaggaatgttagaacttttaggtacaagttttgtaaacaatcgcgggatggcgatttttatcatcattatgttggcaacaggaacgcttgaaagaaatggtctgaaagaatcagcggcttccttgatcaagcgattcaagaaagtatctgctggtatgattgtagatatttatgggatctttcgaatgatctttgcggcttttaacgtgagttttggtggagttgctggatttgttcgtccaatcattttaccgatggcattggggaccatcgaatcaaaagggttagaagtccatcctaagcatgaagaagaactaaaaggtatggcttcagctatggaaaatgtctgctggttctttggccaagtactattcatcggaggagcaggggcgttgctagtccaatcaacactgaaagatctaggatatgacgtaacattgggacagcttgctttagtggaagttccagtggctatcacggctttagttgtggcaagtgtctacttctatcttaaagaaaagaaattagcgaagaaatattatccaggaaaggggcaataagatggacttttttacaaatcctgatattttattaggcgataaattactggagatcctttatatcgtgatgggactcgtattgatttacactggagtaagaaatttaacagataaaaccaatcctcatcgttatgggtcagcctttttctggacggtcttaggggtagttattgcaggaggaagatggcttccggcaatcgtgaacggtggcttgatctttgcgatgaccataccagcaattgctaagaaagtcagcaaaggagaaagccggcttccatcaaaagaatatatggaaaaaatgtcagacaaactaggaatgaaaatttttattccagctttgagtatcggtgtctttgcgatcttgtttgctctatttaccaatttaggtgctttagtcggcgtgggcgtcggtgtttttgcagccatgctaatcttgatgttcttttctcgagataatcgaccaagtacatttttagatgatgcagcagatatgctgggcacagtagggccgttaagcatgttgccaatgcttttagcttctctaggtgcggtatttacaagcgctggagttgggacagtgatttccaatgcagtaggtacgatcgttccagaaggaaatgtgaacatcggcatcatcatttacgctcttggcatggtgatatttacggtaatcatggggaatgcatttgcggccatcaccgtgatgacggttgggatcggtgcaccattcgtatttagtcatggagcgaatccagcgttaataggaatggttgcattgacttgcggtttttgtgggaccctgctgacaccgatggctgctaacttcaatatcgtgcctgtagcgatgctggagatgaaagacaaatacggagtgatcaaaaaccagttgtttattgcgttatttatgctagttttccaaattgcttatatgattctatttaaataatagaagagaggggttgtgacagaataattgtcgcaacctcttctaacattgtagtggaacactatttttttataagaatatattaagtttgatctgttatgttatttaaactattgtttcctttatttacgctgttcaaggaaaatggtatgataaaagataaccatatgttaaatcaatcggacggaggaacaacagatgaaagtactagtaacaggttttgatccatttggtggggacaaagtgaatccagcctatgaagcagtaaaaaaaatgccagatgaaatcagcggtgctgaaatcatcaaagtggaagtaccgaccgtattcgaaaaaagcagtcaagtagtcaaagaagccatccaacagcaccaaccagatgtcgtgatctgtgtcggacaagcaggtgggcggtcagcagtctcgttcgaacgtgtcgcaatcaatctagcagaagcaagaatccctgataatgaaggaaatcagccattcgatacggctttagaagaaaacggtccagccgcttactttacctcattgccaatcaaagcaatgacaaaaaatgtacaagatcatggtctaccagcgtacatctcttatacagcaggaacatttgtctgcaatgatatcatgtatcgtttgcttcatttgatcgaaacacaattcccggcaattcgaggtgggttcatccacgtgccattctcacccgatcaagtgatcgatcgtccagtgggtacgccttctatgtctttagaagacattgcttcttctttgacttatgcagttgaagcagcagtagaaaataaagaagatatttccggaaatgccggaacaactcactaatttagcaagaaacactggctggttgctaacgttatgttagtagccagctttttgtaattagaaaggaaagaaacagccgtggaagaatggcaatccgtctttgaagaatggtttccaaaagaaatcagcaaaagctatcccatcaaaatttctaaacaatacacaagcagtcaacgttgggagatctatgcaaaattaacgaaaaaacagcgggaactagtcgataagcaccgccgatatctaatcagctctcgttttatggaagaacattatttagctgcaacagattgggtgttttctgacttcaagatcaatccgttttttcgaacaaaacgaagccagcaaaaattgtattgtgagtgtggtagagaattaaaagtgcaatacatcgttaaatcgccaaaaaccggaaagatcctaaaactaggcatcaaccactttgccgatcacctgcatgtctctccgacagtggcagcttcgatccatcagggaatgacaaaagttgatctggccttagacgaattattatggcttaagcagaagaatatcgattttcctgaaggactatggcaaaaatactgttttgtcttgtaccaaaatcgtcggatgaaacagccatatttaccggatataaaattagctcagcggctcgcagaatttcgccaagtagaaatgccgatttacatagcggattatcaagcattggaaaatgaaatcaagaaaataagtgaacacatcaatgggcagtcaaaaaagcgacagataaaaaaagaactatttgacgactttgcagaagaattagtaaaggatgtagaagaattcttgatcaactatcgcgcatttttacgtaaagattggcaatccatcgtatatgaagaagtgccagtacatcctaatgcttattttgaaacatttatttccgtgttgagaaagacaaaacgtcaacgaacaccagaagtcactgctcagatggaatattttgcgaaaaaccaacgattcatccaaccaaaaatctatctatttatttggaagcaatattgtcgctatggttttacagaagggttcttcgacagcattcctcggatagtcagaaatggttttttaaaagtattgcgtaaagaacgagaagctatacaatctgctgataagaaagaccgtacagtctcaaaagaaaaatggcaactagtagtgaaagatatccaatctggaaatgtgcaagagacaatcgacaaatggaaaggaaaacattatcgttttactgaagctcagaaacaagcgttggaatattatcagaagttagaagaatcactgcgtttcaatgatgaggcaagaaagtatctgaaggaattactataaaaaatagaggctgggacagaagcgtttaactccaagaaataagaagaaattcacgaaaattgcttttcaaatttttgtgaatttcagcttatttccgaaggagttgcttctgattccgccgtttatacgtgtttagagcgtgagacaaaagtgttctttacttttgtcccacgctcagtttttttatgcgtgttgttgtgcgttgtagtattcttcttccattttttgcatacgttcacgttctttttggttataccaaggtgaaacggtaaatgcaaggacatcattcagcaagtaaacagagctgttcacgaacatcgccaaacttgcagatccatgcgtaaatgaaatataccaaaggaccatttgagcaagccctgaagctaaccaccagtaatattggttgttgtaacgcaagaaactgatgataccagcagtcaagctaatagaaaaagcaatggcatctacccacggccgaggatcatctgtataacgaccaatcaggaatcctgaaacaagatagacaaggaaagtactgatgattgcgataaaccagctttttccagtgaattttcggatttttgaagccatattatgattccattctttacttaacaatacggggatatccaatgtgatcatataagcaatctgttcaccgatacttaaatagttctttgctgaaaacccaacgataataaaacaaatcgcagacaaaatacctaaaataccgttgactgattttgccgcattgatggataaaatacacaatacaccaagcgtggtaccgataaatgtaataacggacagccaagtgatgggactattgacaagagtcatgacctggcagccaagactgaaaaagaaaagataataattttgttgcggccagccttttagctgatgagctaaaaactgaaaatatgacttcatgtatgaggactccttaagacactaaatgtagtgtgttctgtatttactaacacaatctattgtatgcttttcttgaaaaaaaactagtctttcaattataaataatttgtgttatgataattttctgtttgttttcttgaaaatataatttcttactttcatttattatattgggaacaggaagagtgtcttggaggacctactttctgttttttttgccttttttcttataaaaaggaaaaacagctatttttttcaatctgacacatttacaatggaactggagattaatatagatccgagcttaaacgaagaataggagtgctcatatgaaccttacaacgatccatcatatagccatcattgtttcagattatcagaaatcacgtgatttttatgttaataaattaggatttgaagtaatcagagaaaattaccgcaaagaacgagatgactataaattagatctgaaactaggaagtgctgaattggagatttttggaattgctaatgcgccacaacgaccaaactatccagaagcttgtggcttgcgtcatcttgctttcaaagtagacgatattgaagaaacaattgcagaattgcagtccttagggatcgaatcagaaccgattagagaagatacctttacaggaaaaaaaatgacgtttttctttgatccagacggattgccattagaactgcacgaataaagataacaaaattgtcacttttttttcgtttcattcgatttttcattcgttcatttcttgatattctttaaaaaaagaaacaggagaatgaagaatgaaaaaaatgatgtttggtgttgctgccctcatcgtaatagggattaccggtatgacgggactgctcaatgccgcttttcacatggatgatattagtgaccaggaatatcggatctcattgaaaaaagcagcagcaatcgtaaaaaacgaaacaaaagaacataacatatctgctattcattttgcagttgaaaaagatttggagaatcctacgaatgcaacatatgaataccagtttttttgtgaaggacaagtcatagcagtcaatccatccactgggaaaacaaccgtacgaaatgacacggaaaaggccgcagaacatctttttgatatagaaaaaacggaagagttcaaacaaccgcaagcagcgatgaaggaagcagtcagctactacgggaaaaaagcaaaagtgaaagagtggacacttctagtcaaagatgaacgtccttattataaagtccgattaatagatggagaacaggaccgtcaggtatggatatctgcatagaagaaggatattgcttctcttttttacaatataagagtaagctaagagagtaaagatgaaaggaagttgagataacatggaaaaaatgaaatgccctaattgcggaaaaaaatttgcatacgaagaagtcaataatgtagtcgaacataatgataaagaaatgccagtcgtctgcccttattgccgaactgaagcggcaagaatcgttactcatggttatttcattactgaaaagattgaagattttttaaaataacgattttgcgatttctttttctgcatgttagaatggagaaaaggagaggaaactatgattcgttttgcgagaaaagaagatgctccagaaatcgccccattgatcttagtgattctaaaagatatggaactgccatttttgaagcagacaggggaacaaaagactttagagattttagaagaagcaatcactgatccaaattatcgttacagttattcacgaggtatcgtagaagaaatagacggtaaagttgcaggagttgcttacggttatacagatgaagaagaatcaatcatcgatcagccactggtacctatcttagagaaatatcagctagatgcgtctacacgtttgttcattgataaagaaacgtttcccaacgaatggtatttggactctatcagtgtatcagaagattttagaggacaaggcatcggttcgcgattattagaagcattacctaaattggcgaagaaagctaatcgctccgtcatcggtctaagtgtggatgaaaaaaatccaaaggctaaaaaattatacgaacgccatgacttcaaagttgtcggtcagcggatgatcagtggtcatctttatgatcatatgcaaaagaatatctaaaaagatgtacctgaaatgcgtatttccgcatttcaggtacatctttttaacttaagttaagtcggtaagaaacaggcttatcgcgacttttgtctttacggtagagccagtaatctaaaaccgcagcaatacaaatacaaactggagcatcttcatcatttgagacatccaatacatagtaatctcctgaaaaaagtgttgctttatccattttcatgatttgctgattgaaatgatggatttgatattgatgattatagatatcaccttggactgtccagtgaagtctacgaatataataaaagtcaccgggccaattgaatattttctgcatggttcccaccttttcgaactctttatacagctcaaaacgcgtaccgaatgtcaggcttatctgcttgatgtgagcaacgagatcgccattcatggcataaagagacaatgcatcgccctttgttccccagcgaccaaccatcaaaaacagggaatgtcctttttcgtttttgacaattgtccgagttgcacgtccaagctgcttttcctgaatgaaaaattctgacatctatatccctcttttctagataaaactacaagtcttctgcaatcgcgcgcaatatggcttttcctacgccagattcaaggtttgtgtccgttgtatatttggcataatcttttacttcgatttctgcatttcccattgcgaaactgactcctgctacttgcagcatgctgacatcattgaagttatcgccaatcgtcatgacttcttctaaagaaatcccacgctcgtgagcgacatgggcaacagcaattcctttttgagcgtttttatggttcacttcgatattgttttgaccagaggaagtaacggctagatcgcctaaaagagaaatctgctttccaactggacctaatacagctggcccttctgtatgaaaacaaataatttttaaaacttccagattcttttcttccaaaatagcacgaatactgtccacgtatgtgatgtgcaataactccagcttagctgaggccatggcaatcgccattttatacgtaaggtgaggtaaatgggtagccaccatggaagcaaaactttcaattcgtttcgcttgattttcagaataaagaccatcgttggttgctacttcatagtaaataccgttagcatctagaatatctaaaacagagattgcttgattatttggaatcgacacggtaaacaatgaatttccttctttatcaaatacctgtgccccgttcaaagtgatcatcgcacaatcgattcctacctcatctaaagctgcgcgagcttcttgatagtttcgaccagtagcgaccatgaactcaacaccggcatcatttgcaaaacgtatcgcctcggcattttcaggagaaacactcatatgggcatctaataatgtgccgtccatatctgatgcaattaatttgatcataatgattatcgttcctttctgcttcttgttcctagtttaccatattaatcaagtgctgagggtgaagattgtcccttgtgattgaagaaaatgtgagttattctttttattaggaggtggagtttttgaaagaaatcattcataacagttggcaagaagttttgtcctcagaattttcaaaagattattatctgcatctaagagaatttttaaaaaaagaatatgcgtcccaaaagatccatccagatatgtatcatatctatgaagcattggaattgactccttatgaagaagttaaagtggtgattttaggacaagatccttatcatggagaaaatcaagctcatggcttatctttttctgtgcaacctggcgtaaagatcccgccatcgttaagaaatatctataaagagctttatgatgatcttggaatcgcacctgttcaacatggaaatctagtgtcatgggctaaacagggagtccttttactcaacaccgttcttaccgttcgggaagggcaagcgtattctcatcgcgggaaaggttgggaaagattaacagacacgatcattgaaaaattaaatgaacgggaaaaaccaatcgtgtttatcttgtggggaaaaccggcacaagaaaaaatcaaaatgatcgataagagtcgccatatcatcataacatctccacatcccagtccgttatctgcaagtcgtggcttttttggttccaaacccttctcgaaaacgaatgatgcgctccttgcgttaggagaagaaccgattgattggcaactgcctgaaacagtgtaataaaacagcgctttcctgttatagtgcagttcgctttgtatgtgaaaaacttaatttttccagcatttttgactgatacagataaaataaactgttctttttttctggaatagtgtatgataatacatataaaaacgtctggaggtcatcttgtggaattgtttgatagtttaagatttaaaattgttcgccgtgggatcaaaatcgttttcccggaagctactgatgctcgtattttaggcgcagctgcccggttgaaagcagaagaacttgtggaacccattttagtagggaacgaagaagaaataagaaatgcagcgcatgccagaggaatcaaaacatctagctttacgatcatcagccctgataattacgataagtgggatgaaatggtggatacttttgttgaacgtagaaatggaaaggcatccaaagaacaagcagaaaagattttaaaagatgtgaattactttggtacgatgcttacgtatatggggattgcagacggaatggtctctggagcgatccattcgactggcgacactgttcgcccagcacttcagatcatcaaaacaaagcctggcatcagtcggacaagcggagcgatgatcatggtacgtggaagagatcaagaaaaatatgtcttttcggattgtgcgatcaacgtgaatccaactgcgcaagaattggctgaaatcgccgtagattctgcaaaaacagcagaattgttcgatatcgaaccaaaagtagcaatgatgagcttctcgacaaaaggctcagcgaaatcgccagaagtagacaaagtagttgaagcaactaaaatcgctaaaaaactagcgccacaatacatgatcgacggcgaattgcaatttgatgcttcttatgttccttcagttgcacaactgaaagcgccagattcagaagtagctggtcaagcaacagtctttgtatttccagaattgcagtcaggaaatatcggctataaaattgctcagcgtttcggtaactttgaagcaatcggaccaattctacaaggcttgaacaaaccggtttctgatttgtctcgtggagcaaatgaagaagatgtatataaattatcgattatcacagcagcacaaacattgattgattaacaaatacacgcgaactagccaaaaacagcagctgctgttcttgactagttcattttttctttaaaaaaacttcattacgcgatatactggcaaaaagaaagaagagcgggagaagatgaaaaatgatcgaactatcaggattaacaatgacagaacaattcgcagaggcaattggtcattccgcaatgccaggtgacaatctgatattgactggtgatctaggtgcgggtaaaacaacgttgacgaaaggaattgcccaaggattagggataacgcaaatgatcaaaagtccgacatacacgattattagagaatatagtcaaggtcggattccgttgtatcatatggatatttatcgggtagcagctagcggagcagatttagggttagatgaatattttgaaggtgatgggctttccgttgttgaatggggaaatctattagaagaagcactgccggaggattatttggaactgattttagaaaaaagtgatacagatttagaaaagcggtatgtgaaactaatctcatacggggagcaaagtgaaaccttcaaacagcgaattctagaaaaatgggctgaaaatcatgagtgaagaagttgggatcatcttgcgggaagcagtgccaggagatgcaaaagacattcttttgatgatgggacaagttaataaggagacagaatttttagttttggatgaagcagaactcctgttaccaccagaaaccttagaagaagagttggattatatatacgaaagcaataataatttattgctgcttgcaatctatgaagggacgattattggaacagcatctgtcaaggcagacagtcaatttcgtttgtctcacgtgggagaagtcggtatcagtattctgcaggaatattggggaatgggactaggcactcttatgctagaagaaatcatcagttgggcgaaggaaatgggtgtactttttcgattggagcttgacgttcaagttcgtaatgaaagagccgtacacctttaccgaaaaatgggcttccaaatcgaagcggtcatgcctagaggggcaagaacagatctaggtgaatttttagatgtatataaaatgagttatttgattgaatagaagaaataggaaaagagtgagaaactgtcatccttttgagaaggcagaaaaacacacgaagggactgtgacaaaagtcgtgtcgcagtccattttttttgaataaacggtgttcaatcagctgaccttcggtattagctcaaaaaacggcaaaatatgaggaactattttgccgtttgtttctctaatactcaggtcaaaacgctgatttcacaacctcttggtaaacggtgtccaaaagcttgcatctgcggtaataagtccaaccaaatgaaaaatatgagaagctatttttgtttggctgttcttattacttgatgcagaacagctttttcacaacctctccaataaacggtgttctcctgccagctcctcggtcaccagtcacaatatttaataaacatgagaagctattttttgaaattgctccttgtgactcggagtgaaacggcaggctcacgacctctttgtgtgtttcataagtattcttttactttatagtcacaagttttttcaatggatctgtcccgaattttttttcttgataaagcaggatttccgcacatgcacgactatcttccaatgcatcatggtgatgatctaattggatgttcaaattttcgcacacagtgttcaatcgatgatttggaaattcaggaaacaggcgacggctacttttcactgtacataaagaaagataattaggctgttcaagatgataataatctaagcatcccgctaagacctttgtatcaaaagcagcattatgtgcaacgactaaacgatttttttgaaaatatggttggatagtttgccagacttctgggaatttcggcgcattgcgtacgtcttcttgatggattccgtgaatttggacatttcgccagaaaaaaggagtctcaggctgtatcaatgtatagaattcatcaacgatctggctattttttaccatgactagcgcaagagaacaagcactataaggctgatgattggcagtttcaaaatccatggcaacaaaattcatttctgtaaaacctccttgggaaattactgtaacatacttttgaaaaaagcaaataaatttaacaaaaaacatagaattttttatgtaatatttgttgagaaaagctagtttttgaactcattccttgtgatttggagttagatggggatcatgacttctcggtattaagtcaaatttatgcaaagttgtgaggaaccattttcaaaaaaatttcttacgactcgaaagtaggcgactttttcacaacttctccactaaacggtgttcaatcagctgaccctcggtattagctcaaaaaatagcaaaatatgaggaactattttgccatttgtttctctaatactcaggtcaggacgctgatttcacaacttctcaataaacggtgttcaaaagcttgcatctgcggtaataagtccaaccaaacgaaaaatatgaggaactatttttgtttggctgttcttattacttgatgcagtgcagctttttcacaacctcttaataaacggtgttcaaaagcttgtatctgcggtaataagcccaaccaaacgaaaaatatgaggaactatttttgtttggctgttcttattacttgatgcaggacagctttttcacaatctctcgataaacagtgttcaaaagccagtttctcggtattatgccaaatttatgcaaaatgtggaaagccattttcacaaaatttttcttaatactcgaaactaaacgactttttcacaacctctttatttcaaatctaattctactggacaatgatcactgcccataatgtccgtatggatctttgcatcagctagtcctggctctaaatctttgctcgtcaaaaagtaatcgatccgccaaccagcattgtttttccttgaattgaatcggtagttccaccaagagtagacaccttcctgggttggataaaaataacggaatgtatcgataaacccgttatccaacagtcgagaaagagccgctctttcttctggagtgaatccagcatttttttgattcgttttccagtttttcaaatcaatcttttgatgagcgacatttagatccccacacacgatgactggtttttgtttttttagattttccaaataattataaaaggcttcttcccattctaatcggtaatctaaacgttttaattcgctttgagaatttggcgtgtaacaggttacaagaaagaaatcggaatattccaaagtaatcagacggccttctgtatcatggatatcgatacccattccgtaagtggcattcaatgctggttttttagcaaaaatcgctgtgccggaatagccttttcgttccgcgtaattccaatattgataataacctggaagatctaaatcaatttgtcctgcttggagtttcgtttcctgcagacagaaaaaatcggcgtctaactcatgaaaaacttctaaaaaatttttatttacgatggcacgaagcccgtttacgttccaagagataaatttcaataaaagcacactccttcgaattaatttccttacctttgcgatactattgtacctcattttagtaaaaaatggtgtaagatgaaagtaactaaatgatccaggaggaaagtagatgaagattggtgtaatcggtgtagggaatatcgcagaaaaagcatatttaccaacttatgcgaaaaaacaaggaacacttgatttttattttgcaacaagaaataaagaaacaaaagaaagaattcaaaaagagtacgggttccaacatctatatgaaacgatcgatgagcttttagaagaaaaaatcgaagcatgtatgatccacgcagcaacaaaagtacattatgaattagccaaaaaatgtctagaaaatggtatccatgtttatattgacaaaccactgagtgtccatctaaatgaagttcgtgaattgcaagaattagctgataagaaccaaataattttgatgatcggtttcaaccggcgctttgctcctatggtagaagaattgaaacgtatcccagataagcggttgatccacctgcaaaaaaatcgaatagcggcaaaagaaacgacagagttcgtcctttatgatttgtttttacatcttattgatacagctgtgtatttattagatgaacccattttgagaacaaaataccagataagagaaacaaaggaatttttggaatatgccattttacaattagaaacacaaaatcaaacggctattttaacgatggatttagcaagtggcgctaatatagaaaaatatcaagtaacaagtaaaaatggtacttatgaagtaaacgatctgacccagcttgtcattcaagatgctgatggaaaaaaagtgaaagaatttggcgactggacaaacacgctagtcaaacgcgggtttgagccaatggtagaggccttcttttctcagatccgtttaggtaaatcggaaacagaattgcttaaacaaaaagaagttgtaagaagtcatgaattatgtgaggaagtgcttaaagatcactaccgtcatcaactttgaacaagactggcaagattgtattaagcgtgatagaataatgaggacgtttgagaaaagaaaggaaaatcctcagtgaataaagaagaaatagttgaaagcttagccacgattactatattgtttgatgaaccattgatgaactatacgtttacgaaaacaggtggaccagctgatgtccttgcattcccgaaaaaacaagaagaagtaaagcaaatcatcgattattgccgaatccatgatataccttggatggtattaggaaatgcaagcaatctgatcgttcaagatggcgggattcgcggtgtagtcatcatgctgactgaaatgaaacagattcatgtcaaaggaacgatggtcattgcggaagcaggtgcctcactgattgatacgacttatgcagctttggcagaatcattgactggatttgaatttgcttgcggcatcccgggaagtgtcggtggagcggtttatatgaatgcaggtgcgtatggcggagagatcaaagatgtttttgctgaagtggatcttttgcttgaagatggaacattgaaaactttgacaaaagacgaaatggtattttcttatcgtcacagtaaagtccaagaattacgtgctatcgtattggaagctcgattcagtttgcaaacaggggattatgaagcaatcaaagcaagaatggatgagttgaccgaattgcgtcaatcaaaacagccattagaatacccttcatgcggaagtgtctttaagcgcccagtaggacactatacaggtcagctgatccaacaagcaggattgcaaggcctgaaatggggcggtgcacaagtctctgaaaaacatgctggattcatcgtcaatatcgatcatgcgacagcgacagattatattgaattgattgcgcacatccaagaagtaatcaaagaaaaatttgatgtgtctttagaaacagaagtgcggatcattggagaaaaacaagcaatatcagaaacaagcagaagtttagccaattaataagtaatggaacttaaaataagtaaaagagcaggacggtggccgtcctgctcttttttgtggttgtttacgcaaatggcgcaaatcttgtacattttaacacaataaaacaaaaaatatagaatatttcctcataaatttttccattttttgcaatattctcaaaaaaaagataaaaaatgagaataactgatgaaaaaacaagcataatccatcataaaatcagtataggtgaaaagatgaactttcatctgcatatcaagtaattggtatgaggcattttttgaggtgtaggatatgaagttggattaccttatagaagaggaagatagagaaaaactgctgctagctagatatttagaatttgagaaaaagaattatgtagtgctgcctaagttatatgaaacattaggtttgtctaaatttaaaacaagaaattatatcatagaattaaataaagaatttactgaattcaaaacaaagccagagatccaaatttcagaagaagcagagatccatgtcgaacgtctgaatttgacggatatcaaaaatttaagaagaatctactttcaacgatcaaaaattgctcgactgttaacggagatcgtggattcaaaagtaacgatcgaaaaatttgcagagaatcattttttaagcatatcaagagcctatgtaaaaagaagagaattagtctcttttcttgaacagcatcaaataaagttaaagaaaaacatattagttggggaagaaataaacatacggaacgtattatttggggtatatttcggggtctttaatggtttttctatgccatttagagaaagcgtcatgaatgaagcaaagagtatcgtgcaatattttgaatatctgttcaatttaaaactgtctgcaacaaaacgaatcaaattcaatttgctaaccactattagtttgttgagggcctatgggaatcaaccaatcggaaaacgtttcttttcagatgaatactttaagagctcagaaggaatgaagatcatcaaggatttatcacatatttcttttcttcatatccctaaagagcagatcattgatgagatttcttatatcatgttgtttttgatcacggaagaagaatttgaattagatggcgcatttggacttgcggaagctcattttcatgatatccacatgattagtcaaaaaatgtcagtggaattgattgatcaattaccattttcgattgaaatctctgaagaagaaagactatatatacgaaaagaacttcgtatgggtatgatgcatgtcaatcgaaaaaattggatattcgactttgagatgactagctttacgtctaaaaagcagctacagtttttcttcgagacgtatccaatattcagtacagcaatccaaaaggtcatacaagagaataaacgctatttcttgggaaaagatgaacgtttcatgattcgcttattttatgattatctctttttattggtcggtatttgtccggtatcatattttgaagcaccgattcatgtctgtattgatttttcgcaaggatctgcttataccgattacattatttctcaagtgaaaggatttaaaaattacaatattgtgattgaaagtcgaatcacttctcgtacgaatatttatttatctgattgtttacttgaaaaatttaataaagaacagataatttggaaaaatccaccgactccagatgactgggaatattttggaaatatcatcatcagagaaaaaaatagacatttaactgaaaaaatcagctagtatttatggatggcagctttgtctcacatatttattagctgatttatgtttttttcaaagaaaaggtaactagatataactagatataactagatatattacttaacaaaattaaaaagtacataagttattattccgattttcttgaaacaataaaaaatcaaaaaaaatactctcctaatagtccatcttcttttgattttatttatataatgaaatcatcttatgaaaattactacttcatgtttagacaagagtagggaggactaagaataaatgtgttcaaaaagacgttcaaaacaactaaataaacacgcttgtcgtttagataaggaacggtcgtgttctgaaaaacactacgttaagtttatgatgcgcacgatgctgatcagtttatctgtaggtgtctatatgcatgtacccgttcaggcaacgacacaaaccatcaaggtcgtacgtacctctgtttctgagaccactgattcccctatcactattactcatactttcactgatgcaaatggaaaacagctacttcctgcattgacttcctataataaagtcagttatcctccaacgataaaccactactggttaattcctaacaaaacattatggacatcggaaaccggaagcagtgtgccgctttctatcttttccgatatgactgatcctacaaaaggtgatcagttaaaacagatcactgatattttgaatcatgctttgacagatataaaggacggtggaagcgcacaagtttcttatgtatatgaaaaagattattcacagtttgaaagaaagaaaatcgatgttctggcagggacaaaagtttcgatatctgatctggtagaaaggctgaagaacgcagatggaacacaaggagatatgtccaaagtaatttcaaacaatgggaatatcgtggatacgactaatacaggaacatctactatttccttgtcctattttgatccaattgctttaaaaacaatgactgcatctgctgtgatccatgttcgtgctgatcaaacagctatcaaaggaaaagatcttcacttaagaacaggagagagttacgcccctaaagatcttgttgaatatgtaacaaaaagcgatggaacttcaggaaataaagaagaaatcaaaatgaacgggacagtagatactacaactccgggagaatatcccgttgtattaacttatatagactcgaaaacatcaaatgtggcagaaacaacagctgtagtttatgtagaagcatctgctgcttcatcgactgtcatcactcattttatagatagtcaaacaaataaagaacttcaagcagaaacacatatgagtagtgtaaatcgtattcctgatttgcgcctacctgctgaattttctgatcgagtgccaaatatagatttatcgacttatgaacaaaatgggaaagtcacttctatttctgattggatgcaagcaaacggattagacagaaaaagtcactggtcggagatccttgaagtacttcactcagaactgatgaataataggaagcaatcaggaggggaaattacctttacttatgtttatataccagacaatcgttcattagaaggtcatgatcttattgttcatccaaacgaaaaaataaacaaagaagagttgatccaatcagcaacaaattccttaggtaaacccgtaccgttaaaggatgtatcggttacaatcaatgaagtaccattggaggatggttatttgaccaaacaaacaggtgattttacgattatgtatagttatcatgacccgtattcactccaagaactccatgctcagtcactattacatgttttaccattaaacaaacagatagatcaaaaagaacaaaaaagacaagaagaaagcttgtcagaaaaaaaacaacaaatggctcatgcagtttctccaacagggaaagtaaaacaaacaagaagcctagagttagcaagaatatctagaaaaatctcagaatctaataaaacgataaggcaagaagctcatttggccccacaagtttctggattggaaaatgaaattttagagcctaaaataaaacaacaatcagaaaaagaatttgttgctaaacagtcggaagatcagaaggaatcagatgaccagaaggaaacgaagaaaaaacgcttgtcaactattgattccaccgatgagcatctgcagccgcaagtaccacttcctagtccgggaacacccgcacctggtggaggtattccttcttctgctttaggagatttcatgcgaggtatggcaggaacatgggtatacgctaatcgaaatgaatttgacgcagatgactggttctgatttatatctctatctgttatagtcaaataagtagctgagtcatatgttatttggcataatggagacgaggagggatagaaaaatgttagataaaacgttaccttacgcagaaatctggatgacaagaccacttcaacaaaatgttccaatcacgcctttagcggaaggttttgaatttcgattttatcaaaaagaagatgaatctgcttgggcggagattgagacttccgttggggaatttcaaacgacagatgaagcacttgagtattttcaacaaaactttgctccttatcctgaagaacttgaaagaaggatgttttttgtagagacaaaaaaaggagaaaaagtagcaacctgtaccgcttggcgaaaaaaatcaagagagcaagtgtatccggtttttcattggttagcagtgaaaccagattaccaaggaaaagggctcgcaaaagcattgactgccagagtcttgcaagaatttcctaccctccatacggacggaccaatctatcttcacacacagacatggagccatcaggcgattgctctttataaaaaaatgggttttacttttattgctgaaaatctagacggcacacctaatccagattatgaaaaagttatgcaggttttaagtaaattagataaataacgaaatggtgaaataagtcctcagtattgggataaaaaacgaaatagtcattcctcatatcttacttttttgagttaatactatcggataactaatggcatgccatacattcaaaaaagaaggggcagtgacaaaagtattgtcactgccccttctcttgttttttagcatgttttatcgtttgatttttttaggaataaaattcttgatgaacgtaaatttttggtaatcgtttcgactatagaggtaaccaaatacactgaaaacaactgctccaataaaattaacaaataaatccttcatagtatccatgattcccacgtctaagtaaccattttggatgattgttttatctgttttaccatctgcattttgactttcaatgattgtccgagtgatatctggaacatgatagacagtgtttccgtctttacttaactccacactattgatttgctggatgatcgtatctttttgcatatcgaattgcagtaatttatctgctgaaaattccacaaactcccacataacaccaactgtcatcgaaaaacagaaggaaacaactgctagtaataaaggagtcaagttcatggtttttgtatttttattgagcaaataaacaagggaaaagccgacacccccagctaaaaatccgctgaatgcatgtagaaaagtatcccacattgaaaaatagccataaaaatcacttaactctcctaaaactgttgaactaaaaataaaagataacaaaatgatttctagcatatttggaatctgtatctttaatatcttttccagaaaataagggatttcaaataaaattaatgtcagtaataaaagcattgtatttccccagtgttggttccagacctgatccactagcataataacgacgatgatacgtaataaaatatagattccgtttgtgattctacctgcagtttttgtactgttcgtaaaaaaggttttcaaatgattcataaaataactccttcatgtatatccttaattatactaagaagcgtgtgtttaccaaagctatatgacttaaagaaaaacagagttgatattgtgaaaaaaatcacttaatatagtataaggagaaaagggggatacaaatgaaaaaattagttgctggtttattaacagccgttgcacttcttgctatgagcgcatgcggcgcagatcagaaaaatacagcgcagacaagttctagtacgaaggaatctgccgaagtatcatcaggcgcttctgaacaagtatatacagatccaaaagaaatgaaagaatcttatgatgtcgtgattattggagctggtggtgcagggatggcagcagctatcgaagcaaaagatgctgggttgaatccagtaattttggaaaagatgcctgttgccggaggaaacacatctaaatcatcaagcggtatgaatgcttcagaaacaaaatttcaaaaagaagaaggaatcaaagactcgaatgatgccttctatgaagaaacgctaaaaggtggtggaggaacgaatgataaagaaatgcttcgatactttgtcgatcactctgctgatgcggtcgattggctagatcaaaacggtatcaaactggacaacttaacgatcactggagggatgagtgaaaagaggacacatcgtccgtctgatggctcggctattggtggatacttagtggaggggttattgaataacgtccatgagcgggaaatccctatttttgtcaacgcagatgtgacagacattaagaaaaatggggaaacggtcaatgaagtgactgtacatgttcaaggagaagaaccaaaagaggtcaccggaaaagcaatcgtagttaccacaggcggttttggtgccagcaaagaatttattgaaaaatatcgtcccgatttagctgattatattacgacaaatcaagaaggatcaactggagatggtatcaccatgattgaaaaattaggtggacaaaccgttgatatggataaaatacaaattcatccaactgtgcagcaggatgagggggtcttgattggtgaggttgttcgcggagaaggagcaatcttggtcgatcaagaggggaaaagatttgtcaatgaaatggatacaagggataaagtatctgcagcaattacagcattgcctgaaaaatcagcttatttgatttttgaccaaggcgtgcgtgatcgtgccacagctattgaattttatgaccaaaaaggatatgtcacaactggaaagacaatggaagaattagcagaaaaaatcgatttaccaaaagaaacactagcaaaaacagttgatggatggaatacggatgttgcggagaaaaaagatgctcaattcaaccgtgccacagccatggaacatgacttatcgtctccgaattattatgcgatcaaaatcgcaccaggaatccattacacgatgggcggtgtgaaaatcaatacgaacactgaagtattagataaagaaaaccagccaattagggggttatatgctgctggtgaagtcacaggtggcttacatggaaacaaccggatcggtggaaattcagttgcggagatcattatttttgggcgacaagcgggcatacaagcagctcgatttgcttcggaaaatgaatgaaatagaacgtaaataaaaagaggttgtgaaatcagcgttttgagctaataccgagggtcagctgattgaacactgtttagtgaagaggttgtgaaaaagctgccctgcatcaagtaataagaacagccaagtaaaaacagcttcttatgtttttaacttggttggacttattaccgcagatgcaagcttttgaacaccgtttattcggaaaaagagcgtgggacaaaagtaaagaacacttttgtctcacgctctaaacacgtataaacggcggaagcagaagaaattccttcggaaataagctgaaattcacaaaaatttgaaaagcaattttcgtgaatttcttcttatttcttggagttaaacgcttctgtcccagcctcttttttgatcagcatgattttattcagttatcttcaaaatgatttttccgatgtttttgtttgcttccatatattcatgcgcttgtttgactgcgctgaattggaatgtacggtcaatgattggccgaatcttgccattttctagaaaaggcccagctttttgcataaaagtttgtgcgagctctgctttatactgatcacttctaggtgtcaataatgtaccaagcagttggacacgtttcccaatcaatacaccaaggtctatctcaggcacgatggtcccacctagcataccaatcaagacccaacgtccatcaacggctatagaagctaaattcttttcccagtaagaagcgccgatgaaatccaaaataacatcgactccccgaccttcagtgatttttcgtacctcttcttgaaagtcttgttttttatagttgatcaattcatctgcaccaagttctttacaaaaggcgagtttttcttctgatcctgcagtaacgatgattttcgcgtgagaaagctgtctagctaattggatcgctgctgttcccacaccacttgctcctgcatggatcaagacagtttcgccttcttgtaattttccaagccagtaaagtgtttgataagcagtcaaaaaaacttctgagattccagcagcagaaacatagtctagcgtatcagggagaaggattgcacgatcggcaggcatcacagcatattcggcataaccacctagattgactaatccgtatacttttgtcccaggagtaaaagtggagatatcacttttattctcaactacctctccagctacttcgactcccaaaatagggtagggaggtttcaaagagactgattctcttttcataatatctgttcgattgacagctgctgtatggactttgatcagtaattcgccttgttttggtttaggaacaggcacttcaatttgttctaatacatctacagaaccaggatgcttgattgaaatggcacgcatggatctattcctcctttgcccattcttggaatgctgtattcaactctttgctaccttcagaaagtactagagtcgtacgagaaatatccgtttcttccactagagcggcaagtacagcagcaactgtagagcgagtgatcgtttttgatgccttctcattaggcttagttaattgaatggaagtaacttcttcatcgttagtcaatgtgactggttgaagaatgacaaaatctaagttagttcgtttcagccattcatctgcataatgtttagtaatataataatctgtcatggactcaggccattttgctggttcatctgcataaacagcactgaccatcagatagcgagagacatgcgcattttcagctgcgatcactgttttgattgcgccatccaagtctacttgcagaagattctttccttgagagccggcagcaaaaatcaatacatcgatgcctttgaatgcttcggtcattttttccacggaccaagttaaatcaaaagagacatacgaaacattctctttttttactaatgtttgggaagcaacatctctcacccctgcaaaaatttcatgggaacttggagctaaatcttttatcaggtgtcggccaatttgtccgtttgcacctacaacaaaaattttcatttggatcatcctttcgacgtcaaatctttccattcaatagtaacaccaaaagagaaaaaaatcagagatcggctacgatgactatcagttagtaagagaagggtgcttgaagtatcttaacaagacattgcatactgctgcagtcgcaagacctgcgacgattccttcaggtataccacttgtaaaaataaccgctagaatagctgaataaacagcatttaaatttgttccgatgactttggcataatcttgctggaataaaaagtagatcatattcatcactaaaatcgtattggtcaatgaaccggaaagtccagctaagaataaagaaacggaatctgctttttgtttcattagtttgcgcagacctttataaacgaaataaggaaccaccccaatcaagatgcgaggaataaacgcgatcagcaaggctttccagcttccatgttctgttccgatgactgggataaacggagaaaagacaaaagacaaaggtgtttggataactgtgctacggatcatgctgatcagtccaaatgtaccgccaagaaaagcacctagtcttggtcctaaaacgatcgaagcaatgattacaggaatatgcatggttgttgcattgattggaccgatagggataaaacctaaaggcgtaacagctaataaaatcaaaatagctaaaaacatcgcagttaatgtaaagttttttgtatttttcataagtactccttttttctaagcatttctttcattaagagtcagcatgacctgttcgatgatcgtctgaatatcagctaaggcaccttttccaaaatctccacaagctaaaagagattctcttggttcaatttcctgatagccgacagatctcaatgtttccagattacgctgagtgatcgggttttgatacatattcgtgttcatggcaggggcaatcaattttggtgttcccactggaagcgccattgcgactgttgaaagaagatcgtctgcaatgccgtttgctagcttgccgataatgtttgctgtagcaggcgcgatgagaaacaagtcagcttgttttgctagttcgatatgattgattacctgcggatttgattcttgcatgacgtctgtatggactgcgcgcttcgacagagattgcaaggttaatggcgtgataaaatgtgtgctgcttttagacataatcacatctacctgggcacctaatttgacgaattgacttgtaagatcagcgcttttgtaagcagaaatacttccagtaacgcctagtaagatctttttcattttgattcctccagtctaattttctcagtaatcaatgcagcaatctcagatttactttgagcttcttccactgttccatctttagataagagatagccgtggtgtgtctcgccatggatttccgtcaaatcatttgcgaaaataaaatcagttttgttatttatcagactattttttgcgactgccagaagagattcctttggtacatctactaatagtttgaaaccaatgatttttgcttttggctgccattcacgtagataagaaatgatttttggtgttttcttcaaaacgagcacaagatgctcggtgttagaagagatctttgaaacagtggtatctgtctgttcattttccgcaaaccaattgtccagttcttcttgcgttgaagaagtgggtaggttttttgccagctgttcttctgaaaaactaaaagcaggagtaaaatcactgactgccatactgtggataatcgcatcgtagtgttcttttttcgttagttcttctaattgtaaaaataagtccagtgcagattcgatcgtataaatcgttatattggagtgtcttttcggtttcagtgcttgtttcgtagtcacgtaatcgattgtggtatccggattggcagctaaataatcagctaatgcttgccctaatcgtcctgtcgaatgatttgtaatagcacgtacttgatcgattttttcagtcgttcctccagctgtgattagaatcttcatttatggtcacctacatttactagtgttcttccttggtgtgttccagcaagtagtttagatgctgtttcaggcaattgatccagagtaatctcttggacgaccagttcatctgcaatctgcaaatccgccatctgttgccataaagaaagacgttgatctattggtacattgacagaatcaattccaatcaactggatgtttcgcagaataaaaggcaagacagtcgcgtttagtttgattcccccagcattgccacataaagctactgcaccgttataagagatcaatggaagaagactgcttagctgctcgccacctactgtgtcgatgacatagtcgatttgctgttttcctaaagcttttgttgtctctggcagaaattcatcaggtcgtacgacttgcaaagcacctagactttttagccatgtgacagactcttcttttctggaaaaggcaatgattgactggaatcctagtttatgtaacagggctatcgctgtactgcctacaccgccagaagcaccagtaacgacaacttttttatcggaggtcataccttgacggattaaagcgttcacacacaacatagcagtaaaccctgctgtaccaaggatcatcgcttgacgcagcgtcatattttttggtagaggaactaaccagtctcctggtactttttgatattggctataaccgcctggatgggtgacgccaagcccaaaaccagtagcaagtacaagatcttcttttgaaaaacgtggattgttactttggacgacagttccggataaatcaatccctggagtcatcggatatgttcgtatcacctgaccagactcgctcattgccaatgcatctttataattgacatcagaataggcaatttttaccaagacttcattttcagccaactcagtaaatggcagatcactgattgctgtatggaaaacaggttcctttattacctgaaaagatcgaaaagcgttcattcgtgagacactccttttaaaattttcttttatcataccataaagcctactcttttattcttgttcttccgtaaatttagacaaaaattaggtgaaaaataaagaatcaaacaactagaatttattccaaaagataaagaaatattcagcaaaaaaaattttacaaagggttgcctttttcaataaatttcgtatactaatacgagtggtagtaaacaggaagtttactattagaaaacttcgattcggaggaaattatggaaattggtgagaagttaagaaatttgcgcatccaaaagaatttgacacaagaagaactaggcgaacgcacagatttgtcaaaagggtatatttcccagttggaacgagatttaagttcaccatcaatggaaacattcttttctattcttgaagtcttaggtgtgactccagaagaattttttcatcaagaagcagcgaatctgcaagtggtttattcaaaagaagatcatacggtttatttcgatgaagaaaacgggtatgaattggaatggctcgtggctgattcgaatgaaaaagaaatggagcctgtcttgctgacttttgaaggtgcaggagaatataagacgtttgaaccttcattatctgaaacgtttatttttgtattagaaggggaattagagttaagcttaggagagacggtctatgtggcaaaagcaggacagtcgatctattatcaagcgacaaaacaacatcaattaaggaatcatctcaaaaaacgaacaaaagtattgattgttgcaacgcaatcatatttgtaatatagggggtaaaaacgtggggaaaccaatcatttcatttgatcaagtagtgaaacgctatgatgatgaaacagtattaaaaaaagtaagttttgagatcgaacaaggaaaattttatacactgcttggtccttccggctgtggtaaaacaacgatcctacgtattatagctggattcaccgaagctacagaaggggacatctattttgaagggaaacggttgaatgatttgccagctaataagcgacaagtaaatacagtcttccaagattatgcactttttcctcatatgaatgtttttgataacgttgcttttggattgaagatcaagaaaatgtccaaatcagatatcgaaaagaaggtaaaagatgctttgcgtatggtccagcttcctggatacgaaaaacgggagattagtgaaatgtctggtggtcaaagacagcgtgtagcgattgcacgagcaattgtaaatgaaccgaaagtattgctattagatgaaccgttatcggcgcttgatttgaaactacgtacagatatgcagtatgaactgcgggatctgcaacaacgattaggaatcacgtttatttttgttactcatgaccaagaagaagcgttggcaatgagtgatgagatttttgtcatgaataaagggaaaatcgtccaaagtggtacacccgtagatatttatgatgagccaatcaatcatttcgttgctgattttgttggggagagcaatatcgtggacggtgtaatgatcgaagataatctagttgagtttgttggtaagcaatttgaatgtgtcgatggcgggatgcgtctaaatgaaccagttgaagttgttttacgcccagaggatttgacgatcacgacaccagataaaggaaaactagtcgtaacggtcgatactcagctgtttcgtggtgtccattatgaaatcatctgttatgatgaacagcaaaatgaatggatggtccattcaacgaaaaaagctaaagaaggaagcaaagtaggattggcctttgagccagaagatatccatgtcatgcgtttcaacgagtctgaagaagaattcgatgcacgtcttgacagctacgaagaataggggggacaagaatgaaaacaatgcgcaggatctattccgtcccttatattttgtggctcggtttattcgtgatcgcgcctgtattaatgatcatttatcaatctttttttgatatgaatgggcaattcacgctgaataattatctatcttattttacgtcggggacatcgctttctatgacgatcaattctgtatggtatgcatttttgatcacgtttttcacgctgatcatcagttacccgactgcttattttttaacaaaactgaagcacaagcaattatggctgatgctgattattttgcctacatgggtgaatctgctgcttaaagcttacgcatttattgggattttcagtgtgcacggcagcgtgaatcatttctttgattttatcgggatcgggccgaaacagatattattcacagacttcagttttctgttcgtggcaacgtatatcgagattccatttatgattatgccaattttcaatgcattggaagagatgaatccttctttgatcagtgctagtagagatttaggcgcgaatagctttgagaccttccgacgagtgatttttccgttatcattaaatggtgtgaaaagtggtgtccaagcagtatttattccttctctttctttattcatgctgactcgtctgattggcggaaatcgggtgatcactttaggaacggctatcgaacagcatttcttggttacacaaaactgggggatgggttctacaatcggtgtgattttaatcattgctatgttcatcgtgatgctcctgacaggcgagaagaaaaaaggaggtcgctcataaatgaaaaaatttaaatggtcgtatctttatttagggatcgtctttttattcttatatgcaccgatcttctatctgattttttattccttcaatgaaggaggaacgatgaacagctttacaggatttacttgggaaaattatgaagctgtttttgaagatacacgtttgatcattatcgtattgaatacgttcatgctggctttcttatctgcattgatcgccacgatcatcgggacatttggggctatgggaatctattacacgaaaaaacgacgtgcacggacagcgttgttgagcatgaataacatcttattagtctctcctgatgttattatcggtgctagtttcttgattttctttacactactaggattcggattaggttttcagagtgtattgctttcccatattgctttcagcattccaatcgtcgtcttgatggtcttgccaaaattgcaggaaatgaacgattcaatggtcgatgcggctagagaccttggtgctaataatttccaagtagtcaaaaatatcattttgccttatctttctccaggaatcatagctggatattttatggcatttacctattctcttgatgattttgcggttacatttttcgtcacaggaaatggctttacgacgctctcagtagagatctattctcgtgcaagacaaggaatcagtttagaaatcaatgcgctaagtgcgttagttttcttgttctccatgatattggtcattggatactactttattagtaaagaaaaccgtccaaaacggctgaagaaaaacagaagagtacgcgagggggtggcacggctgcgatgaaaaaattacaatctctgtttttaggtattctcatcattattgcggtgctgctgcttggtgttcgtcaacttgaaaaaacaagtggcatgagtggagcaaaggtacttaccatctataactggggagattatatcgatcctagtttgatcacgaaatttgaaaaagaatatggatacaaagtgaattatgaaacatttgattctaatgaagcgatgttcacaaaaatccagcaaggtgggacaaactacgacatcgctataccaagtgaatatatgatccaaaaaatgatcaaagaaaaactagtacttccattagatcattcgaagatcaaaggattaaataatattgatccacgatttttagacttggattttgatccagataatcagtattcgattccatatttttggggaactttagggatcgtatataacgataaattctttgatgcaaatcaaattaagcattgggatgatttgtggaagccggaattaaaagacagtttgatgctgattgacggtgcacgagaagttatggggctttctttgaatagtttaggctattctttgaatagtaagaatatggcacagctgacagaagcagcaaataaattgaatcatttaacaccaaatgtcaaagcaatcgtggcagatgagatcaaaatgtatatgatcaatgaagaagcctccgtggcagtgacattttctggcgaagctgccgatatgatgtgggaaaatgaacatttacattatgtgatcccaccagaaggatccaatctttggtttgataatatcgttatgccaaaaaccgtgaaaaataaagaaggtgcctatgatttcatcaactttatgctagaaccggaaaatgcggcacaaaatgcagagtatattggttattctacaccaaatgaagaagcaaaagcgttattgccaaaagacatttcgtcggacgaacaattctatccatctgatgacacgatctcccatcttgaagtctacaaagatctaggatcgaaatacctaggcatctataatgacctattcttagaattcaagatgtataggagataatggcaaaactcagtaagaatggggacttatcaacgttctaaagagctaaaaatcgtcctttttctatctgagttttccaatcttctaccaaaagcggatgaaacgccgctttttttgtgttattttattttttctaccacgtttttctaccagagaaaagtggacaaaaccattgtaaaatagggcccgagacgggctagtaaatctaagattgaaaaagttacagaaggataaagtaattggaaactatgcaaatatacttaacccttctgtaatctattaataaaactaatatatgaatccagttcaatatttgtagctatgaaaaaacataaaaatcatattagataaaaactaaattggtagataaattattttgtcagatatctgaggcaaatattcgactatttgtgtttcaaagtaaaaattggaatacaaatatagaatagacatattgcagccgatagtttattatgcttttagacacattaaactggaggaaaaaatgaaaaagagcgctaaagatcgagtttttgatgagctgatacgactaacagggaatatgtcttctgtcactgccgagaaaatttcgaagaatctaggtatctctcgtcagaatgccagccattatttgacgagattagtggaagataaaaaggtcgagaaattaccgggaaagcctgttttgtggaagcctttagatgaatatgcggttgtagataatacggagcaaataaacgaagcctttcattctgtagttggtcatgacggaagtctgagagaggtcattcaaaaatgtatagccgctgtcaaatatccgcctaacggactcagtgtattaataaatggagccacgggtgttggaaaaagttttttagccacaaaaatttttgaatacgctatccatgagcaaattattgaaaaagatgcaccatttgctatcttaaactgtgccgattatgcggacaatcccgaactgctttcggcaacactgtttggatacaagaagggggcctttacgggggctgaaaaggataccgatggtttattggcaacggccaacaacggctatctttttctcgatgaggtccatcgcctatcgaaagaaaatcaagaaaagctctttctatttattgatactggaaactatcgtccagtcggtgaaaatgtaaattggcattctgctaaggttcgttttattttcgccacgacggaaaaaggtgaaaattatttattagacacctttgatcggcgtattcaaattagtgttatgttgccaacttttgaagatcgccccattcgagaacgattagagctgattcaattattttttcaaaatgaagcggatgttttacaaaaagatattattgtttcaagagaagccttgtctttaatgttatctcatccctttagtgggaatattggtaagctgaagaatatcattaaaatcagttgtgcggatgtgtatagtcgaacacaagaagaaccattaacgattgggaaaaatgagatcttgattcagttaaatatgctggaatccgaagtagaaagcttgccgattgctagtttattgataaagaaaaatcaaaagataaaaacggatcgaatcaaaccgtttgattatgattcgattttggaaaaaattactcagctgataaatgaaggtaatttcaatgaaaatttttcttcgataaagaatgaagtacagcatttggtgcatcacattgataaggattcttttttatcaatgagtagaaaattgatgattcagatgtttagaaaggtctgggtatccgttttaggaaaaacgtacggattgacgacgagtggacctgttgcagaaattattagcagatcctatgtcatttccccaagctataagacagacttaaccgggataaatcgtacattagctgcaaatctacctcggacgacttacttatgtaatcagttcttggagcatttaccaccgctctcagaaaaggacgagaactttctaagactgcttattgtcgtgactttatctgattatgtagatgaatccatcgagctgaagggcctgttgcttgctcacggagatagtacggctagcagcattcaagcagtagtgaatcaattatgcggcaattatgtttttgaagcgttggatatgccagtagagagtaatgtgtcagagattgtcgaatcgacaaggaatttcgtgaaacggcaagtgaatacagatagtctagtgctgatcgtagatatgggctctttaaatcaaatttacacacagatcaagaacgatttaaaaggggagttacttcttctgaataatttgacgacttccattgcacttgatattggcttgaagatgacgatgaatgcgccatttaaacagattgcggaggatgcagcagacaagtattcaatcaatgttcaatactttgaaggcttttctcaaagtagcaacattatcatttcctgtatgtcgggtttggggatttcggacaaattgaaagatgtttttcgtcatcatttatcggatgaatccatcgaagttttcacgaaggactacagagaactacgtgaattaatcgaccaaaatgatgaaacttattttgacaagacaaaattggtcatcacgacttcggatcttccacgttccttttcaattcctaatattaatgtttatgacatcttagacggtgatggagcagccaatttggagcatattttgagtcctgaaatgaagccggcagaatttaaccgcttgattcaggagctagtaaaattcttttcgttggaaggaattgcggaccgtttgaactttctgaacccaacgatcgtgatgagtgaagtggaaacagtcatttctaaatatgaaaattactatcatttcactttaaatggccgtgtaaaactaaatctctatatgcatacggcattgatgatggaacgtttattcttggctcggacagaaaaatctgaagaaccgaattatgatttgaaaccagatgaagatgaattttattatgtttctagaagtatttttcaatcaatggagatgaaatataattttaaagtcaatgcttatgagctttcgctgctctatgaattattaggaccgtatattcaaaaataaagtgtctaaaaaagtgtctaatctgttttttttaggttagacactttttttaatgtgaattaacgtgattaaaccaatgtttttaaaagttggcacaggaattgcttatataaaagtgaacagaaagaaaggaattaaccatatgaagaaaattctaatagcgactcacggtcacttagcttcaggctttcttagcagtattcaattactgacggggaaggttcaagagattacggtgattaatgcttatgtggatgagtgtgattttgaacaggagttgaatgtatttgtaaaccaggtgaacgagcaggatcagatttttgtttttaccgatttatttggcggaagtgtcaatcagaagattaccaaaacctttttggagaaagagattgctgtaactattttgtctggctttaatctgccaattctgctcgaaatagtattggcaaccaaggaattaacaaaggaggatattcaggaactggtaaataaatgccaacaggaattaaagatgaccattcttgatgaggtacatgtagtaaatgaagaggaagattttttttaggaggaagaaaaatgattaaagcagtgcgaattgatgaacgattaattcatggacaagtagcgatgacttggacaaagagtctaaatttaaccgggttagtagtagcaagcgatgaggcggctaccaacgatattcaaaagatgacattgaagatggctgcaccatcgaatgtcaaagtcattattaaaacagttgatgacgcgattcatttgttaaaagatccgcgggcgaaggacatgcgcttgatggttttagtccctaatgtcaaagatgcggtaaaagttgcgaaagctttcccaacggaaatcgaattaatgaacgtggggaatgctgggaaaatgacaccgccatcggaagataagaaaaccttatcaaaggaagtgatgttaacgacgtcagaaattcaagacttaaaagaattagttgaactttatccagataccgtttttcagcctacaccggcgatggaaaaacgttcagctatctctattttgagtgatttttagaaaaaggaaggagaaaaattatgtatgatgcatttgtagtcgctttggccgtttttattggagttgctggacatgaaatgttcgggatgtccatgctgagtcgtccgattgttgttgctccgttagcaggagcgttgatgggggatttgcagacggggttgattgtcggggcgtcactagaagccatctttatgggtgtcgtcaatatcggaatctctagtacggcggagccttctttggctgctgggctggctacagcgttcgcaatcaaaatgggaggaaacgtggatgcgattattcccattgtctttccactagcagtattaggattacagttaatgaatatgattttttcttttgtatgtggaccgatggctgctaaatttttcaaatttgcaaaatctggtgatcaaaaaggaatcatcaatctgcacttctttatgtggtttgtccactatgcgctttatgctcttattccattctttgccgttttatttggagcagatgttgtcaaaagcgtcttggataatattccagaggtcatcatgaacggattaacagtcgctggaaatctgctgccggcagttgggatggcgatgctgttacggatgctttggagtaaaaatattgctgtgtggtttttctttggggccgttgttatggcgtatctcgagttaccattgattgcaattgccgcagttggaacgattattgcaattgttatagcccaaagagatctacaactaaaaaatatatctgttcatgcagttcaaagcgatgctgctgtaaatgcaacgcttgaccaagaagaggaggatttctttcaatgaaattagctgatggaatttctaaagatgagaaaaaattggttcggaagatgttttggcgctcgatgactatgtatgcttcggtgaatccggtgacgatgggcggcggtggtttcgcctattctatgatgcccttcattaatcatttctacaaaagtgaagaagatcgagctgcggcgctggaacgtcatacacagtatttttcgacgaccattccttgcgcgtcctttgtcatggggattgcggcatcgatggagaaggaaaattctgaaaaagctggttttgacgtggaaagtatcaacgcgatcaaaacgagtttgatgggaccattggctggaattggcgattcattgttctggggagtttggcgtgtcgttaccgcgggactagcgatcaacttagccaatgccggaaatattttggcaccaattatctttttagttatgttcaatatacctaattacttgatgcgatactatggcggcgttttaggctattcattaggctctaaatatattgaaaagctgtatgcgaacgggttaattgaaattctgacaaaagctgctagtatcttgggtctgatcatggtaggtgcaatgacgatcagtatggtcaaattcaataccgttttgagcttttcaatgaagggcgaagaactaatgaatgtccaagaaatcctcgatagtatttttaaaggaattgtaccgttattggtaacattgagctgtttcaaattactagataaaaaagtcggcgtcatcaaaattatttttggaatggtcgtcttgggaattttattgtcattacttggaatcgcatagtaggaagctgcagctactaggctgcagtttttttagcaaggagggaaaagatgactattaatgaagtaatttattcacccaaacacccattttttaatgctgagttaaacgacggaaatgtgactacttcaaacgaatacagctactatcggaatattcctgatgtaaagggattgaccttcgatgtaagtaatcaaaagacattagcaaaccttgatgtttgcgggacgattcaaacgttgaccttttatcgagaaaatttactaactgaggaaaaaccaggtgtttgggtcaataaacagctctctcaaaccaattcgttatccttaaaggttgaagtaaacgggattgtctaccatttgtcagaatcggatcatcgtattgaagtcgatgtgattcaagactgtttgcctagatatattcatcattattcgacgtttaaggtcattgtagtatcctttgctcccatactggctaataagcgtttaagtatgcttgttcaacaggtttacattgtgaatgaaacacacgaaagccttcaagtttcagtgaaagatgtgccttcgtatcaagagaagtattcggatcagcaaaatgtgttgatttctcaaaaaggaaataaggacacgatcgcacaacaggaagtggcaagcttcgccattgcttttgtggacccaaatgcttttgaagaagtaatgacttttcaggaatctgatatcgaaaaatggctgaaggaaacattgaactattttgctcagctatttgggcagctgtcaatgccaaacgatagagttgtccatctctatcgtcgtgcactttatcaaagcttttctagtttcggtatgaatcgacagggacaggtcgtcggcagcaattggggcagctatcctgctactaatcgaatttggaataaggatatgtattacgcatcattgccattcaccatgtttgaaccggagttatgtcaaaaaacggttctatggtttgatcaatatggcgttaagtttcctggttcaaaatttacaggaggtatcaatcattctctgagtaattcgttatccagtgcgttactggctagtctttattttgaacatactggggatacaaaattctttgagcggtgtccgcaggttctactgaatgcttcaagaattattgaggacatattagctcaacgtcggtcaggggaaccaatgctttttccatctgtttggttatcagacgcctttgcacttggaaagtatcataccggcagcaatctttgtctttggaaggcctgtattggacttgcagaaatttttgaagccctagaacaactgagtcttagcaagcgatacaaaaacattgcctgtaaactaaaggaatcaatttgtaaacaaatgactatcgatggtccttttggtgagcaatttttggagggaatcggtgatgaggagaaaacaacctattcagtgaagcactatcaaaaaccgattcttgagcaagggttaatctttttaagtgatgtgattgtggatggaaaaattaatttattgatgcatgatggagaagaatcagacactacgttgatgcctttttatcaatttttagataataaagatcatttatatcagaacaccatggccttttctgctagttctttcaatccaacctatagcgaggaaatcaaaggcatcacttggggattagaatccggcgccacttttcctggctttatcactgttttaatgagcgagctgcacaaccctcaagctttcgtaacccgattagaagaactaatttgtttggcagatttagacggttcgtggtggtggtggccgtatcgcttagaggctcaacaaggagaagtcgtgcgagactttggctgcggcaaatgcggctgggcatcgggtctttttgtcagcctaatgatcagtcaatatttcggattgaaattcaaaaaaggagtattgcaaattgatcctgttgataatttaacgttttcttggaagaatttgaagttcggtcaagccttcatttcgattgaatgtacgcaatccgagttgagtatttcaaatttgtcagaaaagccattgaaaataagtgatacgaaaaaaattcttcacgtagaaaagggaaaaacgattcacattcaaaggagaaaaagatgagtatactaaaaaatattacccaatttaaaaaaatccagagtcgagcaatcactcccgaaaatccaacaggcgagaaaggtaaagctgcgatgttgccaagcgagctaggaccaagccgcaaaggtcgtggcgcaattccgctgacttctggtgaagaaactgtgattgcggatattactggaacgggaataattcgtcatatgtggatgacgattcgtgatcgaacagaatttggcagttttgttttacgtgatttaatcttaagaatttattgggatgggtcggatagccctgctgttgaaagtcctttaggggatttcttttgtaatgggtttggagagcgttgcgaggtgaactcgttgccgatagtggttaatcctacagggggctttaattcctatttcgaaatgcctttccaaacatccgctaaaattacgatcgagaatttacatccgaaggatatgtcctcatttttttatacgataaattacgctttggtggacgaattggaagaaaatagcctatattttcacgcaaattggcatcgggaacgcattaccaaattacaggaggattataagttaattgatcgattaaagggtcaaggctattacgtgggtacttaccttgcgcttacctgcctagaacgttattggtggggcgaaggcgagtttaaattctacattgatggggatagtgagtatccgaccgtaacctcaacaggttcagaagattattttggcggggcgtgggcctttcatgagtacgatgagttcggacgtccacatgcgaaaaactattcaacagcctttttagggtatccttaccaatcaaatagagatgccacaagagatcgttttgaaacgggaaaattgaatgccgttcatgcctttggtgacgacgcaatgccacgacatggtctttatcgttggcatcttcaagaccccatctgttttaccgaagatttatcggtcactttacaacaaatcggcaacgatgatgttcgcttatttgagcggcaagacgatgttgctagtgtcgcttactggtattcaacagaagcttcaggaaatactaaacgtcatttcactgatcgagaacgcttgccgcgttaatgaagtgtttttcacatattcgaagggaggaacctatgatgatatatggggcaattgaagctggagggactaaatttgtctgtgcagtcggtactgaggaattaacgattttggaaagagtcagttttcccacaacaactccagttgaaacaatgaagcaggtcattgatttttttaaaccttttaaggaacaattggcaggcatcggggtcggctgctttggtccaattgatattcaatgcaaatcaacgagtttcggtcatatcacatcaacaccaaaacttgcttggcaaaatttcaattttgtaggaacgctaaagcaatatttcaatattccgattgaatggacaacagatgtcaatgcggcttgctatggtgaatatgttgctggttctggcaaagggttagcaggtgttgcatacttcactgtgggaacaggtatcggaggtggtgccttgttcaatgggactttcgtggaagggttcagtcatccggaaatggggcatatgttgatcaagcgacatccaaaggacaatttttcaggaaactgtcccttccaccaagattgtttagaggggatggcagcaggaccagcgattgaaaaacggttgggtgtaaaaggccagaatttattggctgacgattcgttttggcagattgaagccttttaccttgcccaatgtgcatacaatacaacactgatgttttcgccagatagaattatttttggcggtggtgtaatgaaacaagaacacatgaagaaaaaagttcaggataaatttgttgagcttataaatggatatgttgaaataccaccaattgatagctacattattacgcccgaattaggtgataatgccggaataatcggcggattagcattggccagaaaagcggtaagaaataagcaaccataattaatgaatgtttcattgatactcatgtcaaaagtatttaaccgagtaatcaaatgatcaaatgaagttggataaagcgaaaatgaattcaaataaaaaggctctaagtcaaatcgtgttgttttcattaaatcactgaaaggaaatgcttctgcgtttccttttttctttttgttgtgcgctgtataccttgaggatattcactggtggcgtacacttaaatagtaatatattgtgttactttatgtctgtggtaatagttatagttgcttaccaatgtatgttcatttttcgaaatgttgacttcataatccttggcttaatgtttgaatttttttggtgatagattttttcagccgtataaaataaatcgtaattctattatagagagttgtgattataaaaagatagcaagaaaaaaaagaaagtttctatacattttaaatattttattcctatttctattgctaaaaaagtagaaattctatatttacctttaactctcgcttctcttgcaaatgtagttagcattttaatcgataataaactcaggtagttatattaccttgaaatgattgataattttgtcacttctattttttttgcaataaattttttattttagtgaaaaataagaaactatttctttgaaggcgataagttagaaaaatattattgtagtcttttctttattaggaatcatcactgttgtatcttattaccttttctgtttttcttattagagaaaaataatttgagaggtagatagtttttattggaggaagtaattatgtatatttttgaaacaaaaatttttcattgcaataattgcaacaaagaaatttcatcgggggaagaggtttggacaaaaatggaaatttccgccaaaagtaactgctcctcaactgaaatcaattaaagaactagaatttgagaatgcactggtaatttgtatgacatgtactgatgaagtatttcgaaaacatttttaaaggttgagatgtatatagatttaaccaatcatttatctctctcggaaaaggaatattaactaaccagcgggttatcaaaaataggtaggaaaactgtacttaatggcttatttcgcgctgattatgagaatatcagtctgtttgattaatttttagggttcaaaatacagagacaaactccaggtcgggtttcgccacaagcgaattacccgatctggagttttgtctattgcaggaaggcgtagccggactgcaggaataaagcccccggttctaacagggggctaacaaagaacaggaaactgtgacaactacccattggggagtgtcctagcagtattttctttgtcacgtgcttatcaattttgtcacctcattttgatgatggatacgctgcatttaacaggcgttctttctcgacttccatcacgaatggtagataaagatattgctgttctagtagatattgattgtcctctgtgtactgataagaagcggtttcttctgaatagaccaacggggcaattcgcacatcgctggtcaattgattaattgagtatagaaggatggctttctcacctagttccttgggtaaatgtttcccaaaataggaataggatttttgatttgctaaatagacgagtatgcgatccacactaaagttggagaaggtaaagggcatcatgtgcagaatatgattttgattatcatgttgcaaatagagctgggcttccttaccaaaattagttgaaccaagataaagctgctttttttcatcgatacattggaaagtaaactggtcttgttcagttggtggaatgagatttgtaataaaaaattcaatcattcgatccatttctttttcactaacaaggtcagcgtgtttgatttcgtctactatgagaccttcaatcttaggatcaagcttacctgcctttttttggagcatttctaaaatgtattgattctcttgatcaccatacaaaagatattcattggtgacatgacctatctctgcgatttggtgaagggtttcggtttttggaaggttgatcccacgttcccagttattgactgtacttcgcggtaaatcaccaattagtttgccaaatttctccatactcaactttaattcttggcgaatctgccgaattcgattgccgactgcttgcttgtctatctccatgaaaactcctcctcaggataagttcttaaatttagtatacgtgtgtacttaaaaaaagtcaaaacatattgacttaaaataaatacaggcgtacaataaaaatgtacttaaaataagttcaataggttctttgacaagtaaatagcagaaggaggtttgtcgatgaaccaagttaatcaacatgatctcggtgaagccattcgagtttctcgagaagaaagggggtggacacaacgatatttagcagaaaaagtggggatttcgagatagttattatcgaaagtagaaaaaggaacgagacaattaagtgaagaaaaattgaatcttgtgttggatagtttgcaagaagaggtcgttccagttaaccgtgttttgattgattatctaaccattcactttttctcgaatcaacatttaaagctaattgaagagattattgaaatgcccattgaacgttttgaggaactggattatgcgccaaagggctatattggccaatacgtgtggaatcaagtaatcacgattcggtattccattgacgatgcggttaaaggaactgtgatggagttttcaggtcaaggctgtaaacacttagcaagatggctaaaaacacgaaaaacaaattggcaacagttttttcgtaaggtattagattatcaggggaactttacacggattgattttactttagatgattttgtggggagtctcagcattccagaacttaagcataaggtaatactaggccatgtgtggaccacttttcaagtgagtgaatctcatggcggtacggatatcataaacaatgaatcaaatggtgagaccttgtatttaggctcaaagaagagtcagtgtcgtttttgcttttatcagaaggaccatgaacaacggaagcgacgaggaattcctttagaagaggcaaaagtaaagaatcgctttgaactacggtatcgaaaagagaaagcgcaaagcttggcaaagattatttcaaaaacccatgatttaaccaaactgttctttgagttacttaatggagcaatttgtttttatgaccgtgatccaaatgatctaggtgcaaaagttgatgccaaatgggcagcctttattagcaattatggcgcaatcaccatttctttagatacaattcctcaaagttttgagaaaactatgagttggttaattcatggtgtttcaccatcattagtttttattgcacaggtcgatcaaacgtttcattcttccttgttgcctttgattattgaacaaggagaaatgaatccaagacagatcaaacttctccaaaatatgaaggcagacccggagtattatcaggaggaggttgagtattatgaacgaaaattacaaagtatatcaaatgagaaaacaagctactaaaaaagcaaagtactgcttacacaacaagttgtgcaacgtactccgcctcgacaagacgagtataacacaaccatcgaatgagaaacaatagattataaagaggattattttaaaaggagtaaagaatcaggaggtgagagaatggaaacaaaatgtgatttcatggtaaatcgtgcaattttgatagagatgggctttaaacctagtcaagctgcacgaatgattaaagagagcaaggcatatcttgcaaggattgaaggtattgatttttataataatcgccaagttggtgtggtgccatcccgagtaattgaacatctttttcacattcaagttgcggaataaacagtacaagcgcggtactattaaagtagcttttctcaagtacagggaggaatggaacgatgccaaaaattaaaaatatttaccaagataaaaagacaaaaaaatggttcttccgagcgtatctaggtatagatgaaaatggaagaaaggttcagaagactaaacgaggttatgcttcacaaaaagatgccaaaattgcttatgacaagtacatggaaacacatgattttaacaagacaattcctaatcaactgtgttctaccaatcaaatgactttcgaagagttttacaaggataggtttgtaaaatggtacgagagacaggtcaaaagtcaaacatatgagaatgcgcaattcattttcgaaaagcgtatgcagtttttctatcattttcgtgttcgagatattacaagtcacgatattgaggattggttatttgaactaagccagacagagtcacgtaattcacggaaaaaagttaatggcgaaacgttatcaaaatcttatatcaatcggattcgagggcacctaaaaattgtattggatcgggctgttaaagagggggtgattgctaaaaatcccgttgaagatgtttcttcgcttccttctgagaataagaaagttgagttttgggaacacagtgagtttcaaaaagtgatgaatgaattgaaggatgataagattcaaacccaccatcggaagattgtgtatgaaatgctcttttatactggcattcggattggagaacttgaagctttgtcttggtcgaatgtagattttgagaaaaacacgataacgattgagaagacattgatttataatacaaaagatgattggtacttttcgactcccaaaactaaatgtgcttatcgaacgattgggttggggaagaagctttccttaaaactcagacagtggtatgacttgcaaaaacgtattggaaattttgaatatgttgctcagttggacggaacatttacgccaccttattcttttgcgaactggttaaaagaagctgctaaaaaagcgggtgtcaaaccgattaagcttcacgcgctacgacattctcatgttgcatttctaattgagcagaatattcaaccgctatctattcaagaacgattgggccatgcgaatattcaaatcactttaggaacttacggtcacttatatgcaaagtcagatcaacaagtggtaagtgcgattgataatgttcaagagggcgctattctttcaaaaaatgacaatttattaccagtctgagttttccacggttctaccataagacaaataaatgcttttgcaccagtgttttcagtcgaattgctcctgttcaagatgtatcggaaatagcgagaaaataagcaaatttgcataactataataaaaaggacttagttttgatgggaaatttttcaaaattaagtccttttttatgtggttgaaacgggtatgatcattttaaggaagtgatctaagatgaaaggacgactgaacaattatcatattagaaaagctttattgtattccacaaacaaattactaagaataacaaattagtttttgtttgttcttattccctattgacttttctttcaaacatgctattctaattttattctaatagtatccgatgagaaggaaagtagacagaaaatggttcaagagaggctttggttggtgtaaaaagctagaagttgactgtcgaaaatggccttagaggattttttgtcgaaaggtaggcaaaaacgaacagtctttcgttaccaagaccactgattttattgtcaggctgagagaaagaatgttttttctgaaaaaaggtggtaccacgagtataatcgtccttttactagtatttgctagtaaaaggatttttttttacaaaaaacaaagaaaagagtgagtgaaatgagcaaaaatagaccatttacagtagatcatgtcggaagtttcttacgcccgcaatcgatcaaagaagcaagaaaaaaagttcaagaaggcttactttcaaaagaagaacttcgtgcaatcgaagaccaggaaataaaaaaattagtggaagaccaaaaagcagtcggcatcaaaggaattacagatggtgaatttcggcgtggattttggcatcttgattttttagaagaactaaatggtatcgaaggctatgttccagaaactggatataatcaaacattccacggaaaagcagcaccagcttataatattcgggtagtagataaattatctttcaatccaaatcacccatttttaaaagattttgcttttctgaaagaagtagtggaaacagatgatacttttgttgcaaaagcaacgatccctagtcccacgatgattttacgacaagagatcctatctaatgatggttcttcaaaaatcaaggagatttatcctgatctatctgatttttatgaggacttgtcctctacttacaaagcagcgattcatgctttttatgaaaaaggttgccgttacctgcaattcgatgatacaaattgggcgtttctagctgatcaaactaaaagagaagcacttcttcaaaaaggaattgatccgaaagaaatggcccatatttgtacagagattatcaataacgcactggaagacaaaccagaagatttgacgatcacaacacatatctgccgcgggaatcacgcttcttcttggctgttttccggtggatatgaacccattgcagaagagttgttttcaacaaattatgatggtttctttttggaatacgattctgaccgagcaggagattttactcctttaagacattggagtaacaaagaaagtaaagttgttttaggattagttacttctaagtttccagatttggaagatacggagaaaataaaagaacgaataaaagaagcacaacaatttgtaccattggaaaatctaagtatcagtcctcaatgtgggtttgcttcaacagaagaaggaaaccatttaacagaagaagaacaatggaagaaaatccaattattgcagcaagtcgcaaaagaagtttggctataaaaatgtgaggcttggcaaaaaaaagcgtcccaaaaagtcggcttttcatggagtggagaaatccactcttttttatttaccttttatattatttatttgtattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaattccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatcttttttcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgcaataaaaacactaataaaggatagtacagtataataaaaaataaaaggtatctggtacgaaaatcaactagataccttttttgtgttcttatttttttgttattttataaaaaatagagatctcatgttagaaaacctaacatatgcagttgacaatattttttttaattggtacactttagccaacttataaaacgaaaggggacgtctgatgggagaaaaggaattgcgccgatctatgtccgtatttccaattggtacagttatgaagctgactgatttgtctgctcggcaaattcgctattatgaagaacaagatttagttcatccggaacgaagcgaaggaaaccgacgtatgtattcgctgaatgatattgatatgttgcttgagattaaagactatctttcagagggattgaatatggctgggatcaaacgtgtatacgaaatggcacaggcgaaaaaacaagaagcaaaaaacaagaagccgttgacagatcatgacgttcgacaaatttttcgtgatgagattttggcgcaaggtgggttaagcaaaacaggtcattatcagtcgcaaggattgcaaagacaattctttgactgaataaattaaaaaaggaagagggataccatggtaaagaaacagataacaggtgaagaaatcaaacgaatcattgaggaagaaaacgtacgatttttacgattgatgttcacagacatcttaggtacgatcaaaaatgtagaagttccagtgagccagatcgacaaagtattagaaaataaaatgatgtttgacggttcttcgattgaaggatttgttcgaattgaagaaagcgatatgtatttgtatccagatctctccacttggatgatcttcccgtgggaaagtgctcatggaaaagttgctcgtttaatttgtgatatctataatccggatgggacaccatttgccggcgatcctcgcgggaatttgaaacgagcattgaaagatatgcgcgaccttggttttacctctttcaatttaggacctgaaccagaattcttcttatttaaattagacgaagacggtgggatcacaacgaccttgaatgataaaggtggttattttgattttgcaccaacagatttaggtgaaaattgccgccgtgacatcgtgttggaattagaaagtctaggctttgaagtggaagcttcacatcatgaagtagcgccaggacagcatgaaattgactttaaatatgcagatgtggtagatgcttgtgataatatccaaaccttcaagctcgttgtcaaaacgattgcacgcaagcatggacttcacgcgactttcatgccgaaaccgttatttgggatcaatggttctggtatgcattgcaatatgtctttgttcaatgatgaaggaaatgttttctatgataaagacggtgaattggaactaagtgaaacagcttatcatttcttaggtggtttgctgaaacatgctcgtgcctacacagccgtttgcaatccaacagtcaattcttataaacgtctcgttccaggttatgaagcgcctgtttatgtcgcatggagtggccgtaatcgttcgccattagtacgtgtaccagaatctcgcggtttatccacacgtttggaattgcggtcagttgatccatctgcaaacccatacttggcaatggcagtattgttgcaagcaggactagacggtatccgtaatcagatcacaccgccagcagctgttgaccgtaacatttatgtaatggatgaggaagaaagagaagctgcacatatccaggacttaccttcaactatccataatgctatcaaagaattgcgtaaggataatgtaatgattgacgcattaggacaacatatcttctcaaattttgttgaagcaaaacgtctcgaatgggcggcattcagacaaactgtttccgagtgggaaagagaacaatatctagaactttattaaaacaggaataccgtgaattagaggctgtgaaatcagcgttttgacctgagtattagagaaactaacggaaaaatagttcctcatattttgccgttttttgagctaataccgagggtcagctgattgaacaccgtttagtggagaggttgtgaaaaagctgccctgcaacaagtaataagaatagccaagcaaaaacagcttttcttgtttttgaattggctgaacttattaccgcagatgcaagcttttgaacaccgtttaccaagaggttttgaaaaagacgtttagtttcgagtattaagaaaaattttgtgaaaatggctttctacatttttgcataaatttggcttaataccgagaaactggcttttgaataccgtttatccagaggttgtgagcctaccatttaactccgaatcacaagaaataatttcaaaaacagcttctcatgtttgatggatattgtgacttgtgaccgaggagttggcaggagaacaccgtttatttagaaataaggaggcacgacttttgtcgcatctccttattttttacttatgtgattcgttaccttcaatgaatccctacaaggcacttttgttgaaaaaaaggtcatctttgaaaaaattagtggaattgttttgtttttgatattatttaatagaaaagatatgccaaaaatccgagaactgtggactacgttttttacgtaaaggaggtaaataagggtgaaagaaaaagattgtttctacgataagctatataaactgttgctgcaagtaggaaaaagtagttctttgttaggtgggatattatctatcataatgtttgttttatttttttatctattatttcacttaaaatttttcagtaacgattttctgatttgcttaggtttaacgttagctatgtttatatcaagcttattatgtgggttaaattttttttgcactcataaaggacttaagaaataatttctcaaaggatatcgaaaaagaaaaaattgtaagcggatagtattcatttgagtacttgactttcccttagtcagcttgtattatacaccttgggcacccttttagagggtcagaagtttacagaaatttcggctccctattcttattgaagaatagggagctttgtttattgtctgagacttttcctgcacataaattaaaaaggagtttttgaacttatgacaaaatatatttttgtgaccggcggtgtcgtttcatcaatcggaaaagggattgttgcagcttctttaggacgcttattgaaaaaccgcggcttaaaagtaactatccaaaaatttgatccatacatcaacgtggatccggggacgatgagcccatatcagcacggagaagtattcgtaacagatgatggtgctgaaacagatttggatctgggccactacgaacgttttattgacatcaatttgaacaaatactccaacgtgacgacaggaaaaatctattctgaagttttgcgtaaagaacgtaagggcgaatacttgggagcaactgttcaagttattcctcatattacaaatgagatcaaagaaaaaatcatgcgagcagctaaaatgactgattcagatgtgatcattacagaagtagggggaacagtaggggatatagaatctttgccattccttgaagcacttcgtcaaatgaaagcagatgtcggtacagataatgttatgtatatccatacaacattgattccttacttgaaagctgctggagaaatgaaaactaaaccaacgcagcacagtgtaaaagagctacgtggtttaggtatccaaccgaatattttggtggtacgtacagagcaacctgtttctcaaagcgtgaaaaacaaattggcacaattttgtgatgtcgaaccagaagcagttatcgagtcgccagatgtagatacactttactccatcccattagttttacaagcacaaggaatggatcaaattgtttgcgaccatttaaaactagatacaccagaagcagacatgacagaatggaaagaattagaagaacgtgtcttgaacttgaagaaaaaagtacggattgcgcttgtcggtaaatatgtcgagttaccagatgcatatatctcagtagttgaagcattgaaacattctggtttcgcctataattcagacatcgagatcgattggatcaaagcacaagaattaacgagagaaaatgtagaagaacgtttgaaagacgcagatggaatcttggttcctggtggatttggtgatcgcggagtagaagggaaaatcgaagcgattcgttatgctcgcgaaaatgacgttccgtttttaggtatttgtcttggtatgcagatggcttgtgtcgaatttgcacgtaacgtcgttggattagaagatgcgtcatcagctgaaacgaatccagatacagcaaacaatattattgatttaatggctgatcaggaaaacatcgagaatttgggtggaactttacgccttggattatacccatgtaaaatcaaaaaaggaacgaagacggctgaagcatatgatggagccgatgttgtgcaagaacgtcaccgtcaccgctatgagttcaataacaaatatcgtcaattgtttgaagaacaagggctagtcttttcaggtgtctcaccagataaccgtttagtagaaatcgtagagctgccagagaaaaaattctttgtgggatgccaattccacccagaattgatttctcgtccaaatcgcccgcaaaaattaatcaaagcatttgtcggagcatcattagcagatcacgaaacaaaataatttttgaacttgatagaaagagaaaagtagcaagagaaggggataagcaattttcttgtcacttttctctttttctgatttgttattatttgtaggaaaaaagatagaaagcaaaagacttttttcgattaaagcgctattggatattttattttttgcaaaaaacttcttgaaaattttcattttcattgattttagtagaaaactaccgaaatgtttggtaaaatagggtcgttggttaagaattgtcttaacaaatttagttttacaaaacttaggaggaattttattatgccagtagtatcaggagctgaatttttaaaagctgctcgtaaaggcggttacgctgtcggcggattcaacacaaacaacttggaatggactcaagcaatccttgaagcggctgaagcaaaacaagcaccagtacttatccaaacatcaatgggtgcagctaaatacatgggtggttacaaaatctgtaaagatttaatcactgatttagttgaagcaatgaacatcactgttccagttgctatccacttagaccatggtgattacgaagctgctttggaatgtatcgaattaggctatacttcagtaatgttcgatggttcacatctaccatttgaagaaaacttgaaattagctaaagacgttgttgaaaaagcacatgcaaaaggtatctcagttgaatgtgaagttggttcaatcggcggagaagaagacggaatcatcggtaacggcgaattagctgatattgaagaatgcaaacaaatggttgctacaggtatcgactacttagcttgcggtatcggtaacatccatggtcaatatccagaaaactggaaaggattagcttttgaccacttacaagcaattgctgatgctgtaggtccagacatgcctttagtattacatggcggatcaggtattcctcaagatcaaatcgaaaaagctatctcaatgggtatctcaaaagtaaatgttaacactgaattccaattatcatttgctgcagctactcgtaaatatatcgaacgctggtaaagataaagaaggtaaaggattcgaccctcgtaaattattagctccaggtaaagcagcaatcgttgaagatgctaaatctcatatcgactggttcggttcagctaacaaagcgtaagcatccacataacagatacgatatataggaatggagaacgacttttgaagtcgctctccattcttttttacttaaaacggcagaccatgctcgtttcttttttttatctatgataaaatacaagcatatccatgaaaaaagattaataaacaaggtggaaacagatgaaaaaaatcgtaatcaaaggaaaccgacctttagctggtgaagtaacgatcagcggtgcaaaaaatagtgcagtcgcattgattccagctgcaatcttagctgattccccagtgatcttggaaggtgtgccggacatacaagatgttcattcattaattgaaattttagagatcatgggcgcaactgtccatttttccaacaacatactagaaatcgatcctcgagaagtcgtatcgattccgatgccgcacggaaaaatcaatagtttgcgtgcttcttattattttatgggaacactgcttggtaaatttggcgaagcggtagtaggcctgccaggtggctgttatttaggccctagaccgattgacctacacgtcaaaggatttgaagctctaggtgctgaagtgacaaatgaacatggtgccatgtatttacggacagaaaataaaggattgcgtggcaatcggattttcatggacgtggtttcagtcggagcaacgatcaatgtgatgttagctgctgtaaaagcaaaaggacagacagtaattgaaaacgctgcacgagaaccggaaatcatagatgtggcaactttactgaataatatgggggcaaaagttcgaggagcgggtacagatgtgatccgtatcgaaggagtcgaaacattacatggctgtcggcatttcatgattcctgaccgcatcgaagcaggaacctatctagcattagcagctgcagtaggaaatggtatcaaagtgaaaaatgtgatctttgaacatttggaaagctttatagcaaaattgcaggaaattggtgtccatatgaaaatcagcgaagatgaaatcgaagtttacccctcgaaagaattaaaacccgcaaacatcatgacctatccttatccaggatttgccacagatctgcagcagccacttactgcgttactattgatgactacaggcacttcagaaatcatcgatacgatctatgcgaaacgtgtgaaccatgtgccggaactagcacgaatgggcgctgatattaccgtggaaggaaatatgatcatcgtgaatggtccaaataaacttcacggcacagaagtcgtggcttctgatcttcgggcaggtgcttgtttagtgattgctggactattggcagaagggacaacgacgatttacaatgtagattatatcttacgcggttatgatcatattatcgagaaactaacagccttaggggcatcaattgaaatgatagaggaagtgggagctgaatgagcgattatttgacaatggcagaactagagaacaaaacgttaaaagaagtttatagttatgccaaagaatttaaaattccttattacagtaagatgaataaaaaggaattatctctagctgtgattcgtgcacaagcagagaaacaaggattttattatatggaaggaatattggatatcgttggtcaagatggttacggttttttacggccaatcaattatggaccaagtgcagaagatatctatatttctgcctcacaaatcagacgattcagtttgagaaatggggacaaagtggcaggaaaagcccgtccacctaaagaatcggaacgttattatggtttgatgcacgtggaaagcgttaatggaaaagatccggaagaagcaaaagaacgtccgcattttccagccttaacacctctttatccgcaaagacagcttcaactggaaacaacaccgcaaagactatctacccgaatgatcgatatcttttctccaatcggttttggtcagcgtggattgatcgtcgcaccgccaaaagcagggaaaacttctgtattaaaagaaatcgcaaatggtatcaccgaaaactatccggaagtagaattaatcgttctactgattgatgaacgaccggaagaagtaacggatctagaacgaagcgtgaaaggcgacgtggtatcttctacatttgatctgcagccgcaaaaccatactcgagtttctgaattagtattggaacgcgcaatgcgtttagtcgaagataaacgagatgtcgttatcttgatggatagtattactagacttgctcgggcctataacttagtcgttccaccaagcggacgtacattgagtggcgggattgacccagccgcattgtataaacctaagaaatttttcggggcagcaagaaacatcgaagaaggtggcagtttgacgattttagcgaccgctttagtcgatacaggaagccgtatggatgacgtgatctatgaagaattcaaaggaactggaaatctagaattacaactttcacgtgaattatctgaacgtcggatcttcccagccatcgatatcaaaaaatcaggtacccgaaaagaagaattattgatgccaagtgaagaattagaagaaatttggaaacttcgaaaaaatatgactggagattcattagaatatacggaacaactgatccgctttttgcgtaaaacaaaaaacaatcagcaatttttcaaagaatttcaagatgtctcctttggtaaaaaaaatccgaccagaaatctgaaaagataattgcaaccttgactgaaacatgttaagatgttaatgttgtaaatcgacaaatcaactctggttcagcaaatggagcagggcaaaggagcgaaaaaatcatgaaagaaaacatccatccagattaccacccagtagtattcatggattcaacaactggtttcaaattcttgtcaggttcaacaaaaacttcacaagaaacagttgaatgggaagacggtaatacatacccagtcatccgtgtcgaagtaacttctgactcacatccattctacactggacgtcaaaaattcacacaagcagacggacgtgtggaccgtttcaacaaaaaatacggtctcaaagacgcaaacgctgcggaataataaaaacgctgataactcaacgtttagcagactatctgatagggatagtctgtttttttatgttttttgccaatttaaaacttcgtttgatgctgaaaaagtcgtaggatcataatgcacaaaacaatgaaaaactagtatatagttttaattatccacttgataaaaacaccttatattaacgaaatgaagaggggttatttcgaagtaaaaaaccatttacctaaaattagaagctaagctttcctttcaaggaaggctttttgttttgttatagacttgcgattgtttgtgagctagatcgttcattttaatgacttatacacgcggatgatgggtctttttcctctgttcattcataatattgaacggtacagctagcgatgctatactgacctcagttccaagaaaacgttaacattttttgtgggggagaggttttttatgaggtttgatcaattgatcgcagaagaactgattgttttcgatccatcgatagattcaaaaggatcattatttgagcgaataggggatgtgttgaaaaaaacaaataaggtaagaaatgttcaaaaagtcgttaaggcactattcaaacgagaggaggagatctccacaggaatagaagatggatttgggattccccatgcaaaaagcaaatatgtgacaaaaccagcactgtgtttttttcatacagccaaattaacggactatagcgggatagatgaaatgccaattgaatatatttttgccatcgtagttcctgaaaaatcagcagatatgcatctagagattctcagcacactctccagacgattgatgaatgcagattttagaaagggaataaaagaagccactacgccagcagatatcatcagacagattagtcaagaatgaaaatagtagagtctttgtccgagtatcgatagtgaagaaaaaggaggaaaataatcatgaaaatcgttggtgtaactgcttgcccgactggaattgctcatacttatatgtcggcagaaaaattagaagtaacagcaagaaatctaaaccatcaagcaaaattcgaaacacaaggtgtaaaaacagaaaatcagttatctgaacaagaaatcaaagaggcagatgcaatcattcttgcagtagataaagaaatcgaattggaccgatttgccgggaaaaaagtaaagcgtgtctctacaagccgagcaatcaaagaaccgcaagtagtaatagacgaagcattgagagatattggcgtattcgttgtgtctaatgaaaaagaaccagctgcaaatgagaaaaagccgacaatctataatcatttcatgaatggtgtgaattacatgcttccatttgtgatcgcaggcggaatcatcatcgcactgagttttgcctttgggattacagcggctgatcccaactcagcagactataatgtgttagcagctgcattttcaaggatcggaggagatacagcgtttgccatgatggttcctgcgttaggcgcggggattgctacatcgattgctggaaaagcaggttttgccccaggaattgttgccggattactggcctctacaggtggttcaggttttcttggcggaatgattggtggcgtgctagcagggtatatctgtgattttctggcaaataaaattagcgtaaaaaaagaattttctgctatttatcagctgattgtcgtcccctttttatcgatcttaattattgggcttttgatggtatttgtgattgaacaaccgatcacatgggtgttggatgctttgacaaattggctgaatagcttgggaaatacatccgggctattgttcggattacttatcgggatcatgatggcagctgatatgggtgggccgatcaataaatcgacttcgactttctcgatcggtttgatgtcagctggagtaaatgcaccgattgctgcttgtatggctgcaggaatgacacctcccctaggtattgctttagccactttattattcaaacataaatttaccaaagaagaacggacttcaggtcaatcatgctggattttaggcgcttcgtatattacagaaggtgctataccgtttgcggtatctgacccgatccgcgtgatacctagtttgatgacaggttcagcagtcgctgcagggatttccatggcagtaggagttacttcaatggcacctcatggagggatttgggtgatgctaattccaaatgttatgaacaatttacctatgtatgtcttggcaattgcatcaggtacagtcactacagcctttatgcttggactattgaaaaaaacagtgaaagagaaaaaacaagacaagtggacgaaaaatgaaaatctaacaaatgaggtggaagcgtaatgttatatacaatgaaagagttattgaaagtggctaaagagaatcaatttgcagtaccagccttcaatatttgcagctatgatatgatgaaagcaatcatcgaagaagcagagagattagaagcaccagtaatcttagaaattcatcctgatgaaatcgcctatttaagtgatgagtttgttgcggcagtaagagcctatgcttatacaagtaaactgccgatcgttatccacttggatcatggcggtacgatagaagatgtcttacgggcgattcgaaacggctattcttccgtgatgatcgatgcgtctttgaaatcattcgacgacaatgtacagattacgaaaaaagtggttgcgttagctcatgcggtaaatgtctcagtggaggctgagcttggaacgattgggaataatggttctgctgaaggaggtgctgaaacaatcatttatacagatcctgatcaagcgaagatttttgtgaaagaaacaggaatcgatacacttgctgtagcaattggaacagcgcatggcttgtatccgaaaaacagaactccaaaattaaatatcgacttactgaaagaattgaaccaacaaatcgatcttccatttgttttacatggcggttcaggtaatccggacgcagaagtcagcgaagcagtaaaatacggagttgccaaagtgaatttgagctcagatcttaaaagcgtctttttcaatgctttgagagaaatattgagtgaaaatccatcgatgtacgagccgaatgcaatttatccagcagctaataaaaaggtacaagaagtggtcaaacataaaatggaaattttgaacacagtaggcaaggctagtttatactaaaaataaaaatgtgtggtcaagagggtatgacaatagtcttgtcataccctcttaaccacacacgatgttcagaagtagttttttcgaaaaatttcttcttatttctcgaagccaatcacttctgtcacaacctcttttttcctgttactatataaagtaaatggggtgattttatgttgaatgaagtggagaatagacagcaggagattgtgaattatctaaaaaacaaccaatttgcaagagtcaccgatttgatcgagttagtaaattatagcgaagccacgattaaacgtgaccttgtttttctggaaaaaagtggattgatccgtagagttcgcggtggcgccatgcttattgacaatcgaaaaattgacgtgccttacctgatgaagatcaccaaattagaagaagaaacagaaaaacgtaagattgcagatacagcttcttctttgattcgagatgatatggtcttattcttggattccagtacaacctctttacacttagtcagaaacctagcaagatttgatggtttgcagatcattacgaatggcatcgtcacagctgctatgttgagtgaatatacaacggcaaaagtatctgtattgggaggggcaattgttccgaaacgagcaacaatcaacggttcaaaagcctataacgatgcattgtcatattatgcggatttagcgataatgagttgtcgcgggctagatttcagccaaggagtaacagaaactcatgaaggagaggcaatggtcaaaaaagcttttagaaaacaatcagaccggcttgccgttttagttacacagcaaaaaattgcacataaattcatgcatcaagccattgcttttcatgaaatcgattatctggtgacaagtaaagaactgacaaaagaacagtatgcgaaagtaaaggaacaccatatcgaatgtctgtacggataaattattacgtgaatgttctaagtggcttcctcatttttagataggaccttatctttgctcgcttctctcagccgatggtataataatgaaaaggttatcttgttagataatcttacttttttatccaggagaaaggagtgcagaaaatgaaacatgtgaaggcgttggtagtgaaggcaatcatgatctgggcgattctgtgggtcgtgctgacaggtttatacggtgttagctttatggattcaacgattgttggggtaattattgtagtcatgatctatgtgctaggggatctgttgatcttacgtaaagtagggaacatcgcagcgacgatcgcagatgctggttcagctgcagttatcttgtggctctatctatattttatgaatgatacagtcgatatttggatgaaagtattgattcctgctctattgatcggtgtggcagaatggttcttccacaagtggttgctaagtcaaggcatcgtaccagatgaacggaaaatggaataaatcaacagttaaactattcttatcgataaatgaaagctttaaaaataaatagatgtttaattaagaataatcataaactatttttactcaaaaaaccgctcagattattttcagatctgaacggttttttttatctattcatcaagatcaaatttcatttttcaatgattcaatcaattcgccctctgcttcatgactatgttttcggccattaacaagatagagtgctgtacatatcaatggaatgactccggcaatcacatacaatcctctaaatgaagtaagagattttagcatccccatcaaataaggaccaacgcctaagcctaggtctaaaccaataaagtaggtagataaagcaatactgattcgatgttcgcggacgatttttaaacaaacagcctgtccatttgacataaacgtaccataacctaggccgactaatgctccagagataagcaatgtcacactattcgtcgttacactcagtaaaaataatcctgctgttaagaataaatagctaggatacatcacgtattgttctcctttgacatcgaaaatccttccagtcaatggacgtgtaaatgtgatgaccaaagcatatacgacgaagaaaaatgacccagcagcaactaagtggattacttttgtataagaagataaaaatgataaaacacttgaataagaaagacccatcaaaaaggcaattcctgtaatgaaaagtgctttcttttcaataaaactattgatattccatgagcgaagagatattttttgttcttcagataatggaatattttttacaggaaagacaaggcaggcaatcgtaacaaagaagaccagtacaattgaaaaccagataatgaaacgaaaatcagtcatattcagcaaaatcattcctaaaaatggcccaacagcggcagctaaactagtacttaatccataataattgatgccttccccttttttagatgcagggatatatgcagtaacgatagcatttgtagctgtagaaactgtaccgtagccgaatccattcaagaatcgaactaaatacaatgccccgatagttggcgtataaagatatgctaatgttgaaaggagatagaagatcgcgccgcctcttaaggtaaacttccgaccaaatagttctaactgtttccccatgaataagcgtgccagcaatgttccgatgatatagatcccagaagcaaaacctgcttggctcaagctggcgtgtaaggtgtcttgacgcaatgactgccatgatgaccatcaacagataataaatcaggtagacaataaaattgatcaatgtgattccaataaaatatttattaaataatttcttttccatgtatgttatacattccccttaagctgaatatgcttttaatttttgtatttgaacttctacatcgtgataattggatggatagcgatcaacaagttggcgaataaataaatctcttgtagacataaacagatttaaaaattcttcgcattcgtttgttggattctcatccactgctttgatcaattcgatcgagttttgatacgcatcatttaaaaagactaaagaagctttcatatcaaatcttgtttgatatgctgtttctaatcgattaatgattgtgttcatccagtaattcatgttttttccctctattcttaaaaaattttacttctgcagtataacgaataaaaaaaaggaaaaaaatcgcataagtgatggaaaaaggtacttaacaaatgttaatatcattagtaaaatacctttggactttaaaaagttttaaagtactgtatgatctttttagatgaaagtttggatgggggagcatcattggatagtagagtcttaaaggaatatttggataaaaatgattttccgattatacgcaaaggatatcataaatatttgacattcgaagggatggaagattcccatacgtatatcttgaaagagggaacggtaaaagcaagtgttatttcaaatgatgggagagaatttaaccttcgctatatcaaagatcttgaaatcgtctctcttttaaaagacgaatattcacaattcatcgattcgccgtataatattcgagttgaatcagaatatgcagagttttatcgaatcaatcgtgtgcgcttttggcaaaatatcaaccaagacccaaagctacaacactatgtaaaagagtattaccgctatcgtctgctttattcgatgaaaaaaatgcagcaaatgctattaaacggaaagctgggagctgtttgtacgcaactttacgaattatatgatttattcggtgtgcggacagaagaagggatgctgatcgatttttcgatcacgaatgaagaaatcgccaaattttgtggcatctcaactgctagcagtgtaaacagaattttaaaacaactgaaaaaagatggtattatcaccgttaaagaccatcatatcgttattttgaatatggacttgttagaagacaatattatcttttgatgaacaaagaggttgtgaaatcagcgttttgacctgagtattagagaaacaaacggaaaaatagttcctcatattttgccgttttttgagctaataccgagggtcagctgattgaacaccgtttaccaagaggttgtgagcctgccgtttaactctgagtcacaaggaacaatttcaaaaaacagcttttcatgtttgatgaatattgtgacttgtgaccgaggagttggtaggagaacaccgtttaccaagaggttgtgaaaaagctgttctgcatcaagtaataagaagagccaagtaaaaacagtctcttatgtttttaacttggctggacttatcaccgtagatgtaagcttttgaacgccgtttatttgcaacaaaaggggctgtgacacgatttttgtcacagccctttttttgcgaacattcatttagcaatttttagaaacttctgccgccaccgccaaaagtcccgccaccgctagaatgggtagtacttccgccaccgccgcttccaggaggtgggcttttggggattcttcttgtcgtgacaaaagaatttgtcagacgatcggttttttcagttaatttgatactggatttttctcggaatggatatttgtagatgcctgatttcaattgataacgcgaaacagtcacaaaataaaagacaagactaaggataagagccaaaacaacagcaatgatgatttctactgtcgtcaaaaccttatagcgtgtaattttgccagtttcttcgtctacacgataatgtcctcctggaactccgtcttccacatatgttgctgatttagacaggtaagcttttgcagcattgtaataggcagcatttgtcatctgatcataaacatcatctaagatcgaatcgattctgctatcagtcaaataatcgatcatattaccagaagtcgaaatgtagatttcacgctgtcccatatctaatagcaatactgagccattttgatcatttccgactgcgtctcttaagtaattatcagcaaagtctcttggttcttctgaattagatgtagtcgttacgatcaagactcgtcctttgattttttcattcagcttttctgcctgttgttccaaagattggatttgatctgttgtgaataacccagcctcatcatttaccgtagctgtatctgcatgagtagccaccggccagccaacacttactagcaaaagaaagaataaaaaaaattttttcatcatatcaagtaacctccgatcagaaagaggatcgctagcccagcgaaaatcccaagagcggtcagtcccaattttttctggctgatcggcaggacaccgctgacctttcctgtttgtccattcattgcgtagtagtagacttttttacttgagtcattgcttcgataagtaacaagccataccggcagtaatacgtaattatttacttcgtttgtgattgaagcagaagttcgcacaccggtcaatgttgtatatccatttgcggtatcttttaacagcttctctgaatagtcttttaattcagattgaatctgtgatttgattgcctcatattcgatatctcttttttctgcttggaacccggctaaatactggcttttaaaatcaattgctttatctaacgggaaaggttgcacgccttcgaccatcttttgttgcgtattttttgataaggcattttttactagttctttaaaagaaagcttgcctgctcttgaaacagcaaattgcttcgtttctgtgtattcgatgtcacctatccgccatatgcggataactgtaccattcgcctgcatggcaccatctacttcagcatctgtagcccaataagggaaatacacacctgtcaacttatcgatttgatccttattgaaaaaagctttgggaacaaaccattttttcttggtccaagcgagaaatctgttgattgcttcttctttctcgacagcaaaaggaagtactttatttggcaagaattctccgcttaaacgtcccgatagtacgacgggattatggcagtagtaacaataagtcgcagcagttgtcgcatcagtcacgatctctgcaccacagttgggacaaagaaaaagatctatcgctgcggtattatctgcagattcgtccgctgtatctgaaaaaccgcctgcctcgtcaaccgctttgcgctcggcttcattcatatcggcaagctgttcttgggctgtaaaagtaaaatcttcggtaggtgaaggttcttctttgctttcttcgccagccatacgcgcttctttttgcttttgctcatattggctgacttcttcttctgtatagatattcaggcagtattcgcaatgaaatttttggtctttgggatcaaaagtcaacggaccgccgcaattaggacatttatgtgtaagaacatccatcagctgcacacctttctaaataaattaattaacggggattcctttaaacggtttaccacagtttggacagaatttagggatgccgttggaaagatccacgatctcattgcattcactgcatcgcatttgtagcttaggctgaacgttttctacaggtttggcagctccgcagttggaacagaattttccggaattttctgtcccgcaaactggacatgtccaagtatccgcatttccttgtgcagtttgttgattttgtttttctgcttgttgtttgatttgttcttggttattttgagctgcttgagaaagataagaaccatttgcattcattcccatacctacacccataaagccggtcattgctcctgcttcattttttccggctgcttccataccacgtgcaatggaaccttgcacgtatccttcacgtacgctaggatcacctagcatcgccccttcgttacgcatattgatcagtttcacagaatcatcggtgtaagaaatgctggctacagccacagaaacaatctccatcccacgtaattcacgccaagaatcatccaatgcagtatccatgtatttgcttaattccaaactcttagatggtacataagaaatccgttgaccatctgcagacatctgattgattgctgattgtagcgctgttaggaattcagctaaatactgctcattgatatcattgatttccacttgtgttttgtttttagggattgcgtttgtataaaataaaatcgggtcaacgacatgaatagaataagtgccatgtgcccgtaagaataattctgcgttatagaaattgtcaaagtagttcaacggcgcgcttgtaccgaatttgattccctttatttcttggagattgatataaaaaacttgttgtttctgcggtgtgacgccgccaaatttgaatcggtcaaaagtttcagcaattgcttctttcagtgttccattgaacatggaaggagctgcgtcatttttaatggtgtaataaccttcctcagcggtataatcgatgatttttccaccatcgaccaaaagcatcatcatgtttggatagacatggacgactgttccgtctgttaaaacatcttctgttcctttacgattggagccacgtttgtcatctttgcggactttgacaccttttgtcatgaccgttgtatcactcatattgtctggttcgatgacttctagccattgatctgccagaccgccgccaaccatacttgttgctgctttgataagacccataaaaaattcctcctctgattcagctagtgccaaacaattattgtttatttattataccataggaagatgtgaaacttctcggactagagacggaattgaaatggaaaattgcgtattgtttaaatacctgaaaaagccgagaaggatagtagtttttttacctaatatcacgtataataagagatagtgaattttttaaaaaagggggatccttatggcatatcaagcactttatcgagtctggcgttcgcagcgtttcgaagacatcgttggacaaaaagctgtgacacagacactaaaaaatgctattgtttcccacaaaacctcacatgcctacttgtttacaggacccagaggaaccggaaagacgagtgcagcaaagattttcgcaaaagcaatcaactgtccgaacagtaaagacggtgagccatgcaacgaatgcgaaatgtgtcgatcaattactgctggtacgcaagaagatgtgatcgaaatcgatgctgccagcaataacggagtcgaagaaatccgatttatccgtgatcgggcaaattatgcgcctacaaaggcagcgtacaaagtgtacattattgatgaggtacatatgctttcaacaggagctttcaatgccttgttgaaaacattggaagagccaaaagaaagtgtcatattcatcttagcaacgaccgaacctcacaaaataccagctacgatcatttcacggactcagcgatttgattttaaacggatcaatacggcagatattgtcgaacatcttgaatttatcttgaaagaatcgactatcagctatgaaccagctgcattgaatgtgattgcccgttctgcagaaggcgggatgcgggatgcattgagtattcttgatcaggcaatctcgtttagtgaaggaacaattactttagatgatgccatgcaagtgacaggtagcttaactgacgaaatgatggacagttacttgagtgcttgcgtgaaaaaagaagtaccagaagcattggaaacattgaaccaaattctcgcagccggcaaagaatcacgtcgctttctagaggatatgttacaatactgccgtgacttgctgatgtatcagcaagcacctaacctagttgaggaacaatcgagtacgatcagaagtacatttacagaattggcacaaactgtttcagcggatcagctgttttcaatgataaagattttgagcgatactcaaaatgaaattcgttttaccaatagtgccgctatttatttggaagtcgctacagtcaaacttgcacagctaccgtctgcttctgttccttcagcagatgtagcatttgcagatgatcagatagtaaaacagctacaacaagagattaaggaactaagaaacgaaatcaaggaactacgcagtaatacaggaattgagaatacaaaagtacagccggtacagcaaacaaatcataaaaaacagacaagtacctatcgtgtaccgacggaacgagtatataaagttctgcgggaagcgacaagacagcatctgaaccaagtaaaagaagtatgggaagacttgctgatgagtctatctgtcactcagcgagcaatgcttaaagcaagcgaaccagttgcagctggacctacaggactagtgattgcgtttgattatgagattgtttgtcaaagagcagcaaatgacgaagaattgcagctttcggtacacaacaacttaagccgaatgatcaaagattatgcgcctgatcctgtttatattacaagagaaagctggccagaacttcgaagaaattatttgacgcaggcacaagaagagggaacagaaaactcttttgcttctgaagactcagaaggagaaatcgagttgcttcctcaagaacaagaagtaccagaagaaacacttgtagtaaaagcagaggaactgtttggctccgaagctgttacagtggtagatgattaataaaaaggagtagataattatgatgcgtggaatgggcaatatgcaaggcatgatgaaacaagtacaaaaaatgcaaaaagaaatggcagaagcacaagagctgctaaataaaacagagtttacaggtaaagccaccaatgaattggtcaaagcggtttttacaggcgatcgtcgcatgaaagatatccaaatcaatgaagaagtcgttgatcctgatgatatcgagatgcttcaggatcttgtcgtaatggcagtcaatgatgcgatcgcacaaattgatgtggaaactgagaaaaaattagggaaatacgcaaaaggtttgccaggattttagttttaaactgaaggagtaatgaatatgcaatatccagaaccaattgcgaaactgatcgacagctacatgaaacttccaggaatcggtcagaaaacagcgacaagactcgccttttatacgatcgatatgaaagatgaagtagtaaatgaatttgctaaatctttgttaagtgtaaaacgcgatttgcatttttgtagtatctgcggaaacatcacagaagaagatccctgcgaaatatgtagaaatccttcacgtgatcgaagcgttatcctagtggtcgaagagccgaaagatgtaatggcaatggaaaaaatgcgagaatatcacggactttatcatgttctccatggtgtgttatcaccgatggaagggacaggtccagaagacatcaatatttcttctctgttgcagcggctgcatgatgcagatgtaaaagaagtgattatcgcaacaaatgcaacaacagagggagaagcaacagctatgtatctctcacgtctgatcaaacccgcaggtatcaaagtgactcgtctagcacatggtctgtctgtaggctctgatatcgagtatgcagatgaagttactttattgaaagctgtcgaaggaagacgtgagttataaatttctaattaagtgttttttcagatacaatataaaagcagcacaagagatgggggcaacaatgtgaacggactatttattacaatcgaggggcctgatggtgcaggaaaaaccagcatcttgaatgaactttaccctcttttgaaagaagtagcaaaaacagaaatcattcaaacaagagaaccaggaggcattccgattgctgaagagatccgagcagtgatccttgatccaaaaaatgatcggatggatgaacgtacggaagcactgctttatgcagcagcaagaagacaacatctagtcgaaaaggttctgcctgctctggcaaaagggaaaatcgttttatgcgatagatttgtcgacagttctcttgcttatcaaggtgcaggccgacgcatcggcgttaccgagattgctcggttgaatgagtttgctacagaaggtactacgccggattttaccctttatcttgacgtagattcagacaccggattaagaagaatcaagaaaaacagacaaaatcaaatcgaccgtttagattcggaaggtttggaattccaccagcgtgtacgtcatgcttacttaaagctggcagaagagaatccggaaagaatccacaaagttgatgcaagaaaaagctttgaagaagtgctgcaaacaagttatcatacaattattgaacagtatccgcaattttttgaaaactaggaaggtgaacgtttatgaaaattattttagcgattatccaagacaaagacagcaaccgtttatcaaatgaattgattgatgcaaatatccgtgccacaaaactatcatcgacaggcggcttccttaaggctggaaacagtacgtttatcgtgggtattgaagatgaccgtgtagaagaagcattggaaatcatcaaaaaaacgtgtgaatcaagaaagcaatttgtatctacacctgttacactggatatttcgatggatgggggcgtcccttatccagtagaagtagaagtaggcggtgccacagtcttcgtcttacctgttgaaggattccatcaattttaggaggagctgagctatgaatcaagaaataaacttggctcaaatgcaaccgatcgtgtatcagcagcttcaacggagttttgagcatgggcgtatcgctcatgcttatctttttgaaggggagaaaggaacaggaaaacatgaagtaggtatatggcttgcacagcacctgttctgtacccaaatgaaagacaatctgccttgtggaaaatgcaacaattgtcagcggatcgaaaagaaagaacatccagatgttttggttattgaaccggaaggacaaaccatcaaagtcgatcagatcagacgtttgcagacggaattcagtcgcagcggttacgaatcaagaaaaaaagtttttttgatcaaagaagctgaaaaaatgaatagcagtgcggcaaacagtttgttgaaattcttggaagagccccctggagattttttagcggtgttagaaacagatgcagtaggaagaattctccctactattcaatctcgttgtcaagttctgcattttcaagaactttcgaaagaagcactgatccatcgattgcaagaagagcagattccattggaaaaagcaaaacttttggctttcttaacaaacagtttaggaaaagcagttgaaatctctcaagatgaatggtttaatgatgctaaggacttgatttatcaatggttcgtttacttgcaaaagcaagatactcaagcctttatctatgtccaaaaaaaattggtaaaatcatttaaagaaaaaacacaacagtttacaggattatctgtcttgatgttttattatcaggaagcacagcgtcaagcagtagcaaacggcgaatatggcaaagtgaaacagataaaccagataattgaacggatattgatcgcagagcagaaactacgcagcaatgtcagttttcaggctgttgcggaacagttcgttttgcatacgattttttagcttgccgcaaaggatgatgatcaaggaggatggaaatggtagaagtagtaggtgtccgatatagagatgcaggtcatatctattattttgcaccaggagactctgaatatgtttatagtgacaaggtattagtcgaatctcagcaatccttacatattgctactgttgtccttcctaaaaaagagattgatcccaatgaccttcctgaagctatccgtccgatcttgcataaagcgtcacaagctgaattagaaaaagacaaaaaaaacaaaaaagatgcttatgatgcattgaaaatcgcaaaagaaaaagtgcagttgcgtgagttggaaatgaaaatggtcaaagccgaatacacatttgatcgaaataaattgattttttctttcacagcggacgggcgaattgactttagagaattggtaaaagatctggccgctgtatttcgtactcgtattgagcttcgacaaattggtgtccgcgatgaagcaaagataataggcggaattggtccatgtgggcgtccattatgctgttcttcttttttaggcgatttcgtgcctgtatcaatcaaaatggcaaaagatcaaagtttatctttgaatccaacaaaaatttccggtttatgcggacgcttgatgtgctgtctgcaatatgagagcgaagaatacgagacagcgaaaaaagaactccctgactttggaaaagtaattgctacacctgatggtaaagggaaagtcgtagggttgaatctgcttagccgtatcgttagtattcggctgactggacgggaaaatcctgtcgaatatgaatgggatgaattgaaagaatttatccaagtaggtgagatgaatggataagagatcattatacgacggattgaatcaattagaatcagagttgagaaatacattaacagaacttgttgaaatgaagcatgctttgcatgagatcgtagaaaaaaatacaactttggagatggaaaatcaacgtctgcgggaacacctgcgggaattgaaccaagttgcacaagctccagctgaaaatgtgaagcaggaactttctaagtctcgtatgaatcttgaaaaaatttatgaagaaggattccatgtctgctacgatttatatggatcaagaagggacaatgacgagccttgtgcgttttgtctagaagtgatctatcgcgaaagcggtcgatgaccaataacaagaggagactggagcggagaaatactgctccagtctttttattaaggagattgtgacagatgtataatcaaaaaagtttcaagggaaatccggtatatggggatttatatcttgtaccgacgccaattggaaatttagaagatatgagctacagaagtgttcgtatgctgcaagaatccgatcttatcgcaagtgaggatacgcgtaatacacaaaagttattgaatcattttgaaatccatacaccccaaaaaagtttacatgaacataattataaagaacgtgtccctcaattgattgctttgttaaaagaaggaaaaacgattgctcaagtcagtgacgcaggaatgccttccatcagcgatcctggacatgagctagttttagcctgcataaaagaagggatttctgtgatctctatcccaggacctacagctgggatgacggctttgattgcttcagggctagtgcctcaaccatttttattttatggcttccttccacgtaagaaaaaagaacagaaagaaacattgaaaaagctaaaagaacagacagttacgctgattttttatgagtcaccttatcggatcactgctacattgacgaatttcttagaaatttttggaaatcgccaagtcgttttgtgtcgggaattgacaaaggtccatgaagaataccttagaggaagtacggaagagctactcgcttatatcgaagaacatccagtaaagggtgaatgttgtctgcttgtagaagggaatttgttcgaaatgccagtgacggaagttgatgaagagttgggaacgttaaaggaacaagtagaagcaaagatcgcttcaggcgaaaaaccaaatgctgctatcaaagcagtagcgctgaaaaatgggctgaaaaaacaagaagtctaccgtcagtaccatgaattagactgagatagtataagttgtctataatgaaagactaatgaggaaatcagctactaacttttcaaatctcttgaacgcgaacgaatgttcttgtataatgaataagaggtgaggatgatggagctgcaatttcctttacataatgatacatcaagaaaaatcattcatattgatatggatgcttttttcgcttcggttgaagaacgagatcatcctgagtttcgcggacatccattagtaattgccagacaccccagtgacactggtgggcgtggagtagtgactacagcaaattatgaagcaagaaaattcggaattcattcagcaatgagtgcacaaaaagcgtatgagctttgtccgcaagccatctttaagcctggcgaccatcataaatacagcgatatttccaaacaagtacgggaagtattctatcgttatacagatattgtggaaccagttagtatcgatgaagcgtatcttgatgtgaccgaaaataaaatcaattgcaagtcagccatcaaaatcgcccgaatgatccaagcagatatttgggagagtgtccagctaacatgttctgcgggagtaagttacaataagtttttggccaaattagcatcagactatcaaaaacctagaggaatcacggtagttgcccctcaagacgctgtgccatttttaaaagctttgccaattgaaaaatttcatggggtagggaagaaaactgtacctagaatgcatgagctagggatttatacaggaaaagacctatatgaatgcacagaaatgatgttgattcgaaattttggaaaaatgggctattctctttatcgtaaagtcagaggaatccatgattctccagtaaacgttacaagagagcgaaaatctgtgggaaaagagcatacttatgggcagccgttgcaaacggaagaagcagtgctgactcagttgcgccaactagctgaaaaagtagaagaagcactgagaagagtccaaaaacatgggaaaacagtagttttgaaggtcaggtacacggactattctactgtgaccaaaagagtgacattgccagaatatatctataaaaaagaagcactcttttatcaagcaagccttatatgggaggaaatcttgggagtagaaaaaggaatccgattgttagggattactttgacgaatctggacccgatgacttatgaaaacatcgtccttccattatgggaaaatcaagaaatataaaaacagctttgagagttgaaaccggaaatccgttttctctcccaaagctgtttttatatcaagtcttgctttttgatttgttcataggtttctgttgcatccgtacatttttcccaaatcacaacttgattggattctaaagatttttggacgtcaatgatccgctggttgctacttccgcgaaattgtagttttaggtcacgtttgcttaattcaaagcgtccgtcaacaaggatatcgatttgcgaaaggagttctaatttatcttctgaatcttgtagcaattcatcaaaggtatagcctgtccatgaccagatatcttttgtcgtaccgaactcttttcggatacgtcgtacgacttgcagacaaacatctgtattcaaaaaaggttcgccaccaagtaaagttaatccttgcacgtaatcgttgcgcaagtcagcgatgatttgttcttctaattcaggtgtgaatggtttgccatatcggaaattttgtgcagctttgttgaagcagccttcgcaggcaaataagcagccactaacgtaaagactgttgcggacaccttcaccatcgacaaaattaaacggtttgtagtcagcaatatagttttggctgtagtcttttgctaaccattcttttggttttggatttctcataaaaaaacttctttcatttaaggttcaaagatatagctattgaagataaaatctactcgaccacataaataagaacaaactgacctaaatccattgttcaagaaagcttgttcttattttgatagagggcgttcaaagatacaaagccatcgaaagagggtggtgaaaaaagacttgtcatagcctcttattctgaataaacggtgttcaaaagcttgcatctgcagtaataagcccaactaaacgaaaaatatgaggaactatttttgtttagctattcttattacttgatgcaggacagctttttcacaacctcatttcatgtgtttcacacgtgaggaaatttctttatggcggccatgtaccatcggacgagcttgcggatttcctaaatagccacaagtacgtttgactacatcacatgtttttggatcatgatttccacattctggacattcgaaccctcgttctgtcggtttgaaatcaccttcgaaaccacattgatagcaatgatcgattggcgtattcgtaccaagatacccgattttgtcatatgcaaaatcccatacagcttctaaagctttcggattttgttggagcatagggtattcacagtagtggatgaatccacctgaacaatattttggataatccttctcaaattccaatttttcaaatggcgttgggtttttacgcacatcatagtggaaactgtttgtataatattctttatctgtgatattttcgatgatgccgaatttttctgtatccaaacggcagaaacggtcagttagactttcacttggagttgaatagacactgaaatgataaccatattcatccccccatgcatctgcattagcttttaattctttgacgatatcaagtgtgaaagcttttgcttctgggtttgtttcccattcgccaccgaagaaagctgaagcaacttcatacaatccaatgtagcctaacgatacagtagctcgacggtttttgaataattcattgacagaatcggtacgtgaaagacgtttcccgaaagcaccatacatatataaaattggcgcatttgctggaatggcttctttacaacgttctacacgatagagaagcgcatctttcatgatttctaagcggtcagacagtaactgccagaatttattctgatctccttttgattcgatcgcgattcttggcaaattcaatgtaacaacacctaaattcattcgtccgacatttacttcttgaccattttcgtctttccacccttgcaagaatgaacgacagcccataggtactttgaaacttccagttaattcaacgattttatcgtaattcagaatatcaggatacattcttttcgttgcacattccaatgctagttgtttgatgtcgtaattaggatcttcagggtttaagttcacaccttttttcaaagtgaagatcagtttagggaagatagctgtccgcttttcactccctaatccattgattcgaatctgtaaaattgctttttgaatttctctttcaaaccagttttctcctagtccaaatcctaatgaagtgaaaggagtttgtccatttgaagtaaataaggtattgatttcatattccaaactttgcatagcatcgaagatatcttttttggtttttgcttttgcatattctttttggcgttctggcgaatcgatccattcttccgcgtcttttagatgttttttatagttcaattctgcaaaaggagcaagcaattcatctgttcggtcggcagaacagccaccatattgacttgacgctacattggcaataatctgtgagatttgtgctgtggcggtctggatagattttggcgattcgacttcggcattgccgattttgaacccattgttcagcatgcctttgaaatcaatcaagcagcaattcgtcatcggtgtataaggatgataatccaaatcatggtaatggatatcgcctttttgatgcgcatttgctatatgtggtggcaacattttcagtccgattgattttccaacgatcccggctgtcagatctcgctgtgtattgaaaacattactgtctttatttgcgttttcgttcacgacagtttggtccttgttgattagcttttcaatcgaaaagttgatatctgttgctttactgcgagcaaaatctcgtttggtacgataattgatgtactcttctgctaattcatattcgtttttttctagtaatatatgttccacgatgttttgaatctcatagattttgacattttcagcaaaccggcttttgatttcttggacaaccaagtctgcaatcatttgaattttttcataagtaagtggtgataatgagccgtgaattttcttttctgctttgatcagtgcttcattgatcttttgttcatcgaaatcaacatggcggccatcgcgtttgatgactttcatctgggatgtctctggctgctgagtaacgacagttttttcttcataatttactttcattatcttcaactcctgctaaattgttcttgtctatcataaaacaaaatcggggaaggagcaactaaatatcggctatatatagtattcaatgtgctgtataattggatttctatactatatgtagtgtatattttattgtgaaaaaaggtgaaaacttgtagctggtggatttgttttttgcatatttaattttgctgaataaaataattgaataaaattttttattcagtccaagtaaaagtgacaaaaacataagagcaaattattcgtagatatgctactatgcaaataaatagaaatgaaaaatgaaagaggaggagaagaattggaaaagatgatcgaagtgaaacatctaagtaaaagctacggcagcaaactttctcccgtcaaagccttagataatatctcattcacagtagaagaaggcgagtttgttgggattatgggcccaagtggtgcaggaaagacaacgctgatgaatatcttgtccacgatcaatttgcctacgatgggcagtgtctcgatccaaggaaaagaaatcacaaaaatgaaaaacagtgagctcagtgactttcgtcgaaaaaaactaggattcatttttcaagagttcaatttgatcgataccctaaatgcaaaagacaatatcctattgcccctagcagttgaacggatgactaaagaggaaatggaaaagagagtaagacatgtagctcaattgttgaatatagaagaactgctcaaacggtatcccgatgaactttctgtcggacagagacaacgaattgcagctgctagagcacttgttgttcagccacaagtgatttttgcagatgaaccaactggctctttggactcgaagtcggctacagaattgttgaactacttgaagaccatgaatcaaaaagaaaaagcaacgatactgttagtcacccatgatccatatacagcaagctactgcgatagaattttatttattaaagatggtgtgattttttctgaagttgtcagaagagggacaagaagagagttctttgagaaagtaatagacatgcaggcgacgattggcggaggaggaaaaatgaatgctgtataaactagccgttaaaagtttttttcggcagtcacgaggctatcttgtttattttttcagtttgactttatccgtaatgatctattattccttcagcgcaatgacctacgatcaatctttagtcagaagagcaagtcaagatacttcgatagatggtggattgagttttggtggatttatcattactgttgttttgctttttttcgtattcagtgccaaccgatttttcttgaatagaaggcaaaaggaaataggcatctatcagctttttggtatgaataaactgcagatatcaggtatatatgtgttagaaatcatgataattggattgttcgcctgtatttctgggatattactcggtattattttttccaaactcttttcaatgattttggttcgaatgatggatatggatcttactagtccattttttatctccattccatcagtagtagatactttatttgcttttttcatcatccttttagcagtatctgtatattcaatatggaaaatatggcgctatccaatgattcgaagttttggagaaaaagaacaagcagatagttcaacaatgcgcttcaggacaaggcaccgattactcgcagtcatcgggttactacttttaacgagcggatattttggagctagtcattttagggaaatcacttcatggatgatcagttatcattatcttgatacattagttttcttttttccttttttaatttttttcgtttgtgtggtcggtacttatttgtttttctgttatacatttcggttatttttgatcatattgagtaaatggaagatttattactatggtatcaattttttgataatgggtaacacgcaagttcatttgctcaaaagttggcgtacaaattctctgattacagtcattctcggaatttctttaatgacaattggcggcacggctagtatctctactattttatcctaccaggagaaagtttcctccccgatggactatcagtttgatgttgagacagagaaaaaaatcaagccgattctagcagaggaagggcagaagataactaaagaaatcaccttgcattataaagtcattgggagtatctatagtcaaaatctcgaagaacctatgtttcaaactgctaatctgatcacggaaacacaatatcaagccttcagaaaagttaatccagatttgccgaacatttctttgaaatcacctggtcatactgttttgcttgatcaaatgcaaactctttttcggaatatttcattatatggatctagtattggactgccagataatcaagaattgaagattcaacaaatgcttccaagtgtattaggtgacgaaacaatggtatatctaagtcctgtactgattgtagatgataccgtttttgaaaaagcaaaaggtgtggattatcaagtagtcaatgtagatgtatcaggtggaaataatgaaaaaatagatgaacgactgagcaatgacctgtcgataaagtggctcaatgctgtttattattcttatgatatcgtaaatggaagtctacaaggagaaattagcacaaagaaacttccggatgaccaaatgaaggaagcacaatttagccaagaaagctctcgtttgaatttctcttccagctattcgaaattgcgtgcagttaatcggcgaatcggtatcaatatttttgtcacactatttgtcgggatgatcgtgattattgctactggtagtattttgacagtccggcaattagcagaagcagaggaagaaaaagaaaattatcacctattgactaagctggggattccacaaagaaggatcagacggatgatcttcgagcaaaacgcacttaccttctttccacccatgatattagggatcactcacgcagtatttgcaatcaatgtcttcactcagtatataaaaactgccgattactggttggcttatcttgtgagtggcttattgatccttatctatcttttgctttatgtcattacgagtcagttatattgtcggattatcgaggaatgatatacggaataagacaagataataaatagaactaaattttgaataccatttatttggaataagaggttgtgacacgatttttgtcacaacctctttattttttatattttttaaaagtacgagaaattataaagaaaaaagcagtgatttgatgtgctatttttataaaagctatgtgacaaaactgttagtaaaaaaacggtttctgtaagctagacacatgtttctttttgtcaaaattagttacactttgtgtgaggttatatgaggagggaatccaatgaacaaatggcgttctaatccaaaattgaattattggggaaaattcatcattcgaacaattttttatagtgcagtactgctgttcctgatttatctgtatcactataaaaatattcaaggaggaacttttatctataacgaattttaggaggaagagtatggaaatcaaaacgattattgaagcaatcgatgattggggaataaatgaacctgatcgagttgcttatcaggcggatgagacgcatacttttggtgaattgaaacaagcatcagacgcacttgcttattatttagaaaaaaaggtagaaggcgatggaccaattgtcgtttttggcaatttggagtttgaaatgattgtctcatttctaggggttgtcaaatctggccatgcctatttgccgattgaagagcatacacccaaggagcgtatcctatcgatctttcgggtggctaaaccatctatggtcatcagtatcggggactggatagaagatattccttcggttcctgtcataacaaaaaaagaatttcaagaaatcaagaagataccagtaggattttatcccagaaatagcgtaaaaggtacagaaaatttttatattatttttacttctggtactactggagaaccaaaaggcgtacaaatcagtcatgataatctagtcagctttgttcaatggacgatggaagactttgggatcaagcctggtatgcatttcttagcccaagcgccattttcttttgatttatcggtattttctatttatcctgcattagtttctggcggaatgctgaagccgttaaataaagcagttgttcaagactttcgtcaattattcgcgacattgccagccttgaagttgaatgtgtgggtttctactccatcatttatggatatttgcttgatggaacctacattcaatggagaaaatgtgccggaattggacatgtttttattttgcggagaagaattgacgaaaaaaactgcagaaagtctacttgatcgattcccaaatgcacggatatataatacttacggtccaacagaagcaactgtagctatttcaagtattcagattgaccagcatgtactagatagttatgaccgactaccgattggctacgtaaaaaaagacacgaaagtttctattgtccaagaaggtaaacctgtttcaaaaggagaaacgggtgaaatcattattgcaggaccaagcgtatcaaaaggttacctgaacaatcccgaaaagacagctgctgcgttcttttgtcaaaatgacttagcaagttaccatacaggggatgcaggtagactagatgaatatgggcttttattttatgaaggacgtatggatcagcaggtcaaattacatggataccggattgaactcggggatatcgaacattatctgctccaagacaaccgaatcaaacaagctgtcgtcgtaccaaaataccaaggaacaaaagtacagcagctggttgcttttgtcgtattagaaaacaaaacgaaacagccggattttcagttgactaaatctatcaaagaacaattactagaagttgtaatggattatatgattcctcagaagttccattatgtcgatctgctgcctcagacagttaatggaaaaatcgatcgaaaaaaattaacagctgaggtgaatcctgaatgatgttacctcatatgatcccttatgcagagccgttttatttttttcttttagccattgcgcttgtaccgatcgttctatctttattgatatgggaaaaaagattaccagtttatcaatcagcagtgacacttttctttttatttgtcagctttggaggtaattattggcaacagggagcggcgctgattgggtatgttttgtggcagacgatacttgtatggggctattttgtttatcggcaaaggaaaaatcagacaggatggttttttgccgccgttattttagcgataattccactgtttttaacgaaagtgactcctttttttgaacatggaaaagcatcgttacttggttttttaggaatctcttatttaacctttaaatctgtacaaatgatcatggaaataagagatggcatgatcaaaacatataagccatttcgttatatccagtttctgctgttctttccaacaatctcttctggaccaatcgatcgctataggagatttgaaaaagatcagctccatccgcctgttcgtgataaatatgttgatcttttgggaaaaggcgtccaaaatatttttgtcggttttttatataaattcattatcggttattattttggtcaagtactgcttcctgtagtgggacgcattgccttacagcatggtggtatttcatgggcattagtaggttatatgtacgtgtacagtatgtatttgttttttgattttgctggctatagcttatttgcagtcggtacaagctacatgatgggatatcagacaccaatcaatttcaataaaccttttttatcatggaatatcaaagaattctggaatcgttggcatatgacgctgtccttttggttccgtgattatgtatatatgcgattgatgttcttcatgatgaagaaaaaattttttaaaagcaagatcgtaatgtcaaatatcggttattttgctttgtttcttctaatgggtatatggcatggattgacgtggtactacatcgtatatggactgtatcatgcttgtctgatctgtctgacagatgcatggatccgatttaagaagaagcataaagagcagttgccttctaacaaatttacgcatggcttagccgtatttttgacatttcaagcagtatgttttagcttcctgattttttcaggatttttagataaacttttttttagctaacgaatagtgacatattaatttatataacaaaggagaaaaggaaaatggaagaacaaattttatcaatcttagaagaaataacaggaacagatgaagtaagaaaaaatcgtgatattgatctatttgatgaagggttgcttgattctttagcatctgttcaattattagtcgagctagacggagagctggatatccaagtccctgtatctgaattcgagcgagaggattggagcacaccgaataaaatcattcaacaagcaactgcattgaagggttgagtatgaaaaagaaactttttgctattttcggcccggttgttttagctgttggcttactgtttgtgttttttacctcctcctatcaagtagatatctctaatccagaaacgattagacgtgcctcttcttccatgtcagtgaacgtgttgaaaggagatgcgataaaaaattatgcattatctgaaaaacaatatattcctttttttggctcaagtgaattaagcagaatcagtccatttcatccgtctgttctggcagaaaaataccagcgaaactatcgtccatttttgctgggagcacccgggacacaatcgttaagccaatatatgatgatgcgttctgcaggagatgctatgaaaaacaagaaagtcgtctttattatttctcctcagtggttcgttaaaaatggtgtaaaaactgattactttaatacgtattattctgaacttcaaacatacgactggttgttttcaatgaagaaagtaacgcctgctgatcgctatttagctagaagattattaactttctcaaaagtaaaagagaatgatacgttgacggcgattctgcaaacgatcaaaaaagggaagctacctttacctgaatctttgaatcagctgcgcagccaatggaacatgctgaagagagaggatgaagtattcagcaatattgggttgaaagatcgacagcaaaaaatcgatcatgagtcaaaacgattaccaaaacaataccaagaaacagaattatccattttagcaaatcaaattggagaacgagaaacgacgaataatccattcgggttgaaaaacgatttttatacgcatcgtatccgagcccacgagccagagctcaaacagtcacaaaaaaattgggattatcgtttttcgccagaattttctgattttcagctggtcttggatcaattagcaaaaaaccataacgaagtattgttcatcatcccaccggttaacgagaaatggagcgattataccggactatctcaagaaatgttacaaggatttgccaaaaagatcaaatttcaattaaatagccaaggattcaatcgaatagctgattttgtcaatcaagcgggtaccaactattttatggaagacacgatccatctaggctggaaaggctggttggctgcagatcaacagatcagaccgtttttagaagaaaatcatattactgctagtaagtatcatcttgacgatgctttttttagcaaatcttggcaacatcaaataccagataaactacaattaaaataaagaaaacaggcgagtgttgctcgcttgttttctttatttttgaatattctgaataaaagataaaaataccaagtttgcctgaacaaaaatcataagcaatggtataatcacaatatgaatatagaaatgggggaaaacatttggatacaaaagaagaacagctacttattgatttaacttctgcaaaaggagtacctggaaatgaagaagaggtaagagaagtattcagagaatatgccaaaccattcgctgatgatattttttatgacggtttaggcagtgtgattgccaaacatggtgctggcggaggccccaaggtctttatttctggacatatggacgaagttggttttatggtaacaaaaataaccgaaaaaggattcttggaattccaaactcttggaggttggtgggggcaagtcatgcttgctcagcaagttgaaatcaaaacacgtgaagggaaaatcgtccacggtgtgattggttccaaaccaccacatgttttaacacctcaagtaagaaataaaccttatgaaataaaggatatgttcattgatattggcgcatcaagccaagaagaagccaaagagtggggcatacgtcctggagatatggtcactccatatattgaatacaaacgaatgaatggcagtaaatatttactggcaaaagcatgggataatcgtatcgggacagctgtttctctgcgagtattagagaatctatctaaagaagcacacccaaatgttttattcgcaggaagcgatgtgcaagaagaagtaggcttgcgaggtgctcgaacaagtacacaccttgtaaatcccgatattgcttttgctttagatactggtacagcaggagacactccaggaatgacaccaaaagaagcagattcgattttaggaaaaggcccacagattttgatttttgatgcatctatgatcccgcataaaaaattattgaattttgttattgatgtagcagaggaaatggatattccattccaatatacagtgatttctggcggaggaactgatgcaggacaaatgcatttgacaagagatggtgttccgtctgtagccattaccgttcctgttcgttatctgcattcccatacatcagtgattcatgaagatgattatttgaatacagtgaaactagtcacagaattagtgaaacggcttgatagtgaaacagttgaaaaaattcggagttatgaataatgaataatagaatacctatttctgaatatcggaaaaaagcacgagtttctttggaaaatcaatggggaatcaatacttggcttgttttcttatctataatatttacgagcgtcatccagaacttttttgacggtttcagtccttttccggaagaaagcatgcagcagcacttattgagttttctagtcgataatttacttttattcgcattcaactatgcattgttttacattgcgctagtagttgtacggggtggcagaccaaaaagtaaccttttattttcagttttccaaagaaagtattttggttcgatacttggcatcaatttgatcaattcagtcatcaactggctactcaacagtttaatctttctgcccatgtttttaatcagcggagtgagtacttatatgcagctgcttttcagttcaaatgcggtacctacgggtgtcatgccagaagattttcttgatatcagctttgttttatcgatgatagggatgatttttgtttcagcactcatcatgagtattgttggcggtttattccaatttgctgcatggacaaagttcgactatcctgatttgtcggttattcaatgtttgaaatatggctggtttttattgaaagatagaattggtacgtatattttgttgcagctgtcttttatcggctggtatttgctaggagcaatcgctttgttcatcggtcttttgtgggtcattgtttatgtgaatgtgtcagttgcagaattttatgaacaagcacggattgaaaaaggaggtccagacgcctattttacttagcatgtaagcagtttattcatcaaaaaaataacttttgtggtaggataaatctttgagggggaatgtacgatgaaattaactgttttaggatgcttaggagcgtatccttataaaaatcaagggacaacaggttatttgcttcaatctgacgggttcaatttgttgatcgatgcaggtagtgctacgctgatcaaattacaagaacaccttgatccacttgatctagatgctgtgatccttagccattatcatcatgatcatattgctgaccttggtgtattacagtattactggcaacttcatcctaagagaaatccggagacattgctttcaatttatggacacacaaaagattccattcactttgaagaattgacgttggaaaatgtctcaaaaggacatccttattttgaagctgaagaattaaaaattggtccttttctgattacttttatggaaacaatccatccagtagtatgttacgccatgcgtatcgtagaagaaacaacggggaaagtattcgtatttacaggtgattcaggttatttggaaagtttcgctgattttgcgaaagatgctgatttgtttctagcagatacctatctttttgaaggaaatgaacatcatcatgcccatttcacttcaaaagaagctggagaacttgcgaaatcagctaacgtaaagaaacttgtacttacacacctacctcagtttggtgatttagaacaattgaaaaatgaagcgcaaaaggcagcaggcaaagggattgatatagaacttgctgcagttgacaaagtgtttaacatttaggaggaagaacatgatttttgtaccaaatgaaaaccacgacccaagaatcaatttagcaattgaacaatatttgctgcaagaaatgcctttagatgaacctattttgctcttttatatcaatgaaccttcaatcatcatcggcagaaaccaaaatacgcttgaagaaatcaatcgagattatgtggaagaaaatggcattcatgttgtccgtcgcttaagtggaggcggagctgtctaccatgattttggaaacctgaactttagttttatcatgcctgatgatggggattcattccgtgactttgcgaaagtaacacagccaatcatccaagcacttcatgaattgggtgttgctggggcggaattgaaaggccgaaatgatctagtcattgatggcatgaaattttctggcaacgcgatgtatgctaccaacggtcggatgtttgctcatggaacaattatgttcgactctgatatcaatgaagtagtcaatgcattaaaagtaaaaaaagacaaaatcgaatcaaaaggaatcaaatcgatccgttctcgtgtaacgaatatcaaaccatttcttccagaagaaaagcaaaaaatgacaacagaagaatttcgtcaagaaatcttgttgaaaattttcggcgtagagtcagtagaagaagtaaaaacgtacgaattgactgatgaagattggaaaaaaatcaatcgaatctctgaggaatattatcgaaattgggattggaattacgggaagtctccagatttcaatttctctcgccaaaaacgtttttctatcggttcgattgaagtccatttgaatgtctcagaaggaatgatcaaagaagcaaaaatctttggcgatttcttcggactaggagatatctctgacgtggaaaaaaaattggttggacagaaatatgataaagcatctctatcaaaaatagtcagccaaattgatgtgaagaaatattttggtgcgatagaaccagaagaattgcttaccttactttattgaaaataaaaaatagcggaatccacatatatggattccgctattttttatacaggattcgggtaatttcgagagagttgaacagtgatccgatcaatgaaagtatctttttcctgcgttagtgttcctgtgtaacgatccgctacgtctttcatcatcattaagtcaaaacgttcctgatcatctaattcttctgtgatgcctcgactaaataggtttgtatcgtaatgtgcactatgttcgcaacaaatgacgaaatgttcctcttgttcgtgtatcgacaaataaatttttcgatacagtggattttcgatggcatgagtttctctaaaggaatgctctaaagcgtggatcaaaagttgagccagatcgtcatcgttgataggaagttcttcgggaagatctgcttggaaggttatctgaatattccgtttggcagctaacttctggtaacgcgctaagataagatttgtcacctggtggttgcaaaaagaacacagcatttcgaaattttttgcttcttctaatatcttttccacatagtttttagcttttgtttggtccgtatgcattaaatcttgcagattctccatctcttggacaaattccaggcgaagtgtatttacttcttggatatgctgtcgaagctgctcataatgttgctccaacaaatcatttttgatttttaagaaatctacttgtctccgatctttgtcggtatttaagatgtgatcgattagattgtagctgataataacgattagaatgataatatataaaatcgtagaccaattgatcgttgtttgatagatacctaatgccgtttggatgtaaatcaagcaatggataatggctaccaagacgatccaaggtgtacaagctacataaaaacggttattcttatatgcttcgccaatgcatgcaagtgaagtgactaaagtgcttataacactagcaatattagcaatcggcattaattcaggaagttctgcaggagtaaaagttgcataaagcagaacgccgataaaaatcaaaagttggaacgtacaaaaaattccgtaccattttttatagtaaaacattcggctccaatagtagcagatgatgaaagctgacgttaagataataaataaatgagataaaaaagaatgaacgaatggttcaaaaagaataccacttaaaatatcttctgatacagcttcaaatcctaatgccaaagcaaagcaacttaagagaataagtgagtattcaagacgtttttgtttatacatcaagtagatcgtatagaaaaaggtccctatagcgataaaaacagcgattatcatcgtcaatacttgcggcactgattgtgaataaataaaactaatcaatggtccagttgttcctagataaactttcggtggcagtccagcatagttctgataaggagatgagactgtaagggtcaatttttttccgatataatttgctggtaaatctatcacagccaatgagagtccgggattgctttcttcctgataatctttccgttggtataaaatcttttcgcctagatatacagtaatccattgatggtttcctttgattagtaaatttgcttcgtccaacggtttttcaagtgtcgtttccataatgaatgtttcgtctttatccacggtaggaatcgtacgagtgtacttgctgtcaaacttaaaatcaggatcatcttttgtatagaaaacccacgaatcttttatttctttcatttgattgctgtccgcaggagaaaaaataaaataaaagaaataagcaattcctgttaaaaataacaatgataatataatgattatgctccactttatacgtaaataaaaagattcttttttattatatatgttattaaaaaaagacataaaggtattcctttctaaaacttgtaatgttagggtaaacgttttttaaactaacgtcaattatttataataaaaaatgagataaagatgaggaaatagaattagaaacatataattattaaagggaaacatttttacagctataatttgaaaaaaatttatcgttattatatgattaagaaggattgaataaagaaagaagttgaaaacgatacctgattacaaaaaaataacttttataagttctataacgttgattatatttttaattcttattcttctcgtcgtcttggttccccgaatttttggtttgactccttatattattgaggacaaagaaatgagtccatattatgcacaaggaaatctgatatatgtacgaccgaaaaatacaaatgagattttagtcggagatattattacatattatgaaaattcaggaaaaaaaatctcgacgcgtcgcgtaatagccgttgaaaacaaccacgaagatttttatacaaaagctgatacaaagacttatattgagcctggagtagtaaaaaagagaaatattatcggtagtcccatctttcagattccatatattggactagtcctttcaaaaacggcatttgcatggattcaggggttattctttacgattgctttttgcctaacaggaatcacagcatggaatacctttgtagagttgaaaaagaagcggagacgaacacagaaatttttgtaagaatgttaaaaacataaatgtattccagagatccaacgactcttctgaacatgaaacacgagaaaacactcatgcagcttgtagatttagtcagttgttcgtataatgtgtgaagaggaggagtagtatgcgcaatgaaatgatgcatcgtcctgtagtcaaagaagaactattggattttatgcgtacccagcaaaaaaaattaccgggtgagctaggcaaactggaagaagaagctcatgtagcagaagtaccagttattccccatgaaacagttgtatttttgaaatttttacttggacagcttcagcctgaacgaatcttggagatcggagcagctatcggtttttcatcaagtgtcatggccacgacaatcggagaaaacgctcatgttacgacaattgatcgtttcgatgtcatgatcgagaaagctaaaaaaaactatgaacgtctaggactgacagataaagtgactttgcttgaaggtcaagcagcagatatcttgccggagttgtctggtccgtatgactttatttttatggatagtgcaaaatcaaaatatattgaatttttacctgaatgcttacgtttgttaagaaaaggtggcgttttgatggtagatgacatcttccaaggaggaacgatcttgctcccagatgaagagattccccgtggcaaacgagctatccatcgtaaattaaatgaatttcttcgtgttgtgatggatcatcccgatttgacatcgacaatcttgccattaggtgatggtgtgatcttaatgacaaaggaatcagaaacaatcgagttgtgatacatgattatggcagcctgtagataatcgattgaatcgagggctcaattcgaacttgatgtaaaagtttctatatttgtaagtcaattaaaggatacaggaaatctaaataaacaggagtagcatgaagtcaatgtagctcctgttttcaattgataaccttagaacagctgaaggagaatgtctcgttttaaaagattgatttagtagttgggccaaaataattcattatttgctaattaaataactatttcgtattgacagaagcaatttaattatctataattattgatgttccgctgattcttgtcatagtagctcagctggatagagcatccgccttctaagcggacggtcgggggttcgaatccctcctgtgacgctaaaaaaccgttagaaactgaggtttctaacggtttttctttgttttttgtgccaatattgtttgttttcaaaggcaaataaaataaaaaaacatccttatcgagtacaattataaggagcaaaaaaataaaactcatcagaaaagaggaagaagatatgacgatactatctagaattttagtgactctagttgcaattgaatttttttatatcatgtatatcgaaacggtgagaactgattctgacacgacaagtagggtttttaaaatgagtaaagaagagttaagcagaaaatctgttcaaacattgtttaagaaccaaggagtgtacaatggactattaggagtgggactactttatggagcttatctttcttccgcatctaaagaaatcacaagtatgctattaatatctattttttttgttgcattatatggcagtttgactagcgatcgttggattttactcaaacaaggtgggctagctctgttggcattgctttctattttcttataaatatagaaaaaataagaatttatctaacaggaaactttgtgaaaaatattactttatctcatgaaatatgatattctaatgaatggtattttagaaaatttcatgaaaaaggagttagataggtgttcaaaaattatgtttcctcactaaaaaaagaattttcaggttatgatctttcaagatttcagaaagatcttttggctgggatcacagtagctgctgtagcattgcctttagccttggcttttggggtatcaagcggagctgatgcggccgcaggtttgattacggctatcattgccggtatcgttattggcggtttatcaggcggtttttatcaaatatcaggtccgacaggtgcgatggcagctatcttgatgtctattgcggcaacaaagggaatgcaaggtgtattgcttgctacttttttagcgggtctatttttacttgcagcaggacttttccgattaggaacactgacttcttttatcccagcacccgtaattacggggtttacttcaggtattgctatcattattgcattaggtcagatcgataatttatttggtgttcactcggaaggtacaaacgttattgaaaaactaagtagttatcaaacgataggatttccgataaacacagcctctttgatcatgggagggctagtcattttagggatgtttatctatccaaaaaaatgggcgaaacgaatgcctagttcgctgctggctatcattttggcaacagcagttatgctattgttccatttaccagtagcaactgtgggtaagattccacaaacattgatcagtagtaatcgtttgaatatgggagattttagcttttctgccttgcaacaagtggcagttccagctattagcattgctttattaggaatgattgaaagcttgctatgtggtgcttcggctggccgaatggcaaataagcccttagatagcaatcaagaattaatggcgcaaggaattggaaatctgttgcttcctttctttggcgggattcctgctactgcggccatcgcccgtacaagcgtggccatcaaatctggtgcacaaactagattagctggtatgatacatgcagttgtcttactgctctccatgcttgtttttgcgccagtgatgtcacagattccaatgccagcacttgcaggtgttttgattgtgacggcttggcgtatgaatgaatgggaaacgatcaaggagctatttactaataaatattggtcagcagttctattgtttatccttacgatgatttgtacagttatctttgatttaagtattgctatcgtgatcggggtgatcggcggctgtgtattttttgttgtcaaaagcgctgctatcacgatttcattagaaacgatcgattggcaaagaatggggctgccagaaacggaaaagctgaataactggacagtagtgtatattagtggtccactgttttttatgtcttcagaaaaactcaaaaataaattggaagaactaaatcatcacgatggtgtcattttctccatgcgaggcgtaccaagtattgatttgacggcacgtgcagtttttgatgaatttcaagaaaaagcagagcaaagaggacaaacgattatctatacttccttgcagccagaagtagaaaaacaactttctcacttgtgggaacatacattcacgcatcaacatcaaacagttgctcatgcgttgacagctttacatgcgaaatatactgcaattagccattaaaacaatgaaaaagaacagacaagactgtaaactgaagattttatggtcttgtctgttctttttaatattgctgtaaaagtgaagctagtacttgccagtcttgatggataacaggtacaagggagcgattgtagaaaatagctgctggatgaaaaagtggaagaattcgatagtttttttctgaccattcgtaggcatccttttgttctgttaattgtaagacaggccctgtatagagttgaccatgatttttggtaaccgtatattctttgccaagtaaacgttgaagaccaatgtttccaagtgtcgcaattaattttggctggaccttcatcagttcgtaatccaatattggtgcatgcgcaaatacttcggaacgagtaggtgtccgatttggataaacagtttctgactgttgtgtccgtttattgatccgatgagtcacgcgatacgggcggctccttacagcactggtgatatacacctcttctcgtgttaagccagttgaagaaagtgcctgcatcaattcttttccagcttgaccgctaaaaggaacatgcgtatcaatctctgttttccctggggcttctcccacgagcatcagtttaggatgaagaggtccttgcccagcgataaatccttctacaggacggccgttcattcttaaagaagcttcttgtatcagttcttttgggtattccatttatgctcctcctttttcttttattataagaataaaagaaacacaatgcgactattttatttggtagaactgtgaggatagaaaagcagaagtattgcttgaatttttgttttactttttgattttaaatttagttgactaacggttgctgttctggtaagctagtactgttgtaattgtggactccacagctacaaccgctcagaacaagtaataagcacagcatatgctgtcacttcggatggcgagtctaagtatatcagaaggaggtgctttatagcatgtacgcaattattaaaactggtggtaaacaagtaaaagttgaagtgggacaagcaatctatgttgaaaaacttgacgttgaagcaggagaaaaagttgtttttgacgaagttatcttagtaggcggagaatctacaaaagtaggcgctccaactgttgcaggtgcaactgttgaaggtactgttgaaaaacacggcaaacaaaagaaagtcgttactttcaaatacaaacctaaaaaacattcacaccgtaaacaaggtcatcgtcaaccatatacaaaagtggttatcgacgcgatcaacgcttaatagcgtttgagaaagaaggcctatatatgatcaaaggaacatttaagcgaaatgacgcaggtcagatcgtttcattcactttgaccgggcatgctgatgctggtccttatggaagtgatatcgtttgtgcgggtgtttctgcgttagcgatcagcactgtcaacgggattgcctcattagccggttttgagccgattgttgaaatgaatgaagaagaaggcggttatctttataccgaagtcacttcaggaatgacacaagaacaaaacaatattgctgagattctattagaaaatcttttattaggattacaatcgatagaagctgaaaactcagaatatatccaaattaaaacaattaatgataaataggaggtgcagaccatgttgttatctatgaatctacaattatttgcccacaaaaaaggtggcggttctacatctaacggccgtgactcagaatcaaaacgtctaggtgctaaacgtgctgatggacaaacagttacaggtggatcaattctttaccgtcaacgcggtacaaaaatctatccaggtgtaaacgtgggtatcggtggagacgacactttatttgcaaaagttgatggcgtagtacgtttcgaacgtaaaggccgtaacaaaaaacaagtgtctgtttatccagtagctcaagaagcttaattgaatcttatgattaaagaggttgtgacaagacttttgtcacagccttttttgtttataaaaataaaagttgtagtggaggctacgaagtttactttgtctttttacacttaatatttttttgccaatttggaatcaggatgttttgataactatcgttttcaattgatggaagctatattgtttgctatcagtgaaataattatatggtaaacagtgttctttttcttgtttccattataaaaatcgtatcgggatttttcgttcttttaaattgaacatttctatctatccgcgtgttatcaacaaaacaaaatcaggtaaatagttgacgaaacagaaataaatacatagtattatgttttgaagcctaagtacaatagtctatagaaaaggagcgataccattggcaaaacgcattgaccgaatttatatgtatgtcaaagaaaaaaccgctcatttaacaaaggcagaatatgatcaaggagtaacaacacaggaaattgctgaagtgttagggattcagcgaacaaatagcagtaaagatctgaatcagctagtgcgcgaaggaaaactgataaagacagacggacgaccagtacgttacatatatcaaacactcgttacgcacgtaaagccagttacaaaacatgtagtcagttacaaagaaacgccggtctctgaagaaaaaaatacactccaaatagatactaaggatatctttgcaaaaatcattggagctaacggcagcatgaaaaattcagtggaacaggcaaaagctgcgattttgtatccgccaagaggattaaattgtttgattacaggacctaccggatcaggaaagacttattttgcacacgcgatgtatcattttgcaaaagcgcatcatgtaatagatgaggaaacggaactgattgttttcaattgtgctgattatgccaataaccctgagcttttgatgagtcatttatttgggtacgcaaaaggtgcttttacaggcgcagatgaagaaaaaatggggattatcgatcaagcggatggcggtatgctgtttttggatgagattcaccggttgccgcctgaaggtcaagaaatgatcttttactttatggatcatggaacttacagtcgtcttggggaaacaacgaaatcccatgaagcaaatgtacggatcgtaggtgcgaccacagaagacccaggttcttctctattagaaacttttgttcggcgtatcccaatcaatatcaaacttccggcttttgaaaaacgtcctgcaaatgagaaagtcgatttagtaaaaatcatgattgcccacgaagcaaaccgcacgcagcgaaagatttctttgacagaagatgtagcaaaagcattgatcggcagtgtgacctatggaaatataggacaattgaagtcaaatatccagttagtatgtgcacgaggatttctaaatcatatgcaatcacccgaaatctcgatcacaatcgatgatttgacagaagggattcgtagcggattgattcaattagcaagcaaccgcagtgcaatggcagagctttctaaaatattggagccaaagataactgtagcaccaaatgatacgatcatgaaaatccaatcggactcctatgagttaccttataatctatatgatatcatcggagataaagcagctttactgaagtcggatggtttggatcaagaagcaatcaatcatttcatttctacagatatcaacatccatctgaagtctttctataaagaccatggtttttcttttaatgcagacagcaaattagcagaatttgtagatccgaaaatcatagaagtgaccaatcagatttatgtaatggtcaaaagatctttaccatatgagtttcagcaaaactttatttatgctatgagcttgcatatcagttcttttttgaaaaaaatcaacttaggagaagaacggcatacgaatgataacatccgtgagatggcttttgattttccagatgaatatgctgttgcgaaagaagtgcgtagttatatcgaaacgtattttcaagtggagattccagaaagtgaagactattacttgaccgttctactcgtctcgttacgggcaaatcaagcaagcggcagaatcggtgtagtcgttgcagctcacggaaacagcacagcaagcagtatggtccaagttgtccaacagttgttagatgcagagaacgtacgagcagtagacatgcctttggatatggatccgaaaacagcattggaccgaattgaacgcaatgtacaagaagtagatgaaggaagcggggtcatactcttagtagatatggggtcccttgcgtcgtttaattcgcaaattcaaagagacactggaattccagtacgtactgttgatatggtaacaacttctctagttttggaaactgtacgaaaggtctcagtattagggacagatctagatatgttgcatgaatcattgaaaaattttcgaggttacgcagaaatatcttctgtagaatctgttcaggaagcaaaacctattcataagaaaaaagctgttttggctatctgcgcatctggcgaaggtacagcacaaagaatcaaagaattgatcgaacgagcggtaaacaagcgtcaagaaacagaattagaagttctagctttgtcgattgtggaagtgaaagaagaactgccagttatccaaaaagaatatcagatcatagctactactgggattactgatttgaatatccaagccccatttattcctttagaacgttttattgatcaaaatatcgaagtcattttggatcagttgctgatggaatcagaattggaggaaactgaattcatctccctagatgaagagtcagctaaaaatacgtgtgttgagtttatctctgataacttcatctttattaatggtagtaagttaatcgatccaatgtggcaattttctacacaaatctctcagacgacgggaatcggcgatgaagaatatggattcaaaatcaacctagtgatgcacacagcaggaatgatcgaacgtattattcggaatgaaccattgactgtggaagaaaacgaattgacaaatacaacgaatgatcctctttatagccaattggcagcctcagttgttctgttggaagatcagataaaagtaaaagtgccgatagaagaaatgtattatctgctacgtctagtccataatcagttagataaaaaagaatacactgtgccatgaatacacaaaaacgatacacttttatagtgtatcgtttttgtgtattggttaagaatcctttaaattcaattagtgtatcgtaaaaaagttggcacgctttttgcttatagtagtgtgtgctaggaggtggttgttcacacagaaatgataggggtttctgtgaagtagtgaggaagaaggagttttgcagatggatattcgattggcacgtatagatgatcgtttaatccacgggcaagtcgcaacagtttggtcgaagcaaacaggtgttgaacgtatcattgtgatcagcgatgtagtcgctcaagataaattgagaaagtttctactaaaagaagctgcaccgccggggatcacagcaaatgtaataaccgtgcagaaaatgattcaaatctatcatagtggattattatcacgagcaaaagtgatgcttttattcaccaatccccaagatgttgaagcggttgtccgctgcggtgtacagttgaagtcgttgaatatcggcggtatgagttttactgaaggcaaatcaatgattaccaattttgtttcagtaaatcaacaagatattgattcctttcgttacttgaacagtcaagaagtggagttagagattcgaaaagtacctgctgacaggaaaatccttttgatggaactactagcgaaaatcaaaaaggtgtagcaagaatggttgttggaaaaggtcaaataattctgttgtaatggttagcaattattaatatttttgaatttgttacaacaaaagtaaataggaggtataaatatggtagggattatcctagcaagtcatggacaatttgctgaaggaatcttacaatccggttcaatgatctttggcgaacaagaaaacgtcaaagccgtgattttgaaaccaagtgaaggtccagatgacttgagagccaaattggaagaagcggttgcttcttttgataatcaagacgaagtgttattcttagttgatttatggggcggaacaccgttcaatcaatcaaacacattattcgaagagcacaaagataaatgggcaatcgtcagcggtttgaatttaccaatgttgattgaagcctacgcatcacgcttttcaatggaatctgctcatgaaattgcagcacacatcattgaaacagcaaaagacggtgtaaaagtaaaaccggaagaattagaaccggcagaagcaccgaaagcagcagttgaagacgcacaacctaaaggagcacttccagaaggaactgtggtcggagacggaaaaatcaaatatgtattagcacgtgttgactcacgtctgttacatggacaagttgcgacagcttggacaaaagcagtgcaaccaaaccgtattatcgttgtttcagatgcagtatcaaaggatgatctgcgtaagagactaatcgaacaagctgctcctccaggtgtaaaagcaaatgttattcctattagcaaaatgatcgaagtagcaaaagaccctcgttttggaaataccaaagcattgcttttatttgaaaatcctgaagacgtattgacagctgttgaaggtggcgtagacatcaaagaattaaatgttgggtcaatggcgcattcggtcggtaaagtcgttgtaagtaaagtattgtctatgggacaagaagacgttgaagcgtttgagaagcttgaacaaaaaggtgtgaaattcgatgtacgtaaagtacctaatgattcacgcgataacatggatgatattttgaaaaaagcaaaagctgaattagcaaaagcgtaataaataatattaaaatttataggaggcttatcatgtctattatttcaataattttagtcgtattagttgcctttctagctggtatggaaggtattcttgatgaatttcaatttcatcaaccactagtggcatgtacattgatcggtttagttaccggtaacctcgaagctggtatcgtacttggcggtacgcttcagatgatcgctttaggttgggcaaatatcggtgccgctgtagcaccagatgctgcattagcatcagtagcatcagcaattattttagttttaggtggacaaggtgttaaaggtgttccttctgcgatcgcgattgccgttcctttggctgttgcagggttgttcttaacaatgatcgtacgtacaatcgctgttccaatcgttcatttgatggatgcggctgctgaagaaggaaacatccgtaaggttgaaatgtggcacatcattgctgtatgtttacaaggggttcgtatcgcggtcccagcagcagcgttgctatttatcccagcacaaactgtgcaatcattccttgaatcaatgccagcatggttaacagatggtatggctatcggtgggggaatggtcgtagctgtaggttacgctttggtaatcaacatgatggctacaaaagaagtatggccattcttcgttattggtttcgttgtagctgcaatttctcaattaacattgattgctctaggtgctttaggtgttgcattagctcttatttacttgaacctttctaaaatgggtggttcatcaaataatggaggcggaagcaactctggtgaccctttaggcgacattttgaatgactattaatcttgaaggaggaaaataaaatggcagaagaaaaaatcaaattatcaaaaaaagatcgtttagctgttgcgtggcgctctaccttcattcaaggttcatggaactacgaacgtatgcaaaacggtggctgggcattttctatgattccagcaatcaaaaaattatacaaaacaaaagaagaacgttctgcagcattaaaacgtcacttggaattctttaatacacacccatacattgcttctccaattttaggggttacattggctctggaagaagaacgtgcgaatggcgcgcctgttgatgatgtagcgattcaaggggttaaagtaggtatgatgggtcctttagctggtgttggtgacccagtgttctggtttacagtacgtccaatgctaggtgcactaggtgcttcattagctatgggaggaaatatccttggaccaatcatcttcttcttaggttggaacattattcgttgggcattcatgtggtatacacaagaatttggctacaaagctggttctaaaattactgatgacctttctggcggattgttacaagacgtaacaaaaggtgcttcaattttagggatgttcgtattagctgcccttgtacaaagatgggtatcaatcaaattcttaccagttgtatcaactgtaaaattagataaaggtgcttacatcgaatgggataaattgccttcaggtggtgaaggaatcaagagtgcatttgaacaagttaataatggcttagccctttctcctgaaaaggtaacaacattacaagacaacttagaccaattgattcctggtttagctgcattaggattaacattgttatgtatgtggttgcttaagaaaaaggtttctccaatcgttatcatccttggtttattcgtagtcggtgttgttggacacgtcatcggacttttataatccataaaaatatagctcgggcgttgtcccgagctttttttatatagtatactgttcataaacaaatatctggagggagaaaatggttcaatcaatcaatacaaaagtagacttggtaattgatgctacttcgtttacgggtctgacagattacgggcaaatcatgataggtgataatggttttgagttttaccatgcgcgagatagacgcaaatatatccaaattccatgggaagaagtggattatgtactagcatcagtcatgctaaagggaaaatggattcctcgatatgccattcaaacgaaaaaaaatggtacatacacattttcttccaaagaacctaaaaaagtgcttcgtgcgatcagagaatatgtagatgaagatagaatggtacaatcattgagtttctttgatgtagtgaaacgtggtattcgtagtatgtttaaacgcaagtaaaaaataaagaaaacttctaagaggaggttttctttatttttttactttgcagaagaaaatatgaaatagcaaaaccaattatttgtcccctttaaatcccatatgctaaaattgattagcaaagaaggaggttatattatgagttggttatggacattgattgttggagccgtgatcggagcaattgcaggtgcgatcaccagtaaaggaaattcgatgggctgtgtaacgaatatcattgctggactagtcggttcaagtattggacaagcgattttcggcgaatggggaccaaaagctgcaggtatggcacttattccatctattttaggcgcagtgattttggtagcagttgtctcatttttctttggaaaacgatcataagtttttacaaaatagtaaactaaaaggagttgcagcgagactgtgactcctttttggctttatttatttaaaataaaaagaagttttccggaaatttttatttaactgtcgtgtacgaagaaaagtttgctataatggaaaaaagcgtgcaaagaaagagggagtttcattatgatgctacgtgtagaaaaattgcgcaaaaaaatgcaagaagaaaatttggattcatttttggttaccagtccgtacaatcttcgttacttaacgaactttacaggtacgacaggattagctgttattactttggaaaaagcattttttattactgattttcgttataccgagcaggcggcagcgcaggctcaagggtttgaaattattaaaaatgtcggacctatttttgatgaggtagcaaacttagtacgcaaagaagaactgcactcattagcttttgaggaaacaacagtctcatttttagaatattcggttttagaagaaatcatcgatgcggaattagtacctgtttcacagatgatcgaagaactcagagaagtgaaagatgaagaagaaatcgctattatcgaaaaagcatgtcatattgcggatatggcatatgatcacatcctgaaaatgatccaaccgggcatgactgagattgaagtcgcaaatcaactagacttttatatgcgttctcttggcgcttcaggtgtttcttttgatacgatcgttgctagcggattgcgttcggctatgccgcatggtgtagcaagcaaaaaaatcatcgaacaaggtgacttgatcacattggactttggttgctattacgaagggtacgtttccgatatgacacgtacattcgctattggtgatcctggggaaaaattaaaagaaatttatcaaatagtcttagatgctcaattagcagttattgatgctgcaaaaccaggaatgactggtgtccaattagatgcagttgctagagattatatttcaaaacatggttacggggaagcatttggacattctacaggacatgggatcggtttagagatccacgaaggaccaaacgtttcttctcgtgcagaaaagcaatttgtaccaggaaatgtgatcactgatgaaccagggatctacttaccaggaatcggtggagtacgtattgaggatgacttgttgatcacagaagatggaaatcgtgtgttgactcgttcaccaaaagaattgatcatcttatagtttcatcaatagaagaagtaagcgtaaaaatcagtgttcacagactttgttatagaaaatcactcgatttaatgatacactatagaagaacttttaagctgtaagagataataaagttgggtgttttctccaattcatagcagtttgcagctgatcggcggcagttttcttaccacgtgatcactatgccgcatcatagagaattcggatgtatctcgtgcttaggcaaagggaggaataaataaatggcagatgaaaaaaatttgattttaaacgcaaaccaagatttaggagagatcgtgatcgctcctgaagtcatcgaagtaattatcgggattgcagcttctaaagtagaaggcgtatacggaatgcgcggaacttttgccagcaatgtcactgaattattaggacgtgcagctcacggaaaaggtgtttacttagcaaacgaggaagatggcttgaaagtagatctttactgttatctagaatatggtgtttcagttcctaaagtagcaatggaaatgcaggaacgggtcagccagcaagtccttttcatgacggatatcgatttatctgaagtcaatatccatgtagtagctgttgttcctgaaaaattagaacaaccaacaatcgaagaactttttgaagacgaagaggaagagaatgaataaagaattatcaagacacgagattcgggaaatggcattgcaggctttatttccattagacttcaatgcagacctaacaaaagaagatgcgattttcaacgcaatcgaattagaccaccgcgacatgatcaacgaagatgaatcagagtttgttcctgtttatcttgatacgctagttggcggtgtctgtgcaaaaaaagatgaattggataaagtgattgaaaaacatttaaaaaacaattggcacatcaatcggatctcaaaaatggatttggtgatcttgcgtatcgcgatttttgaaatgacttatgtgacagatgtaccagcggctgttgctttaaatgaagcaatcgagttggcaaaaacatttagtgatgaccgttcacgtaaattcgtcaacggtgttttatccaatgtattgaaagaattagaagctggggcgtaagtcctagcttttttctatgaatcatcataaacctgttataaatcgggaaaattctatggtagaatgaaaacacaaaaaatatctgggagtggttagatggcagaattgattaacggaaaagaattagctgaaaaaatgcaggcagagattgctgaaaaaatccaaaaattgaaagataatggtatccatcccggattagtcgttttattggtaggggaaaatccagccagccaaatctatgtaagaaataaagaacgtgtagcaaaagaaatcggaatccattcattggtagagcgttatcctgagacgatttctgaagacgaactacttgcagaaattgaaaaatacaatcaagatcctagttttcatggtatattggtccaattaccattgccaaagcatatagatgaagaaaagatcctgttagctatccgccctgaaaaagacgtagacggttttcatccgatgaatttaggcagactccttgcgggtaaaccggacaagattccttgtactccatacggcatcatgaaaatgtttgaagcttattctatcgatccggcgggtaaacgagcagtagttatcggacgaagcaatatcgtcggtaaaccgatggctcagctactcttgatggcagatgcaactgttactgttgctcattctaaaaccgaaaatctggctgaactggcacaagaagcagatattttagtcgtagcaataggacgtggacattttgtcacaaaagaattcgtaaaaccaggtgctgtagtgatagatgtagggatgaatcgtgatgctaacggtaagctgatcggtgatgtgaaatttgatgaagtggagcctattgcaggctggatcactcctgtgccaaagggtgtagggccaatgactatcacgatgctgatgtatcaaaccgtaaaatctgccgaagcttttggagcaggtgaatagatggcacaagaatatttaactgtcactacattaacgaagtatttgaaaagaaaatttgatgccgatccttatttagaacgcgtatatttaacaggcgaaatatcgaatttccgtttacgtgccaatgcccatcaatatttcagcttaaaagatgaccatgcaaaaatatctgctattatgttcaaaggagcattccaaaaattacgattccagccaaaagaaggaatgaaagtccttgtcgttgggcgtatttcattatatgaagcgggaggttcttatcaaatctatgtagagcacatggagcctgatggaataggtgctttatatcaagaattggaagaacgaaaagaaaagctgatgaaggaaggcctttttcaagggcctaaaaaaatgctgccacgtttcccaaagcgaatcgcggtccttaccagtccaagcggagcggttatccgcgatatcatcacgacggtgaaaagaagatatccaattgtccaattggttttgttcccaacagttgtacaaggaaaccaagcagcggacaatgttgtcaggaatatccagagagtagaagagatgggcaatttcgatacaatgatcatcggtcgtgggggtggttcgattgaggatttatggccgtttaatgaagagcgggttgctcgggcgatttatcaagctaatacgccggtgatttcatctgtaggacatgaaacagataccacgatcgctgatttagtagcagatgttcgggctgccactccaacagcagctgcagaattagctgttcctgttttgtcagaagagttgatgcgcattcaagaacggcaagctagattgcagcaggcgtttgtacgccagatccagcgcaaacaagaacggttcgagcgtgctcgacgttcctatgtatttcggcagcctgaaagattgtatgaaggtcagaccatcaaattagaccagttgaaacagcgattatatcaagctacacagcaaatttatcatgcgaaagaaaaacaaacgatcgcattaagccaccaattggaacaagtggctccgctttatcgagttaaagcagctcgccaagaaactgcttatctagaaaaacgcttagaagagaaaatccaacaatatatgaaacaacagcagcagcgttttgctcaagctgttcaatctcttgatttgttgagtccattgaaaatcatgggaagaggctacagctatacgacgttaaatgatcaagtagtaaaaagtgtcaccgagattcatcaaggggatttgctgacgatccattatcaagatggaatcgttaaaggacaagtacaagagatagacaaaggagaataaaaatatggaaaatccaacttttgaagagtcactgcaagaattagaaaaaattgtcatgcagttagaacaaggagacgttccattagaatcagctctagattcgtttaaacgaggaatggaattaagcaaacattgccaagatacattagctaaagcagaagagaccttgacgaaaatgatgacagaatcaaatgaagaagttgattttgacggaaacgaggaaagctgagatgagattaactgacttttcagctattcatctacctgctgtagaaaaagaaatcttgtcttttttagatgagcatacaacggatagaggactctatgatgcgatgagttattcagtgaaagcaggcgggaaaagaatacgtcccttattacttttaacggccgttgcttcctttgatgagcctattgatgttcccgtctatcaagtagcagctgctttagaaatggtgcatacgtattccttgatccacgatgatttgcctgcgatggacaatgatgatcttcgtagaggaaaacctaccaatcataaagtattcggcgaagcattagctatattggccggagatggtttgcttacaggagcattccagctaatcagtatggcacacttaggtaattctcctaagcttctgctgcttcagcaattagctgtttgtgcgggatcacaaggtatggttgctgggcaagctgcagatatcgagggcgaatcgaaaaagctttctttagaagaattagcatttattcatgaaagaaagacagggcatttgattcgttatgccttgctggctggtggcatattagcgaagcaacctgaagaaatcttattgctacttcaacgattagccgaacatttaggtttagcttttcagataagagatgatctactcgatgtgattggtacaacgaaaacattagggaaaacagctggtaaagatgaacgtatggaaaaaaatacttacccgcgtttattaggcctagaaaagacacgtgaggcgttggagattgagctgttatccgccaacaagatcatagacaaattagaagaggacgttttttcttttgatggcgggctgatgcgccagatgatcaagcaatttgatgtggagaaatgagggaaagaatggaaaaagaacgcgtagatgtattagcggtcaaacaaggattatttgaaacaagagaacaagccaaacgttcagtgatggctggtttgatttacaacgaaaaaaacgagcggtttgataaaccgggagaaaaaattccagtgagtagtgaattaagagtcaaaggtaaaaaacttccttatgtttctcgagggggattaaaattagaaaaagcactcaaagcatttgatctatctgttgaaggaaaaacattgttagatattggtgcatccactggcggatttactgatgcagctttgcaaaatggcgcaaaaatgagttatgctttagacgttggctacaatcagctagcttggaaaataagacaagatcctagagtcgtcgtaatggaaagagtgaattttcgttatgcaaaacccgaagactttaccttaggaattccagaagttgctgttatcgatgtttcttttatttcactaaaactgatgctgcctccattacatgctattttaaaagaagagggagaagtgattgctttaatcaaaccccaattcgaagcaggcagagaagctgtagggaaaaacggaattgttcgtgaccctcagacccatcaaaaagttttagaagacattttgtcatttgcggcacaaggtggatatgatgtgctggaattaagttattctccgatcacggggggagaaggaaatatcgagttcttggctcacttgaggaaagtacccgaaagcggaacaatcaattcagctattaatatggcagaagtggtttcaaatgcacacgaacagtttgaccataaataaattgtaactgtgaaaatcaagtgagaagtatgcggattcttctttattataccaaggaaataagctatcattgattaagaagaatatgctaaggagcgaagacgtaatgagaaaaaaagatcggcatcgtttgattactcgattgttgagtgagcaagatatccgaaagcaggaagaatttgttgaaatcctgaaaagcaaaggaatatctgttactcaagctacgatttccagagatataaaggaactgaaactgatcaaggtaccggcttcagatggcggctaccgttatagcataccagctgaaacaaacgaagatgtaaatactaaattggaaaaactattaaaagacgctttcgtggcagttgaccaaatggaaaaatttgttattttgaaaacattgccgggaaatgcttcggcagcagcaaatttgattgataaacgttacaagaaagaattattttcgattatcaatgatgacgataatgttttgatgattacacgaactgaagaccaggcagttttattgaagaaagacttcctgcattacctttaagttgaggagcgaatgtgatgctacaagaaatcagtattactaactttgcgattattccggaattgcggctttcttttcacgaaggaatgaccgcgctgaccggagagactggtgcgggtaaatccattattatcgatgctttaggtctgttagcaggaggaagaggttcaagcgattatatacgtcaaggagcagaaaaatgtgtgcttgaagggttgtttgaactaccaaaacaagaaggattctctgaactgatggttgaattagggatcgaaacagatgaggacaatctgattgttcgacgggatatgtccttaactggaaaaaatgtttgtcgagtgaatggtcatattatcacattagctaatctgagaagaatcggcagttatttagtagatatccaaggacaaaacgaacatcaggaactgctccagcctgaatcacatcttgctttattggatcgttttggagatgtagctttccaacagaagaaaaagagttatcagcaagaatatatctcttatcgtgagctggaaaaaagggtacgaaaagtgcagcaaaatgaaaaatcctatgttcagagaatagatatgctccatttccagcaagaagaaatagctgctgctgatttgcaagtcggagaagaagagaaattaaaagaagaaagagaaaaacttagcaattatcaaaaaattgctgatggattagctgcaggttacggagcactgacgaataatgaacaaaacagtgtagatggtgttggcttggccgtttcagaactgcaagggatcgcccatctagatgtggagtatgaagcaatttatgaaaatatccaaagtgcttactatttgctgcaagatgcaatcggcgatatgagtcgtcagattgatttattggagttagatgagagtcgtttagaagaagttacgcaacgtttagaattaatccgacagttgaaacgtaaatacggcgaatccattgagtcaatattggcttactatgacgaaatcaccgaagagctagcttcttctgatttttcagaaggtcaattggacaaaatgaaagaggaactagagcaaaaagagcttctacttcagcaacaagccgcagatcttcatgaagcgcgtaaaaaaatcgcaaaagaattggaaaaatccattctgcatgaattgaaaagtctgtatatggaaaacactgagtttgaggtacgtttcttaaaagaagaaaatagacaattgaatcatgatggatttgaccaaatcgaattttacattacgaccaatccaggagagccactgaagcctttggtgaaagtcgcttctggtggcgaactgtctcggatgttgcttgctttgaaaactattttttcttctgagcaaggtgtgacaagtattatttttgatgaagtggatacaggtgtgagcggaagagttgcacaggccatcgcagataaaatttctcaaatatcgaaatactctcaagttttgtgcatcactcatctgcctcaagttgctgcagtcgccgactatcaatattatattgtgaaagcagtgattgatggacgtacgcaaacttctgtttcagagttgaaaacaaaagaaagagaagaagaaattgcacgtatgctggctggaagtgagattacaaaactcacactcgaacatgcaaaagaactattgaaactcgcaaaaaggacctgagccacctcgcagtggttcaggtccttttcagcagctgatagctatattttatttttacatgacactcattacagcagtcaatacaacagatccaatcgttaaaatcagcattgtccaaatgacaaattttgttactttagcaaaagtacttgtttgttttttttcacgcattgttttcaacctcgtcattaattagttgattcaagtgtacaatcttttttccatttccacaagagggcttttttataaaaacttccctttttttaaataataggtagttacgatacaaataaataatgttaatagaactagccatataaaggcatcatccctttcagcaataggtaacttaatgttcattccatagatactgccgacgattgtcggtatagttaaaataatcgttaaagaagttaaaattttcataatattattcagattattcgatacgattgctgaaaaagtctgattcatttgttctactagttttaattgaatgcgagaagtagtcattgcctgctctgtttccaccaatacatcacgtaaatgatttttcaaagcatgattttcttggaaaagtttattttgcgctagttctttcaatgcatctaaattagcagaagtcgcttctctgaaataaacgaggcttttttggatatccatgatttgataaagttgtttgttttcagtggatacttgaagtttggcttccaaagtatcgcattgagattgaagcgtagctaaataactgttgtaagagagtgtgacctgccaaatgaattgaaagaagatattgagattaggcgaaatatcactttttggaaaggtctggctaaagactttctttaaaaacagtggttcatgattcgtaattgtgataagcttctttttgggcgtcaaaataatagagagcgggtatgtatccacttgaaaataaccgctaggacttgttttagcaaaaggatattgtaacaataataacgctggctttgtcaactttgattgattgaattcttctgtacgggaattttctgcatcgtccaatatggaagtgatgtaatctgacggaatttcaaattgatgtgtcagctgatgaatctcttcttgattaggacgttctacacaataccagatcgtttggtcagtttcctttccggtattacgcagtttctcattatctaatgtaaaatatttgatcatgattttcctcctgttgcctgtttcttttattataacggatagggaattggaatacatggaatgtgtttgtaagatatagaatataactgcataaatttaaataaaatgaaacagttgtgtaaagtatatacagtatacttgaagcaacgataaaaaaggagtttacgttcatgggcacattcacaccacttatcttgttttggtatatttacccggtaatcgttttgtttggttgccaatttcttgtaaaattattttcgttaaatcgtcgttttaaaataaaagcccctgatttggcgattccttttttgtggggcggtatgcatgcattgtctagaaatacagggacaatttctatcttaccgtttttctttatttctgttttgctaatgggaatttgtattgctgttttccaagcatattattatgaagaaattatttatccgcgttatttcaagatgacttggcgtttggtttttctgttgacaatcgtcttgtacgctgtcttgatcattgtgaacatactttcttacctatgaaaaaaatagaaaagctgtaaaaagtcttttaaaaggctttttgcagcttgatttttaaaaaaatgtttatgaataaaaaaagttgttcccggatttcccagaaaaggtggtagaaagtgggggattgtggtagactaattttagttagtggaggaatggggggctttcaatgttgatgggtgaattccaacataatattgatgcaaaaggacgtttaatcgtgccctcaaaacttcgtgaagaacttggcgaaaagtttgttctgacacgcggattggatggctgtcttttcggctatccgatgagcgaatgggaaaatctggaagctaaactgaacgaaatgccgttggctaaaaaagacgcacgtacttttgtgcgattcttctattcggctgccactgaatgcgaacttgataaacaaggacgaatcaatatacccagcacgttaagaaattatgcagctttgacaaaaggttgcgtagtcatcggtgtatctaaccgaattgaaatttgggatgagacacgatggcaagatttttctgcagcagcagaagagaactttgacgaaattgctgaaagtatgattgatttcggactataagaataggaagaggctgactaatgactgaaacatttcaacactatacagtcatgttgaaagaaacggtagatggattgaacatcaaaccggatggcgtttatgtagactgtacactcggcggtgccggacatagtgaatatttattaagccaactaagttctaaagggcatctgtatgcgtttgaccaagatcaaaaagcaatcgatcacgccaagctgcgtttagcttcttatgtcgaacaaggtatggtcacatttatcaaagcgaacttcagagaattagaagaacgcttgagtgagcatgtagataaggtagacggcattttgtatgatctaggggtttcctctcctcagctagatgaagcagaacgtggatttagttatcatcaagatgcaccgttggatatgcgcatggatcagtcagctcctttatccgcttatcacgtaattaatgaatattcctaccatgaattagtaaagattttcttccgctatggcgaggagaaattttccaaacaaattgctcgtgaaatcgaacgagtacgaaaaacaaaaccaatccaaacaactggtgagcttgtcgaaatcattaaacaagtcatcccagctcccgcaagaagaaaaggcgggcatcctgcaaaaagaatttttcaagctgtgcggattgcagtaaatgacgaactcggtgccgaagaggcctctttagaacaggcaatccggttattgaaagtcaatggaagaatcagcgtaatcacattccattcattggaagacagaattgtcaaaagtatgtttaaagaatatagtacggtacaagatctaccaccgggacttcctgtcatacctgacgaattccaaccagaactgaaagtcattactcgtaaaccaatccttccttcagaggaagagctaacagaaaacaatcgatcacgcagtgcaaagttacgtattgcagaaaaaataagaatgaaagaggagtagaatgatggcagaattaaagaaaatgcaagattacgaatatgatttacctgaattggtggatcagccggaacaacaaatgcctgattcttcttcgaatcaagaaatcattcttccacaatcaccggcaaaacgattaaagcagatttctgctttggaaaaaattgctgtggcaagcgtggcgattgctattgttgctttatgtgttttaacagttatgctgcgcacaaatatcagcggagctgaaaaagaaatcacgtcaatacaaacagaaatcaatgataaaaagcaagaaaaaacgagtttagaacaagaaaaaaacgaactttctcgtactgaacggattaaacaaatcgcagaagaaaaaggattgtctattaatgacgacaatttaaggaaagtgaagtaaatgagtcttaaaaataaaattcggcggtttatggaaaagaaaaatctaaatccgatgaacaatcgcaaaaaagtaggtatcattttatttgctacgagtattggattgttctttttatttgccgtccgtttctcgtatatcgttattggaggtcatgttgctggtacctcattagctgaaaaaacaaaacagttgtaccaaggaagtgaagtagtaaaagcaaaaagaggaacgatttatgatcgtaacggtgtggcgctcgcagaagatgcctcctcttattcaattaaagcgatactctcaaaaacatatacctctggggataaaaaactgtatgttgaagaaaagaattttgataaaatagcagaaatcctgcataagaatctttctatagacaaaaaagatgcactgaatattttagaggacggcgcaaaaaaagagctgtatcaagttgaatttggtagctatgggaaaaatatctcccaagaaaccaagcaaaacatcgaagcggacatgaaaaaagaaggtgtcgctggtctttattttgtcgaccatcaggctcggatgtatccaaatggcgtcttttcttctcattttattggatacgcagttccagacaaagatgagaatggcttagttggtaaactaggtttggagtctgcttacaatgatatcttgagcggtaaagatggtaagattatttatcaaaaagataattttcaaaatcctctgccaggtacagtggcagaagaagaaaaagctgtcgacggacaagatatctacacgactttagacagcagactacaaagttatttagaaacactgatggatcaagtaaatgaagaatatcagccagaagaattgacagcagtcctgatgaaagcaaaaaccggagaaatcttggcaatgggacaacgacctactttcaatcctgaaacaatggaaggattgactggaaaagatgctatctggcgtaatttcttggtacaagatagttatgaaccaggatcaaccatgaaagttttcactactgcagctgctatcgaagaaggagaattcaacgagaatgaaaccttccaatctggaaaaatccaagtagaagatgctacgatcaatgaccatgactttggtgaaaaaggtgtgctgaccatgcgtcaagctctttcatggtcaagtaacgtcgggatggtcatactggaacagcgattaggcggacgatggtataactatttacaaaaactgggatttggacaaagtactcattctggattagatgatgaagtaaacggtgctttacctacatcaaatattgtcgaccgagcaatgagtgcttatggacaagcggtaggtgtgacgaatttccaaatgatgaaagctttcacttctattgcgaataacggtacaatgattcaacctcgatatatcagcaaagtggtggatccccaaactggagaagagcgaacaactcaaacagaagttctagggcaacctttttcaaaagaaacaacagaaaaagtccgtgaatatatgagagatgttgtcgaaagcgaaaactacggtagtgcttatggtgtatatagtgtacctggatacaatgtatcggcaaaaaccggaacagcccaaatcgcttctgatacagggggatatcaaacaggagatacagcctacctgtattcgattgtggagatggttccttctgaagatccagactatgtcttgtatctaacaatgaaacaccctaagacatatgatcgaatggcattggctaaaatcgcaaatccattgatgaaacgggcaatggattttaaagaaactgaagaagattcagatacagaaacaaaaacagaaaaagtatccgtagccgattatcgtaatcttgaagcggacgttgcagcagctgatgctcaaaaaagtggactgcaacctgtagtgatcggtaatggtaaaaaagtacaaaaacaatctactgccaacggtgatcagttgatctctggagaaaaactgatcctatatactggtggtgataagctgatgcctgacgtaacaggatggtcaaaagcagatatcatgaagctggggaaaatcctcggtattgaagttagttttgatggagatggttattgtgtcaaacaagaacttgctccatatgaaaaaatcactgaagacaaacttagttttactttagaagaataagaagagaaataggagagaaaagagcatggaatggacacaagcattgattcccattgtcagcagttgtgcaatgacaattgccgcaatgccgctatttattggttattttcaaatgaaaaagcaaggtcaggcgattcgtgaggagggaccaaagtggcacaatagcaaagccggaactcctacaatgggcggcttagtgtttctgatcggctctattttgacaggaatttgggttggagcttggcaaaaacagctaactcctactcttttcatcttgctttttgtattagcgttatacggagtaatcggctttcttgatgattttataaaaatattcaagaaaagaaacatgggactgaactcgaagcagaaattgattggacagattctagggggaatcatcttttatcttgtttaccgttctgaaggttatccaggtgtattgaatttcttcggactagatctacctttaggaatcatttatggtattttcgctctcttctggcttgttggattttcaaatgcagtaaatctgacagatggcatcgatggattagttgctggcttaggaagtatctcttttgcagcttacggtctaattgcttggcatcagcatcagtatgatgtattaatcatttgcttaagtgttttaggaggtttactgggtttcttcgtctacaacagaaaacctgccaagatttttatgggagatgtcggttcattagcgttgggcggacttttagcggcaatttctataatgctaaaccaagaatggacattgcttttgattggtttgatctatgttatggaaacagcaagtgtgatgcttcaagttacttcctttaagcttacaggaaaacgaatttttaaaatgtctccaattcatcatcactttgaaatgtgcggatggtcggagtggaagattgatacagttttttggttgatcagcattgtgacttcgttgatcacattatggatcgtttggtaggagatgacgggaaatgaaaaaaatatcaacatatgaaaataagaaagtgcttgtcttaggactcgcaaaaagcggagtaagtgcggccaaattattacatgaattgggcgcacttgtcaccgttaatgatggaaaaccttttgacgaaaatccggaagcacaagagctgctttctttagggataaaagtaataacaggtagtcatccaatcgaattgttggatgaagaattttcattgatggtcaaaaatccagggattccctacagtcatcctttagtagcaaaagcccaagaaatgggtattccggtaattacggaagttgagctagcttacgaagtagcggaatgcccaattattgggattacaggaacgaacggaaaaacaacgacaacaacgatgacaggactactactgaatgcaggagcagatcaaggaattgcacgtttagcgggtaatattgggtatccagcaagtggtgtagcgcaagaagcaaaatcagaagataaaattgtgatggaattgtctagcttccaactcatgggaatcacagatttccgccctcatatagcggtgattaccaatatctatgaagcacatattgattatcatggtacaagaaaagaatatgtcaaagctaaatggaaccttcaaaaaaacatgacagaaaaagattatctgatccttaactggaatcagtcagaactacaagaattagcgcaaagaacaaaagcacgcgtactgcctttctcgacaaaagaagtgttggaagacggtgtgtatgctgacgattactcaatatactataaaaaagaaaaaataatggaaatatctgaacttggcgtaccaggtaagcataatgtagaaaatgcactagctgctatttctgtagcaaaattgtatggtatatcaaatgaagctatacgagaaacgttgcattttttccatggcgtaccacatcgtacgcaatatgtaggagaaatccaaggcagaaaattttataatgattcaaaagcaaccaatattttagcgactaaaatggctctaagtggatttgaaacgtctaaggtcgtgttattggctggcggattagacagaggaaatacatttgatgaattaattccttcattaaaaggaatcaaagcaatggtcgtatttggccaaacaaaagaaaagttgatggatgctggaaaaaaagcaggcatcgagacaatagtaacagccgattctgtagaacaagcagttcctttagcattagaaaacagtacagatggtgatgtagttttattatcaccagcgaatgccagctgggatcaatacccaaattttgaaactagaggaaacagattcatggaagctgtgaaccgattaaaatagaaaaagtagaagcgagcgataaaaaatgaaaattttggttacaggcggaggaacagggggacatatttatccagctcttgcctttgtcaattatgtaaagactcaagaaccgaatgctgaattcatgtatgtgggagcaaaacgaggtctagaaaacaaaatcgtccctgatacaggaatgcctttccataccttggagattcaaggatttaaacgaaaaatttccatgcataacatcaagacggtccgattgtttcttaagagtatccgtcaagcaaaaaaaatcctcagtgattttcaaccagatatcgttatcggtactggaggatatgtttccggagcggtagtgtacgctgcagccaaaatgggtattccaacagttatccatgaacaaaacagtgtaccaggtgttaccaataaatttttaagccgatatgtggatcggatcgctctttcatttaaagatgcggcttccttttttcctgaaaacaaagcagttcttgtaggtaatcctcgagcacaagaagtagcagatactaaaaaatcagatattttgaaaacatttgatttggatccagaaaagaaaacagtcttgatttttggcggtagtcaaggagcacttaaaatcaatcaagcagtatcagtttttttaagtgaatatattccttcttcttaccaagttttgtatgcttcaggagatagatattatgaagagatcctaaataaaataaatcctgaaatacaaaatattagtgtccagccttatatcaaaaatatggcagaggtcatggcttccagtgatctgctggtggggcgtgctggtgcaacttcgatcgcagaattcacagctctggggttaccggcagtgttggttcccagcccatatgttacgaatgatcatcagactaaaaatgcaatgagtcttgttcacgcaggagcagcaaaaatgattgcagataatgaactaacaggtgaatcactaagtcagacagtcaacgaaatcatgggtgatgaagaattgcaaaagcaaatgtgccgagcttctaaagaacaaggaatccctgatgcttcaaaacgtctttatgacttagtaaaacaaataatcaaaaaataaaggcggtggtcttagtgagtaagaaaaaagaaccaaaaaaattgtctcatccgtcttctgatgaaaacaatttgactccttggcaaaaggctaaccgaaaatatctggcagaacaagagatgaaaaaccaagagccaaaaaaagaagacataacattagatacacccctttcagattctgaagaagaaaaaacggttcaagaggaacagcaagaagaaagccagtccgagaaaaaaatcgaattttttgaagagatcaagcaaaagaaaaacggtggaccatataacggttcttttttgaaccggctgcccaatttaaaaagtcaacggcacaaagtactatttcgtcggttagctttgatcatcactgtattgggtataccgctgatttttttgatctattatgtttctccttatagcaaattacaagcagttgcagtatcaggcaataagacagtcaacagccaagaaatcatctctgatacaaaattgtcattaggagaaaatgtttggggacagtattttcatcgatctacttatatcgatcgccttaaaaaagcacagccaagaatcgaaacagcaaatatacatttcaaagggatgaatgaattcgatttggatgtaacagaatataaagagattgctttgatcgcaaaaaacaatcaatactacccagtgattgaaaatggaacagtattagatgaaaaagtagcaaatcctacaaaaaatctccctatcttggaagagttcaaagactctgcaaaaatcaaagaattaacaaagcaatacaatcagttatcatcagaattacaaaaagcaatttctgaaatcaagtacacgccaagagcaagcaataaaaatctgatccaattgaatatgaatgacggcaatcaagttattgtaaatatcaataatcttgcgaaccaaatgaaatattattcgcaagtagccaaagatatggatgaaaaaggtgtgatcgacatggaagttggtatcttctcgcatccttacggtagcactcaagaaacggaagaatcgggccaatcggaagaaacaactgaaagtgaagaaaatgcggatcaaacaaacgaatcaagtgaagaggcagaaacgcaaaaagcacaaacacctggatcgtctagcacaaacggatcatctgattcaaatgattcaagtgaaacaagtcaaatagaagataatccaagtacaactccgtcaagtttaaatgaaaattgataaaacaactttaaaaagtaagaatgtactttctaaaaaccagtaatttatggtagaattggaagcagtgaatatatctattaataagtatattttaaaacggacgctagttgttcgcttgtatatggaatagtaagtaggagggaatcccattcatggcaaaaacaggaatgtatgtaggccttgatattggaacgacatctgttaaagttgtcgtggctgaatatatcgacagccaaatgaatattattggagtaggaaacgcaaaatcagaagggattaaccgaggcattatcgttgatatcgataaaacggtccaagcgatacaacgagcagtacgacaagcagaagaaaaagcaggtatccagatcaaaggcgtaagtgtcggtttgccagcaaacatgcttgaagtagaaaattgccagggaatgattgcagttaacggagattcaaaggaaatcaccgatgaagatgtcagaaatgtggcttcagctgcccttgttcgttcaatacctcctgaacgtcaaatcgtgtcaatattgccacaagattttactgtcgatgggttcgagggaatcaaagatcctcgtggaatgatcggcgtaagattagaaatgtacggtctgttgtttacaggacctaaaacgatcatccataacatacgtaaatgcgtggaaaatgccggattaatcgtcaacgaaatggtgattactcctttagcgctgactgaatcaattctttctgacggagaaaaagattttggtacgatcgtcattgatatgggtggcggccaaacaacaacggctgttatgcatgataagcaattgaagtttaccaatcttgaccaagaaggtggcgaatttgtcactaaagatatctctattgtattaaatacgtcatttaacaatgcagaagcgttgaaaataaactacggggatgcatacccagaacggacatcaccagatgaagaatttccagtagatgtgattggtcagtcagaaccagtgaaagtcgatgaacgctacttgtcagaaattatttcagctcgaatggaacagattttcaacaaagcaaaagatgcattggaccaaatcgaagcattagagttgccaggtggcgtcgtattgacaggcggagctgctagtcttcctggtgttgtggacttggcacaagaaatcttcggcgtaaatgtaaaattgtatgttccaaatcacatggggctgagaaacccggtatttacaaatgtaataagtatcgtggattattcagcaaacttgagtgaagtgtatcaattggcaaaaattgctgttacgggtgaaacctcagcagctcgtcaaatggtagttgaacaagaaacaacaaacacatatgagagctatgaagcacctgaagaaacaatctacgatgagccggaaccaaaagagtccggagaaaatgtaaaaaataaaatcaagggtttctttacaaatatttttgattaattcatcctgggaggaataagatatggaattctcaattgataataatatcaatgacggcgcagtaatcaaagtcatcggagtcggtggtggcggtggaaatgctgtaaaccgaatgattgaagaaaacgttaaaggtgttgaattcattacagccaacacagacgtgcaagcattaaaaaattcaaaagctgaaacagttatccaattaggccccaaatatactcgtggtttaggtgctggttctcagccagaagttggacaaaaagcggcagaagaaagtgaacaatccttacgcgaagctttagacggtgcagatatgattttcatcactgcaggaatgggtggaggaaccggtacaggtgctgcaccaatcgttgcaggtatcgcgaaagaattgggcgcattgactgttggtgtcgtgacacgtccattcacttttgaaggaccgaaacgtggccgttttgctgcagaaggtatcgctcgtttgaaagaaaatgtggatacattattaattatctcaaataaccgtttattagaagttgtagataaaaagacaccgatgcttgaagctttccgtgaagcagataatgttttacgacaaggtgtacaaggtatctctgatttgatcacagcgccaggttacgttaaccttgactttgctgacgtgaaaacagtgatggaaaaccaaggtacagcattgatggggatcggtgtggctagtggagaagatcgcgtagtagaagcaacgaaaaaagcaatctcctctccattgcttgaaacatctattgatggagctgaacaagtacttcttaacatcacaggcggtttggatatgacattgttcgaagcacaagatgcttcagatatcgtagcaaatgcagcaactggcgatgtaaatatcattctaggtacatctatcaatgaagaaatgggcgatgaaatccgtgtgacggtcatcgcaacaggtatcgatgaatcaaaaaaggaacgcaagtctagccgaccagctagacaagcacaaatgcaatcacctgctcaaaagactgtattagatatggatcaagctaaaccaacttcttcagaagaagaaaacagttttggcgattgggatatcagacgtgaacaaaatgttcgtcctagagttgatgattccaattttgacaatatcgaaaaaaaagaatttgatacattcaaccgcgaagaaacaaaatctcatggcgatgatgaattaaatacgccaccgtttttccgtcgtaaaaaataaaggagaggaagagcacatgattgctgacaacttgcagaaaatcaagcaagaaattcaggattcgtgtgctcttgttcatcgtgatccgaaagaagttacattagtagctgtaacaaaatctgttgaatccgctcaagctgaagaattggttagagctggcgttatgaattgtgcagaaaaccgagtagataaattattagaaaagaaacaagatttatttgattttcctgaaataaagtggcatttaattggtaatttacagcgcagaaaggtaaaattgattgtaaatgaaattgattactttcatgcgttggacagtttaagattagcagaagaaatccagaagcggttagagaaagaattatcctgttttattgaagtaaatgtttctggtgaggaatcaaaacatggaatttcaccagatgagcttttaccgtttgtggaatctttagctgcctgcacaaaaatcaaggttgttgggttgatgactatggcgcctaaagaagcttctgatgagcaaatccataaagtgtttggtacgctgaaagaattgcgtgatcttgttcaagcaaaaggttatgcccatgcaccatgtagtgaattaagtatggggatgagtcaagactttcaaattgcgattgaagaaggtgcaacatttatccgtgtaggaacagcgctattcaaagacgaataaaggaggaacaaaaatgccgcttttaaacagaggagcaattgctaattttttcggattagctgatgaggaagagtacgaataccaagattatcctgaaacaacaaaaaaggctgtacagccaactaaaaaaaatacaacacagaatcaatcaactcattctgtatctgctgcgaatactcatgaaaaacaaaaaacggcgacttcacgtcctgtaacgcatgaaagtattcagccggctgaaaagaaaaaagtaattgaactacatcaatcacctacaaaaactgtagcgaaagaaagaacagcttcaagaacctctacacaacctaaagcaaatcttgctggaaaaatcactgtaatggaaccaagagcttattctgaagctatggcgattgctaaacgaatcattgctggagaagcaaccttagtgaattttcatttagtagaagaaaaacaagcgagaagaatcgttgattttctaacaggaacagtttatgcactagatggagatatcaaacgtgttggagatgagatttttctttgtacaccgactgggatggagattgacagttcaaccgctcaatcttttgcagatgcgaatttgtttgatctgtaagaggaggaactacgatttatactattgcactattacttcatttacttcaacgggcagcctatttctatagcattatcttgatggtatatgcattgctctcttggtttccaggcgggtatcaatcagggctaggacgattattagctaagatctgcgaaccgtatatcagtttgttcgatcgtctgcctttgaggattggacccttggatttcacaattttaggggcaatcctgatcttgaacttagccgtacaaggtttagcacagatcgttatatggataactgtccatttagtttattgattgaagcaacaaaatctttattctcagaatagataggaggggaaaattttggatgcaaatgtataccagcactttcgggcagatgaacgtacatttatcgattcggtaggcgattggattgaacaggttcaaggacaatatgcaccctatctgaccgaatttcttgacccaagacaatcctatattttagaaacactgattcgacaaagcagtgatttgcgtttcatgttttatggcggatatgaacaggcagaaagaaaaagatgtttgattttccccgattattacgaacctgtagaggaagattttgaaacagcattgtatgaaatccattatcctagcaaatttgccagcctaagtcatgggaaaatccttggaactttagtgggaacggggatcaaacgctcttactttggcgatatcatctcggacggtgatcgctggcaagtatttattgcaaatgaggtggatcattttgttgctgcacaagtaacaaagattggaaaggttgctgtacgcttggaaccaatcaaatacacagaaatgattatgccgaaagatagctggacacaagaaagaggaacagttagttccatgcgactagacagtgtgatctctgagatttataatatttccagacagcggtccaagcagctgatcgaagctggtaaagtaaaagtgaactggacagaaaatacaagacctgattttgtacttgaactattagatattatttcagtcagaggttatggcagagtccagatccaagaacttgaggggaagacgaaaaaagaaaagtacagggtactgttcggtgtattacgtaaataaaataaaaaggtggtttactcatggctttaactccattagatatccaaaataagacattcccgacaaaaatgcggggatataatcaagacgaagtagatgatttcttagatttagttgttcgtgactatgaggaattgactcaaagaaatcgagaattagaaaaagcagtcaaacattctgaagaaaaacttgagtacttcaatgaattaaaagatgctttgaaccaatcaatcatcgtagctcaagatacggctgataaagtaaaaacaagtgcaagcaaggaatccgaagtgatcgttacttctgcacaaaacaaagcagatgagttagttgcgaacgctgaaaaacgtgcacatcaattaacaactgatgcagaagaaaaagcaagaaaaatcttgacagatgcaacagaaaaagcaagacagcttgcgacagaaactgaagatcttaagaaaaaaacacgagtattccatcaacgtatcagcttgatgcttgagtctcaattagaacaagtgaaaagtccggaatgggatgaaattttacaaccattctccagctacgtgactgacagccatgaagtgatcaaagaagttttagcaaaacagcttgacaatgaaaatgatactgatgtaaactcagacacaggagtcatagaagcacctatgacggcatttgatacacaggctattgatatctcgatcgtgcctggtgaaaatgaaaacgagtagaacagaaaagcactttgttattcttaaagcgagccgatgagagtggaagttcggtaagacactgcatggtgaaagatcctctacttgagacctgcttttccgaaattagagtaagaagcagcggctgacctcgttattggtcacagagagtttgcactagatagatgcaactaaatttgggtggtaccacggcatgttcgtcccttgcggctgaacatgcttttttgtgtccggaaaacaaataaaggagtgtatggttgaatgaaaatgaaagaaaccttgcaattaggaaaaacaaaattccctatgcgtggtaatttgccaaaccgagaaggcgagtggcaaaaagaatgggaagaaaatcgaatctaccaaaaaagacaagagttgaacgaaggaaaacctagctttgttcttcatgatggacctccatatgccaatggtaatatccatttaggacattcattgaataaaatcagtaaagacattatcattcgttcaaaatcaatgtctggctatcgtgcaccatatgttccaggatgggatacacatggattgccgattgaacaagtattggctaataaaggcgtgaaacgtaaagaaatgtccatggcagaatacttggaaaaatgtcgtgaatatgcactttcccaagtagataagcaacgagcagatttcaaacgcctaggagttgcaggagattgggaacatccttatgttacattagatccttcttatgaagctgcacaagtacgcgtatttggtaaaatggctgaaaaaggctatatttacaaaggattgaaaccaatttactggtctccgtcaagtgagtcttctttagcggaagctgaaattgaatataaagatgtaaaatctccatctatttttgtagctttcaatgtcaaagacggcaaagatattcttgatgaagatacagcttttgtcatttggacgacaacaccatggacattgccagcaaaccaaggtattgctgtaaatccaaaatttacgtatgtattggtggaagccgatggccgtaagtttgtcgtagcgaaagatttgctagaaacagtccaatcagaaatcggttgggaaaatgtaacagttctaaaagaatttgctggacaagaaatggaatatatgactgcaagtcatccattctatgaacgtgaatcacttgtgattttaggcgatcatgttactttagacgctggtactggattagtccatactgctccaggacatggggaagatgactatatcgctggtagcaaatataaactatctgtagtgtcacctgtagactcaaaaggattgtttacagaagaagcacctggatttgaaggtatcttttatgacaaagcaaatcctatgatcactgatctattaaaagaaaaaggagctttgctgaagctagatttctttactcatagttatcctcacgattggcggacgaaaaagcctgtgatctatcgggcaactccacaatggtttgcatctatcgataaattccgtcagaatattttggatgaagtagaaaaagtagagtgggttatcccatggggtaaaacacgtttgtataatatgatccgtgaccgcggcgattgggtaatttcccgtcagcgtgcatggggagtaccacttccgattttctatgctgaaaatggagaagcaatcatcacaccagaaacaatcgaacatgtggcaaaattatttgctgaacatggatcaattatctggtttgaaaaagaagcgaaagaacttcttcctgaaggatttacccacccaggttctcctaatggcgaatttacaaaagaaaaagatatcatggatgtctggtttgattctggttcttctcatgaagctgttttacgtcagcgaccagaattatcattcccagcagatatgtatttagaaggatcagaccaatatcgtggctggttcaactcaagtatcacgactagtgtggctatcaatggtgtagcaccatacaaatcagttatttctcaaggatttgctttagatggtgaaggccgtaagatgagtaaatctttaggaaacatcattgcaccagaaaaagtgatcaaacaatttggtgcagatatccttcgcttatgggtatctagtgtagattatgaagcagatgttcgtgtttctatggatatcttaagtcaagtggcagaagtatatcgtaaaatcagaaatacgatgcgtttcttattagcgaatacagaagatttcgatcctaaaaaagatactgtttcgtacaatgatttacgttctgtagacaaatatatgaccgttcgattgaaccaagtaatcaaagaaatccgagaagaagggtacgacaaatataacttcatgcatatttaccgtacagttatgaacttcttgacggttgatctatcgtcattctacctggattttgctaaagatgtagtttatattgaagcagaagatgattatcaacgtcgttgcatgcaaactgttttctatcaaacagctgtagctttgacaaaattattgactcctatcattccgcatacagcagaagaaatctggtcattcctgaaagaagaagaggagtacgttcagttaagcgagtttcctggttatgaagagtttgcaaaccaagaagaattgatggatacctggactgctttcatggacttccgtgataatgtcttaaaagcattggaagaagcaagaaacagcaaattgattggtaaatctttggaagcaaaactaactgtttatccaaaacaacaagttcgtgaaatgttaaaagctttggatgcagatattgcacaattattgatcgtttcaccagactactttgaagttatggcagcagatgaacaagtgccagataacgctatggtatttgatgatgttgctattacagtggaaaaagcagacggggaaacttgcgatcgctgtcgccaagttcgtaaagatgtaggagtagatgaaaaacttcctcatctatgcggtcgttgtgcaaaaatcgttgaagacttctatcctgaagctgtagctgaaggattcgaagaaaagtaaaagggaaaagggggtgtgacatgttctttgtcacacccccttttgttatcaatcgtttaattttccacgttcacgataccagttatctggttgccagatccattcgaatccgtctttttcaagtagttcgaaagctgctttaggtcccattgatccagctttgtagttgggaaaatccggttgtgtttggtcccaagcttttcgaatgacatccacgatatgccaagattgagcgacttcttcccaatgagagaagttcgttccatcaccattcaacgcatctaatagtaatttttcgtaagcttctgggctattttcaaccatttctgcactatttctaaattccaatttgattggttccgtttcaaatccttgccctacttctttcccattcaaggataaagaaaatccttcagttggctgaatatagatcgttagaacattaggtggaagtgtcgtatcgtcacatggttcatcgacagatgttttgaatacattaacaggaacttgtttgaatacgatgttgatccgagtccctttttcagtcaaacgtttgcctgtacgtacatagaaaggaacacctgaccaacggaagttatcgatagtgaatttgcctgcgacgaatgtttcagtctctgattgagcatccactttgtcttcttcgcgatagcccttgaattgtacaccatccaattcaccttgagcatattgcccgcgaacgaagttttctaacacttcttcttcgttataaatgcggatagctttcaatgctttgatcttttctgtacggatttctttttcggaaaatgctactggcggttccattgcaagtaatgctacaacctgtaaaatatgattttgcaccatgtctttaagtgcgccactatgatcgtagtagcccccgcgatcttctacaccgaggttttcgccaaaagtaatttggatattgtcgatatagcgattgttccattgagcctcaaaaatattattggcaaaacggatagctgagatgttttggatcatttcttttcctaaataatgatcaatcctgaaaatatcttgttctgggaatacttctctgatttgctggttcaattcaaaagcagactggtaatcagaaccgaacggtttttctatgatcaaacgattgaagccattttttgtcataatattttgtgatttcaaatgagaaacgatcgttccaaaaaattgaggtgccatagccaaataatagacacggttaccgtttaattgatagtgtccatctaatcggtcagacaattcttttaatgtctgataatgcgttgaatcatttacatcatgggattgatagtaaaaatggcttgcaaaggtagttgcttcttcatctgaaggattcaatgcacggattgtttctttgacaacttcacggtagtgctcatcgctccagggacggcgagcggttccgattacagcaaaatgctcgcctaaatttccttttctgtaaaggcggaacaaagacgggtacaatttacgctgggctaggtcacctgtaccgccgaatatcgtaaacaatacatttttttcattagacatgtggatacactcctttatattttatcgacaaaaatcgtgctggccgccttaaagctgacggggattttctttctatcattttggatagtgatcggtccttcataagctgcgatgtcaacgatctcatattcttcgttgatattcaggtcaatagtgactaagtaatccaacaattctttttcatcaagcactcgtgcgatacgcacttttgtaccgacaggataggactccaatgtttgtcggcgttcttcatggacaacttcctcttttttaggaatcgatcctccatgaggacaatgttcaggatgattcaaatagttttctaaatgatctgcaagatgttccgaagtcacatgttccaatacttcagcatcatcatggacttcattccagctatagtctaaatgttcaactaaaaaaacttcccataagcgatgtttgcgaatcagactgctagctttttgcagtccgcttgcagtcaattgtacaccttgataaggggaatgttctacaagctcttctttcacaagtttagaaatcatttcactgacagatgcagctgagacatctagactagatacgatttgtttattgttgactttcgttgtatctccacctagttctaaaatgattttcaaataatcttctcgatttggtgtcatattcgatcatcctttcatggtaaaaaaccatcattagtaagtgtaacaaaaaaaacgttaattgactatttttctaaataaaaaacaaaggatttttagacgtttttacaacaaaaaacgaaagatgatagagaagactcattctttcgtttataaaggatatatatatacattgggagggatctatttttcagataacaacttatatgaagtgtctgcagattcgtcataaagagtttgttcgggataagaaaagataagataaaaaccatactgatcacgtacgactaaacgatattcatctatttctaccacagatgtgccaagagactgaccgttgatcaaaaacgtgtaatcagatgtaatctgtaattgttgtttttgctggctatcactaaagaaccatgtaccttgatactttgagagtccttctgacttttccgcttgttttttctttttcaagtaaataaaacttgagagaacggtaatgagtgaaccaagaaaatagatcattttttttatcaccaaatcactcctttatgagaaaataatcgcatagacatattctttcttctttatttcattgtaccgaataaaagctaaaatttctctaagactttcgactggtttttttactgtttttctacaaattatgataggatacatagtaggaagaaaggtgacataatttgaagtatcagcaagtggaaatagctttttttattgaccgcccgaatcggtttatagcacattgtatgaaaaaagacggagaaataattattgcgcatgtcaaaaatacaggtagaggaaaagaggtcctgataccaggcgctgaagtggctattgtatttgctcctggacctaaacggaaaaccgcctatgatctgattgctgtaaaaaagaagggtgactggtttaatatcgatagtcaattgcctaatcggctggcaattgatggtattttagacggcacgatccttttaccaggattaactggtccatttacggtatacaagcgtgaagtaacttatcttcactccaaatttgatatttatttagagacggtggtcggacaaaaagcatttgttgaagtcaaaggtatgacacttgaaaataaagcgattggtgcttttcctgatgcgcccacactcagaggattgaaacatataggagaattaacgtatgccgcacaagatggttatgccgcttatgtcttgtttattgctcagttcgaacatcttcatctggcaacgatccatgaagaaatgcaaccagcactagctgatatggttcgacatgcgcagcaaagcggagttcaaatcctcgcctataattgtcaagtatcggcagatgaggtaactgtcaagcaggccattccatttgatgtagatatcccttttgaagatcctatacaatagaaagaaggtaaaataatgatcaacttaggtattatcggaacaaattggattactcatcaatttgtccaagcagctttaagcacaaaaaaatatgaattgacagcggtatattctagacatttggaaaaagcacaggaatttggttctcattatgaaggggatatcgaattcgcaacagatttgaagacttttttcaatattactcatatggacaccatttatattgcttctccgaatagtcttcactttagtcaagctaagcaagcaattttggcaggaaaaaatgtgatagttgaaaagccagctttttcgacgccaaaagaaatggatgaaatcatccatttggcaaatgaacacaatgtgtatttttttgaagcagcaagaaatatccatgaatcaggttttaaaaagattgccgattacttaccattaaaagacgagataatcggtgcaaatttcagctatatgaaatattcttcgcgctatgaccaagtattagatggagaagaaccgaatatcttctcgactcatttctcaggtggtgcattgatggatttaggtgtttaccttgtatatgcagctgttgcttggtttggaatgccaaaagaagtccattatttcccaagaaagatttctactggtgtagatggtcttggatgggggatcttacgttatgagaattttgatgtatcgatccagccaggtaaaatcggtgattcttatttaccgtcagagatttattttgactcaggaacgctagtgatgaatggagtcaatgcaattgaacaagcacaatttcatgatcgcgcgcataaagaaatcattgatttggcggtaacagctgcagaaaatccaatggcagatgaagcagaggattttgccaatgtcatggctcatccgaaagatccagcttggggattgttgtatgaagagtggatcgagctagctagaaatgtgaaccaagtgatttatgatttaagaaaaaatggcggcatcaaattcgatgcagataatgaggaagatttttaatgaacgaatttgtacaagtatttcccgaaaattggcagaaaaaatatgaggataaagggtttatctcaccttctcttattcaacgagcagtttttcagccactaagtaataaacaaagtatagtagcggtttctcctacaggttcaggtaaaacactggcttatctttggcctctactactaaacgtggaaccaggtgaagcaagtgcgttggtcatttttgcttcttctcaagaactagctattcaagtagcagatgttgcacgtgaatggggaaaagacaaagagttgaaagtccaatctttggtgggcggagccaacgtcaaacgtcagattgagggtttgaaggaaaaaccagaaatcttgattggtacaccaggaagaatattggaattgatgaaagcaaaaaaaataaaagcacatcaagtgaaaacaatggtatttgatgaagcagaccagctatttgacgctgggaacagccaaatcattgatcaaattcttcatcaagctccaacagagtatcagctagcttttttttcagcgacagcagatcgttcccttgaaagcattgaaaaaatcactgggaaaacgtttgagacaattgacgtgacagcagaggacgattctcgaaaaggactgagacattactttttacgtgtaccgatacgaaagaaagatgactacttgagacgtctcacgcatatagaagattttcatggtctgattttctttaatcaactgactgaattaggcgtaatggaagaaaaattgctgtatagaggtgtaccggtaggaagtctggcctctgatcagaacaagctactccgaaaagcagcgctagaacaattcaaaaagaaaatggtcagagcacttttgaccacagatgtggcggctagaggtttagatattacaggtcttccttatgtagtgaatgcagaagttccgttaagtgaagaagcttatttgcatcgttcgggaagaactggtcgaatgggtaatgaaggaatagtaattacactcgtacaagataataatctaagagatttaaaacggcttttacgtccatcaaatataacacttgaagagatttttttatacggaggtaagctgcaaactgagcagccaaccaaagaagatgcagctcctgcagtaaataaaaagtatgcgaaaactttttctggaaaggagcagaacccagaatataacaaagaaaaaataagaaaaaaagttaaaaataaatcaaaaaaagagagaaataaaggagcaaggcgcaaataagcgcctttttatgctatgattatgaaaacgggaacaaaattggttgccagaggaggggttatgtgaaagaacgtcaagaagagatcttgcagctattgacagaaaaccaacaaggattgacagcaagtgatgtagctgagcgcttaactatcgatcgaagcaatgcaagccgatatttaagtgaactatacaaggcccatcatattgtaaaaaccgctggccgaccagtcgtttactctttgccaacggaaaagtcaaaatctgatgaagtgcatgtcgactcttctacgcaagtgacttttgaaacactcgttggagaaaatgattctttaaaagtcagcatacagcaggcaaaagctgcgattctttatccaccgcgggggttgcatacgattatttttggagaaactggtacagggaagtcgatgtttgctgaatgtatgtatcattttgcaatcgattcagagatgctttctgcagatgcgccatttgtttctttcaattgtgcggattatgctcaaaatccgcaactgctctttggacacatctttgggatcaaaaaaggggcttacacaggagcagctcaagatagtcccggtctaatagccaaagcagacggcggtatattgtttttagatgagatccaccgtttaccgccggaagggcaggaaatgctgtttactttcattgataaaggtatttaccgtccgcttggagaaagtgcacaagtacatgaagcatctgttcagatcattggggcgacgactgaatcttcagaaagtttcttatctacgttcaatcgacggattcctatggcaatcaccttgccgaatcttgcttcacgttcactggatgagcgttatgaaatcatctctctttttatcaaacaagaagcgaatcgtttgaatcaacgtatcgatatcgaaaaagaagcgattcttgccttcatgctttatgatgcggaaggaaatatcggtcaagtgaaacgagacttgaaactagtctgtgcaaaatcttttttacattaccgtactcatcatgagaaaaagctaatcattcgaaaagaagaactttcccttcaagtacaaaaaggattactgaaaatcaaggaaataccggaacgtctcgaccgattcatggacagcaaaagtcagtatttgacatttgaaccaggatttgctgatgttgtctggtcacaagatccagaacgaaacatgcaggtctataacgatattgaggaaaaagtcacttctctttccgaaaccggtgtggagaacattgatctagagaccctcatttcaaaagatgtggatgcttatttccagacatatgtcaaagaattgactaaaagttcgattcccaaagatcttttgccagatgaaatctggcggttaaccaatcaattgtatgatgtggctgaaaaacggttagaccgtatttataatgaaaaagctcgttttgcttttgctttgcatctgcaaagtacattggatcgtgtgagagaaggtcatatgatcgtccacccagatttgaataacgtacggaaaaattttaagagggaattccaggtagcaatcgatctttcaacgatcattgaagaagaagaacaagttgagattccttttgatgaaatcggctttattagtatgtttctttctatcaatctaggagaaagtgagcctgttaaagaaaacaaagtagatgttctcatattgatgcacggcagacagactgcttcaagcatgttggagatggcacaagaactattaggaacaaaagtagggaaagcttttaatatgccactggttatggaagttcaaacaatgtatgaagaagtgttacaatatgtcaaaaactatcaagagcatttgacgaatggcctactcttgttaacagatatgggatcattaaacaccttcagtgatttgatttatgaagagactggcattcggacgaaagctatcacgatgacaagtaccatgattgtgatagaagcgatacggatggcaagtgttggaagaagcttagaagatatttatcaaaatatccagctttcctttgaatcgatcgtacgtgatcagttcaaagcggaaaagtctgaaactttacagcgtaaaaaagccgtaatcgtgacatgctttactggtgaaggagtagctgccaaattatatcagcgtattatgccagtgattaatcaaaataaggtagaactgatccagatgcagtttttagaacgtgaatcattcaaaaaacacatcgatgccttattggaagaatatgagatcaaagcaattgcgggaacagttgatgttgattatcaaaatatcccatttttttcagcctatgacgtttttgatgatgaaaaactaaatattttaaagcgtatagctgatgatgagatcccgacagctaaaattgtcgattcacttgctggatcattaagcgatgtcttttctattgatgaactgatccgttcattgcaaaagacagttcagcagatccagaccgatttgtcgattatcgtggaacctggagtagatactggaatcgttatccatttagccttcatgttagacggattgatcaaacaagaaagccatcggcaatttgagaaactgtctattttctcaaaaatttatcgtttggaaatggatatcgttcgggcaaacttgatggcactagaacgaaaatatcaggtaaaaattccagaagatgatatcgcatttcttacacaaatgtttcttgaaaataaaataaaaaaatgaacacactaatcatactgtttacacactaaacatctgtgtgcgcactataaaaaagagctaaaaagcatgaaaacgctatttcagctcttttttttattggcatgcttcttgcgttatataaaagtgtaaaaaaataaaaggagtgttaaaaatggcaaaaaaaacaatcatgttagtttgttcagcagggatgagtacgagtttattggtcacaaaaatgcaaaaagcagcagaagaaaaagggatggaagccgatatttttgcggtctctgcctcagatgcagataataatttagaatctaagaatgtcgatgtattattattaggtcctcaagtacgtttcatgaaagctcaatttgaacaaaaacttgcgcctaaaggtattccattagatgtcatcaatatgcaagactatggcatgatgaacggagaaaaagttcttgcacaagcagaaaatctaatgaaataaatcaagtatgcagttgggggtataacaacgtggaagatcaacaaaatctagaagccatcatggggttaatcatgtttggcggtaatgcaaagagcgatgcaatggaagcgattgcggctgctaaaatcggtgattttgagttagcggataggaaaatcgctgatgcagaagaatcacttatacaagcgcatcatgcacaaacagacatgttgacacaagaagcacaaggaaatcatatgcaagtgacattattgactgttcacagtcaagatcacttaatgacatctattgcgtttactgatttagcaaaagaaatcatcgaactttatcgtcgcgtatacagcgaataaatacaacttcttttttgaacggaagaagaaaaatttttgaacggattttttattttgttataaggagaactctctttatataaaaaacttataggaggaagtaaaaaatgaacggactatcaagttggatggagaaatacatcctgccggttgccgcaaaaatcggagcgcaaaaacatttagttgctttgcgtgatgcttttatcggcacactgcccgcaacaatggcgggatcagtcgctgtaatgatcaatgcaattattcgtgatttaccgcaacagtttaacagtacctatgctgacagtttagcagcagacaaaggaatctttgccgtattgaatgtcatcatcggaatcaatggttttgtctggaacggtacactagcaatcgccggattgatctttgccttttcttgggggtataatcttgcccgagcttatggagtaaatgatctagctggggggatcgttggtttagctaccttgattcaaggtatttcctttggtccagcattatcagcagcattagatgtgaatgttccttcaaatgtcgcagatgcaatcaatagttctgagattggtgcaacgattgcagatggcacactgtcagttggattatggggttggctaaaactagatcatttgaatggaaacgcttattttacagttatgatcatgggagctatttcagtcattattttttgtaaattgatgcttgccaacattacgatcaaaatgcctgattcagtaccaccagcagtatctaaagcatttgcagccattttaccagcgacgatcgctttatacgtcattgctattatcaattatatcgtaggtcgtgtagctgatgggcaactgatcattgatttggtgcaaaaatatattgcagaaccattcctaggattatctcaagggttgggagcagtattgatcgtcacagtatttgttcaagtattctggttctttggtattcatggaccaaatgtattggcaccagtgctagagggaatctggggacaagcacaactaatcaatattgatattttccaaaaaggttataacggaaaaactggtacaccagccgtgttagatgcaatcgaagatggaaaagcttatatgtgggtccgcggatcgttcgatgcttttgcatggtttggcggatcaggcggaacgatcgtcttactgatagctatcttgattttctctaaacgtgcagattatctaacagtagctaaattatccattgggcctggtatcttcaatatcaacgaaccagtgatgtttggtctgccaatcgtattgaatgcaatcatgtttatcccattcttgattgctccagtagtagcaacagcaattggatggacagctacttatcttggcctagtcgctccggtatcgcagcaagtcacatgggtagtaccgccgttcttattgtcattcttagcaacaggagcggattggcgggcaccgatcgtaacattagtatgtatggtcgtgactttcttgatttgggcaccatttgtcatctctgcaaacaaaatggaccctgccgcaggcgaacaacaataagatgaacgtgaggagcgggacgctttaagtttcgttcctcataatgaattttcgaggaggaactgaaatgattacaattgccagtgcaatgcaacaagatgaaatcaaagaattgttagaaggatacaatgaagaaggaatgacttttacatttaaagaaaaacaaggaatcaagctgttctttgaaacaagtgcagaagatccggaagttgcggctaaaaaagcaaaggaactaatcaaagcacagccttggggaacagtcctttattttcaatcaacagctgtttagaaaatggtttaaaaagataggatggttgagatgataaaaaacggtttatttttatgtagtattggttctttgatcgtgttgtatagtttgaatccacattcgcaaaggtatgatttgtatagtatggtcacaggtctttttctaacaggattaggaatctatttcttcatgaaggggaaaaaaagagaagaagcaaaggagaaaaataactaatggaaatcacgaaaaaattaaatattccagcatcgtttttttacgataaagttatggactctgtccttttcgatgtacgtaaagcgaccggcaaatcagtaactagaaaacagctgaaaaatttggagtacgtcaaacaattctcgcaaaataaccgggctcgcataaaaatcgaagaagtcattgaaaaccagtcttataagtttcgtacatcgacaacgaagaatgaattcgtcgttcattatcaaatcaaaccattggacgattcgacctgtgaggttcattacacagaaaaaatggagtcttatggcatgcttcaaaagttgaatgatatgcttttaggaacaatcttgatgtattttaaacggagacgtttcaaaaaaatgctagatatgatcgaagcaacgtattaaatcaatgaaacatggtactatttagttattgaaaaatgaagtaagctagaaggaatttttcataggaagatagatctttcctgcgaatcctcactagcttttttgtaggaaggggcagcaaaatgacaaacaaagtaagagagctaggtgtatcttcgattgaggaaatgtttgatttagccacttatgcatttaatggggcagatacacctgaaaggcgagaacgttttcgtacacttgcggagaattcttggaattacggattttttgatgaggaggatcggctaacaagtcaagtcatggcgaccccttttccagtgaatttttacggacaagagtacctaatggccggcattggctatgttgcttcttatccagaagcaaggggacaaggcgggatcaatcagatcatggaaaagatccttgaagattgccgtgatcgtaaagtaagcttatcttatctggcgccattctcctatcccttctatcggcgctatggctatgaacaatcatttgataaaatcagttatcaactaaacagtcgtgatgtgccgtttatcaaaaaaaaatctggaaaaataaagcgtatggattttgaagatgcaaaagctgcaatcagaagaatttatgaacagatgccggaaaaccaacgagctggtctgaagcgcgaagactggtggtatacgtataaattcaagcaaaaaggcaattaccagtttgctttgcattttgatgataatgaggaagcaacgggatatatcgtttatcagcttgcaacgtcttcctttattattgcggagtggggatttttggatcatgatgctttttgcagccttgttcgcttcgtaagttctcacaatggtgcttttgaaacatttgaatattcatgcggctacggcggtaatgatcaaaattatctattagaaaatccatttgcttctgtaatgatcacaccttatatgatggcgaggatcgtagatatttctttgtttttggaaaattatccatttaaaaagagacaagctgcatttgccctacaaatagaagaagatcattatgcgaaatggaatgaaggaatcgtggaagtaacaatcgaaaatggaaaaaatcatctctcaaaagtagaacaaacaaaactcccaatcgttcgaggaagtatccaacatatcacgcagctattattagggtatcgtaaagtggaagagttggtattccaagaaagaatacaggtgacaaaagaatatgaagaaacgttaagctcaatcttgccacagcaacagccaattcttaatgactatttttgataaaaaacgggtgatgacaatatttttgtcaccacccttttgtttttcatttggcatttgaaggaaaatgttaaagtaaatcctcttttttcgtaaatttgaattttttgttttcttttgttttagggttttcttttttgtggtcttggattgcttctttcgtaatcttttcccgattttttttagatgaatctaagcgttctgcgtatactttttcttttggcttatcattcattggaaaggacctccctacattatttcattctacctctagtttatcatctgttaaggactagtggaaacgttttgcctaacttataagctgatttttttagcagataagcttgcaagtaaaaaacaaacaagctacaattgatttattgaaattgttcctgtagctcagtaggatagagcaatcgcctcctaagcgataggtcgctggttcaattccagtcaggaacgtataaataacccctgtatcctttgcggtacaggggtttgttttgtatttgtgccaaaaatgtgccaaactagttatcatttttatataaactatcgaacacagtattgattttttctttatcctgatcttcaagctctcgaacaatatgaagataagtagacattgtagtttctaaactgctatgtcctaaacgtttcgatacgctaagtatatttactccttgataaagtaaaatagatgcatgtgtatgccttagtccatgcaaagtaaattgcttttcaatccctaattcttttaattttttgcgcaaatatttgctgacggcgtttgatgaaactaatccattttttaagttgaaaaaaacaaaattatgagggtttttgatttcaaaattctcgaataattctttttgattgattttaaacttttttaagagatcaatcgtatgtttatcaatggaaattttcctatttgaagtttcgttttttgtttttccccattcatttaatttataattccatgttttattaatagtgatgatttgatcttcgaaatcgatatcttcccatgttaatcctagaagttcagcaaatcgcattccagtggcaccagcaactaacacgagcataggagaagagtactgcgcagaaaggttttcttctacgagtttcattaaagatttaaattgatcataatctaaatatttatcttcttttggcttcaatgaatcttttcctttgattactgcttttctagttggatcaaacggaattaatccttcttctacggcatctttcaacgacgctctaatatggttattaaacttaataacggtagattttacatggtctttagcatacttatttaaaaagcgttgatatcccactctatctaaatcagaaatcaataccgctggcatatatttctttatgttcattaacgtatcttcgtattttctataagtgataggagatactgttccttctttataaagttgcatccaatcctcaaagtaatctgataataatagatttttgcgatcccctttaaggcctttgttcaagttatattctaattcgttggcggcatcttttgcttctccttttgtcttaaatcctgattttcttatcttcgtgtattttccgtcatcttttttgtatgaaatttcgtattgccaactatttccacgtttgactaatcttgccatgattgaatcggctcactttctttgatacaatagacactataaagaagcctattatgtaggtttattttttttagaacacgctcttactctggacggtggggcgtgttttttatttattatacagttgctttaaaaatagctgctttttcaaatgatactaaaggagagaagtggatttctatttctcccttttggtttaacgtgaaatgagcagttacatccatttgttttcctggagcaacagatcccattgtattttcgttggcatatgtctctgattttttgtcatctggtccatatacttccacatctgtacctacagggatatctgaatcgccatcattttttacggtataagtaatttttactacttgtgcaggttggttttcttcaaattgatttctttcatcagttagttctacactatttagtgtatattcagcatcaccaacttttacagtgtcaccaatcttatagaaggtatcgcttttttcttctttagaagatgaagcagaggttgaagatttagttactttttcgccaccattatcacttgctttattactatctgatccaccatttaaagcagaaccaataattataattaaaattactgctaatacccaaaaccatacttttttgtaaaaaggtttactaactttatacatttttccgtcttgacccataactttttttgccatttaaatattcctcacttcttgttataatatatttgcgatctcagaaatgaggtatgagtccgtgtgccagcacgggcttttttaatgttttgctgaaatcggtttttttaataattcttgatgtattcatacatattgccttgcgtaagaatattttttcttaaaatagcattggcagacagcataacaagtgtatctgagcttattctgaatagaataatactccataaatttttcgagattaaactgagattcatcagtcagttcgttctcaatatagatatttaataaaattagaatagctattttatctgcttctgtttcaaattttgagtgaaaagttgtagaagtatcgtacaaaactgaatattcaaaatgagaagcggtgaaatgcgcaagttcatgagataaatgaaaggcttctgcagtttcgccatatagattttcattcaaaaaaatgattctaggcttcggataatagaagccaggctctttcatttccatgtaaactactttcaaattgtattcgctcaacatttctttcaatttcaaatacatacaacccatcactccaactattcattttcctctaaagctttagcaattgcaatcgctttacgcattgtctccttagatatttcttttccatcaaaagaaaaaacagtatcgttttctgataaatccacatgtttaggggtttctttttcttcgcgccccagaagatagtctacagagacatcgaaatagtcagcaatttcttgcaaacgttctgtagaggggtttgagttcttaagtctatataagacgtttttaccatagcctaggtcttcttcaactttatttaatgattttccctgttttttcgctaactcttttattctctcaaacgttatcatatcaatattcctttcgttcaagaaaaaatatttaactttatttgttaaaattcgttgactattttaacaaaaggtgttaatatcattcttgtaaacaagtttaacaactaaaaagacaacaaaaaacactattgattaataaatgccaaccgccaagaaagcttttaaaatcaatgtttatatgtcttatttaactatgttctgattttaacactgtatgttaatttagtcaacgcagttttttaaaaagttgttaaatttgtttacgaatataaaagaaaggagagaagaatatggaaaaaacagtctcggcaaaaatcgaagatttgaaattagacatactgaaacaagcaaaagtggcgatggaacacgcggtagataaagaagactctgccatggttgcagccatagcagagattttagctcacgtttagtcatcgtttttacggtcttctggaagctgaccatagataacagcataatgaatatctaaataagcttgagcaatttcttttggcgaaattgattcgcctttagtagatacttgtgattcgtgatttagccatgcaacaactaaatccgcagcgatttcaaacggcgttacactttgtgtcagttgccataaagaatttcacaatatgtatggtcgtggtaataataccaaagagcaatttgaggaatttatggaaattaaaaaatacaaaaaatcatttattaaaggaggctaaacaatgaacaaggaaatgagccaaacaatcaaggtacaaaaaatgatagatgatctaacacatggaattgatagccaagccgataaaatcatcaaggaattgcaaggacaaaaagttaaggatgcaaaaatgcttctcaagactatcaactttgaaatgaatccaacaaaaagaaagctcgccgatgtgttggaagaaaagttggcttccgctatcaacgagcaagaattactatttgaaaccgatacttttaacagctgatgttttatagatgacagtttcatccgaatctatatcatcgccgagagaaaagaatgttgcttttgacaaaaagccgataagacctacaagcggtcttgatgttgcaagagtagataccccaatatcaccttgcaaggtattcacgtaaatttgagaagaatagaacattccatctttttcttcgatatttgacgcatcatcgtatccaacgaccaaagtatcggcaaatattttgattttttctccatcaagcatagtaattacaaattctggtttcataaattttcacctccttaacaattatttcagcctgtcacactgataaggaaattataccaaagaaaggaatgagaaatatgaatacaccacaaatttttagttttgaacaacatgaagtaagaacgtttctagaaaatgacattccgtatttcgtagcaaacgatgttgccaaaactttgggatacaaaaatcccagtaaagccaccaatgatcattgtaaaaaatcaattgaaacatggggtaacgattcgttaggtcgtcgtcaaaaattcaaagttattccagaatcagatgtttaccgcttgattatcaaatcgaacttaccaagcgctgaaaaatttgaggcctgggtaatggaagaagtccttccaacaatcagaaaaacaggtagctattcaaacgtacctcaaagttttgcacaagcattgcgtttagcagcagatttagaagaaaagaaccaattactcgaacaacaaattgccgagtacgaaccaaagattagctacttagatacgattctttcatcgacagatacggtagctacttctcaaattgcagctgattacggaatgtcggcaattgctctaaacaaattgctaaacgagttaggtgttcagcataaagttagcggacaatggatactttaccgaaaacatatgaaccaaggatacacaaaatctcatacaactgagatcccgaaagccgatggtggcactaaaattgtaatgaataccaaatggacacagaaagggcgtctatttatctacgaattactaaaaaaagaaggatattaccctcaaatggatttagaggaaattggttagaaaggagttttagtatgactgacattgcagaaatcactcaacgagatagagaaaaaatcaaagaatatgtcgaaagttcaaagttcttaacttacaccatgcttgctgaaagatttggaattagcaaaagctacttatctttaattttaaacggtaaaaagacttctgcagaagcaaacagaattatagattcgattatcactatgtacgaattgtaaagggaggaacagctaatgcaatatctagaagcaaaaatcccaattccagaaggctatgtaattatctcccaagtggattatgaggagttaaaaaaagctgatgatactggtagatggatgacgttgccagaagtgctagaacggattaacagaaaatatgattggtttacttctagagttttaaagaacccaagatatagaaatattatcgatatcgagaaaaacaaaaatggatttgtctattatccagttgaaggaagagacacatatctatttttaagaagtaaaacacttgaatttttagaaacaaatttttcggaaatcttaaggaggcaagcggatgggaaaatttaatagagcgctagtgttcagcgcaccgctaatcatctacgctttaggactttggggaagcaggcaagcgttgataggaacgattgtttacatggtttggatttttatggggcttgatgaagctgaagctgagtacagagcgaaaaagccaaccgagggggctgactaaaaatgaatagaaaagagaaactagaatgtatattactattactcagtttaattctttcactaatttctctattgggaagtttgtatttttgatatcaacaattttgtggatttgggttctatttagagtaaatatcatttttgtttggtgattaaggagtttattaaaattaattttccctacttcaaatgcaaggtaacaagatatagcacttttaggaggaatatttagcggtacagcttcagagtatattctattatcatcgactgatcctcctttagcaattaatttcttaaatggagtagctgaccatctgcggtttaagttagcggatgaaagttctaaattaactaacatagctggttctgttgaatagttagaaatgattacttttgtataaatcatatctgcagcgaagtaagaagcattaagttcaacttctagttgagggcgcattccttttatttttatccctgttaaaaacgtactcaatataaaacttattattgacatccattgaaaaattgttaagtgaaaaaaattcaaaataaacaccaccagtttttaactaaattataccaaaaaggagagaagaaataatgcaagaattagtaattttgaaaaataaagaagctgtgactacgagcttacaagtggcagaaagcttcgagaaaaaacatcaacatgttttaagagatattgatgcactaaaaaaagatgtgtccaattttggacagatgtttgtagaaggtaatgaaccagattcatatggcagaaatcgacgagttttcttcattagtagagatggatttttcttgctggctatggggtttacaggaaagaaagctatctacttcaaacaaaaatacattgaagcattcaacgaaatggaagatgttattcgcaagaatactgttcctcaaacaattgaagatatgatgatctatcaattagaagaaatgaaagatgttaaaaaagatgtttccatgcttaaagatactatgcgaattagcggacaacaagagtttgaaattaagcaaaaaggaaatatgaaagttatgggagttctagggggaaaagaaagccgagcttatgaagaaatcagcaaaaaagtattctcaaaattttggtctgaatttaaacgtaccttttcaatcccaagatatggcgagttacctcgtaagagattcgatgatgctgtttcatttattgaaatgtggttgccagaaactgcgatccgtatggaaattgatcaactgaacagacaacagagactttttggtgatgacaatgaatagagctgaagcgctaagaatagggacggcaattgctaattgctggtggaaatactataaaccaatcatcctaagccaacaacatattgacaagcaaaaagcatggcaacaaataaaaaagtgactccgccggcaagcaaagagtcacaaagaaaacacatcataaggagattttagcatatggaaaaagaactttccactctagatcaatatttgattgatcctgattggggcaagccgaaaattgaggaaacaagtggtcgaaaaatcagacgaaatcttttgacgaatgaagaactagcttgggatcaagatgatttaggcaaccatgtaactatttgggatcatgtttatcttatccatctatcgaagcattcgaataaacctgaatatatttacgtcatcgaagatggcttgattgatgcgctagaagagtacgacagagataacttgattgatatctcttattacggaccaggtaagaaatacattgctgaaatggaggcagaatttgatgagtgaaatcaaagggacaacgaactttgaaaaactttttagtcgtaagttaaataaaattctcaagaaaaaaggaaattttgattatttatcttgggctcacgcgtgggagattatgaaaaagaatgatccacaggcaacggtaactattaatgagtacaaacactacagggttgtttctggaactcatcaagactttcttgttgaggaatataaaccttttcttatggatgaaactgggacttatgtatctgtctcagtaacggttaaaggacacacggaaaccgaattatttcctgttttagattatcgaaaccaaccagttgttaaaccaaatgcaatgcaaatcaataactcattgaagcgatgctttgtgaaagcattggctctacacggactgggattatatgtatttcaaggggaagatattccaacaccacctagaatcgatacaaagaaattaaacatgctagagacgattctagaagctttcaatgagcagatgggtaaagatatgaccaaaaccttaatcgaatatgttaatgagcagacagataaattagggctcttagctgataacgttgaaactattgaacagttaagctatgagcaatgtgccttgatggagcgagcaatagcagctaagagaaaagaattagataagaagtgatatgagtgtttaaaccattaatcgattcatattcagcggttctgaaaaagttcaaaggaaaagacataagcgcaaccatcaatgaggaagtgaacattgatcgactaaagacgatgtatgacggctacgatggtgatcgagtcattgaaattcgttttattgatcctagacgtttcaccgtacagcaacgaaacttcatctatgcgctgataggcgatatttttatcgatacaggcatgccaacggacttctggaaggaattcttctactttcgttttgaaggtgtcacagggcgcaaaataagcctgaaagacgaatcgaatacaactgtgagtgatgccaatgtcttagcaaatatcatcttagatttcatctttgaacatcatattcctttcaaagaaggctatgagattttacctgcgaatcaagaatattacttctacaaatgcatcacaaaaagagtctgctgcatctgtggcaaaacaggagctgacatcgatcactttgacaaagcgctaggaagacgaaagcgcaaagaagttgatcatgcagagtacacatttgcagcactctgcagaatccatcacacagagaagcacaaaataggtgtgattaatttcaaaaataaatatcaaatcaaagggatcaaattaaaccagaaaacaatcaaaaagttaaatattggagggtaaaaatgacagaacatcgaagttattatgcgattataccagccaacgtaaggtacgacaaaagacttaaaccaaatactaagttgttatacggagagataacggccttgtgtaatgaaagaggcttttgttgggcaggcaatgagtactttgcagatttatatggtgtgaataaagagaccatatcgcgatgggtaagtgatttgattaagtttggatacttgaatcgggaaatcatttacaaagagggtaccaatcaaataatcaataggtacctacgaattaatcaataccctattgacgaaaaacgcaatacccctattgacgaaaaagtcaaagataataatacatctattaataatacatttaataatacaaaagaatatataagagagttaccgccttcgaaaaaatcgaaggctaagcccgtccgtcataaatacggagagtataaaaatgttcttttgtcagatgagcagatggagaaactcaaaacagaattccctaatgattaccaagagcgaatcgaacgactgtcagagtattgtgaatcatctggtaagacttataaaaactatttggcaactattcgaagttgggcaaggaaagaaaaaagtgaacctaagaacgcaagcagtggatacaagcgcacaggaagacgagagaagcttcctgaatgggcaatcgaccaagaagcctatctcaagaaaaaagcgctagaacgagctaatagacaatcaaaagcaccattctaagaggtggaaaaatgaagatcgattatctagaactaattaatgaaatagcgaattataaaaagggcgaggaattagacgtcctgagagacgtatatgatcaactcgaagaagctggaattgaaggaattaagaatgatcgttcgagttggagtaagctcagatactatttcgcactttatatcgatacaacacaattaagaaatttagcatataccaaattactatttgttgattgtgttaaaggcttgcaaaaacatcttaatgaacttgagcaggtgtaatcagatggacctaaagacatttacagcacagattgaactaatgcatcaagaagctttaagacaaagtgtatcgtacgaagacaagtggctcaacacgttccacggcggacgtgagagcgcacttgatcaagtactcaaattactgaaaggagaatgtcgggatggataagaaagcggcaatgcagcgaattatcgaattgacttattcagaagattggcaaaatgacaaagaagctgcttcagaagtgatgaggcttggaagagcgatgtgggcagacaagagcaacaagccaagaccacgaaaaatcgcaatttggcacggtgacaaacttctagtgatagggacagctgaacagttagcaagtctcacaggcttgcacgagaaaatcgtgaggaaaagagcaaggtgtggctacacagacgctaagaagagaacgtttagatacgtggaggaatcatcatgacaacagaagaagtgattcaaatgcgtattcgaagccttcagcgtgagattgacgatctggaacgaacaaaggcagtgatggtcaatgaaacggcgagaaaggcaatcgatttgcacatagagaatttaagaagggaaatccatcgattggaggaatgagcgtggataagaaagcagcaatgaaaagaattgctgaattaaccaagtcagaatcttggcaagaagacaaagaaatagttgcagaagtccaaaagctcggtaaatcaatgtggactgaaaagcccaaacggagaacgccgagaaaaattgcaatctggcatgatgaccgaattttagtaacaggtactgctgaacagttatctgaaattactggattaagcaaaaacattatctgggatagagctaggagcttatggattgattcaaaaggacgacagtttaggtatgtggaggagagataatggatctcattacacaatacagtgacatcatcctcaagaaaatcatgatgaagattcagaaagataaaaaatcaaaagaacgagctgaattagttaagttagaaatggctgaaacaggagcaggagtgcgaagtagcaggcattggaaagcagcagcaaacattgaattttattacaacgaaattcaaaaagggttcgatcagatgcgtgagctggatcggcaaacaaattggagcaagaaacttcatcaagatcgtttcaaatttgtagagaagtataaagaaatattagaagagtatttgaggaggacagcaaatgataaaaaaactcgttcaattcagcatggatttatatgatatcgaatcaggagcaacactatctgtggaatcggaccatctaatcataaattttggtggaaagcgccagattattttgtgggtagttgatgatgtactgtttccagaaattgttcatgatttcgaagaatcaaaagcggttgagtttgaaatagtgaaaaaagtaatggaattgattgaaaaatacgaggaggacagcgaatgataccgaagtttagagcgtgggataaacgaaagaacgtaatgagagatgtagccgtcttgcattttactaaaaacggcaaaacaaactttattgaatattggataaatcctaccgaattgaaatcatatcacgtgcgaaacatcgacctcatgcaatccacaggaatgaaagataagaatggtgtggatatatttgaaggggatatagtattagtcagcgtgcgaaatggcttcgattacttagataataaagtctgtattgtcaaaaattcaatagattattccggattagtttgtgccactgttgatgaagacttagagtatcaaatttttaacacagagctgtttgaagaatacacgtacgaagtcaccggaaatatatacgagaatagcgagttattggaggaacagcgatgaataaacaggaagcaatcaaaaagttagaaagtattaaagcgataggaaatgatgcaatagctgcttgctataacgagagtataaattcaggtattacgttaatgaaaaaaatagacgaaccgcagaaaccagttattccacaactcgtggccggttggcttgagaaatctacggacccttttacaaaagctgaaaaaatagcgtatttaatcaaatctaaagatggtgattcatattatttctgtgattggtttgtacgagatggcatagtgacgcaagagcaaggagaagaattactcgcttgggcaacaagacaatcatatgaaacactattgagcctatacaacggctacgaggttgagaaagagccgttatgggcaataaagaatgccgatggaaactatcttactaaatgtgctttatggggaaaagatggagtaaattatagttttgaatgcaatccatctcatcgattgcttttcactgataaagcaacagcggatgctgcagcattgttggtgaatggaacagtggaagaggtggtagaaagatgaaactaaaagacggattttacgctagcagtcacggtatcggcggtttaatgctagatatgccgacaaagaaccctaaaacacgcaagaaatcaaaattcaaagtcggtgacatggtccgctgtgaagcagaagagttcgtttatccgttcagaggatacgttaaaaagatactgtcaaactcagcaatcattcgtattgaaaatacaatgaagtgtgatcgttcgactgcaaaacacaagcattatttagctgtagcgagattagttgacatggaagtaatcaagagcaaataaaaaaagccggatcgctccgactgattcaataaatccaacacatttattatatcacataaaggagcggtttgacttgatgcaattgttacgagaggtagatttcaaacagacaagatgtaatgcgagagatgtgctgaagaactttcggcgtttggagcggatggcaggtcgctctttgatagatattaagtcgccgattataacggatatgccgaaggcaccgaagcatggcaataaggcagaagacgcgattattcagatgatggatatagaaacggagagagatgcgattctagcggctttgatggctcttagtctgattagtcgtcagatactctactacagcttctgtgtgccagatagcttctcaaactacagaattagccgtgaagtgggttattcagaaagaagtatacaacggatgaagtcggaagctctaatagagtttgcagaagcatataaacacggaaaaataattgcttataaataatttggcggttttttggcggaatgatggcggtttttagacatttaccagtgttattatggtagtgtcgaaagattaggaaacaggatcgacaaaataaacgaagggaggcaatctccctcatcgttttaaacttcttcttagatagacagcaactaattatgaagaaaaggatgtgaattcaactcctcctaaattcttcatcggttgctgtttattttgattagacagcagcactcacaaaactaaacatgttcttgtcgtctttcaactgctgctgtctattaatttatgtattggagggaagaaaaatgaaattatcagtagaaggcactccagaagaaatacaagaattgctccaagctattggtagtagcaaggagcaaaaggtaagtgtttctaattcagatattgacggtatttgcaattgtttaaacagagaaaaaatatctaatccttactaagagaaaatatgttcgttaatgaatttccaattttcctctgtagctctaccttgataatttttttgcagttcacagatgaataaggaatcgttattatcaagtactgtatttaatttttcacacatttgatttggattcaaattagttttaactaaccaaaaagatttttgtagctttatatatgccccaaattcttttattatttcaaatactttatcatacttttgccctgggttattaagatcataactaatcatgtagggtttatacatgttgtcttgcacatccttgttttatatttcagcggaccactcgctgataaataaaattatacgcttagtatttattttcacaatattaatttatcgtaataacttttgagtaaatagaacaaaaaacctgcactagtttccgctagtacaggcagtgactatatcggttgataatctagcatatattaaaaataattgcaagaaaagaaatttatagtggtttataccaaattatcaaagcaatgttattttgttgctgtctattgttttttaattattcacacgataactaaaggtgggtgaagagaaatgattccattaataatttcaatttttgcgctctgtcttaatgtctatatgattggatttaaaaatgggcaaaataaaaaatagtagcagccaagaataattttatagtgtcactgtggcggaaagggtagacgctaagcatgtgtgctaggtcaatgcttcggcaaccatgcaaggttcgattccttgccagcgacattaaatgcctatgacggttacgactaccgaaaaaagatcgttaagaagctatacggtgctacgtacggcaatgtagtaagtgtgctatctgtacaccaccaagcttcggtcactgtggcggaagtagaagacgcagcggtaaatggcgagtagcctcgtgagagcctggtaagttctcgtgagtggtgcaatcccactccagcgactttaagcaaccgaggcatcggcggtttaaaaatataggggtgcgcaatttcgtacgcgttttgtgcatcgtgcaagttactattacatattagatcactctttgagtggtctttttatttttgcacaaaggaggaaacaacaatgtatagaccacaatacttagaacagaagtatgaagtaatcactgttcataaaggtaatggcgaaaaagtatatgagtatagaagaccaataaagagcgatacatataaacgaaaggaaaacaatgaagttattccattgtatggcaaaagaatagctaagcattaaataagattgcgaaaggagacggaacatgaccgaggaattctatagatggctattacagttgacaagagaagatcgtttggttaagttctatcagtctcctaaatggcgcaggcttagagagaaagcgatgaaacgagatcactatgaatgccaagagtgtagaagactaggtaagtatcatagagtagagaacgttcatcatataaaggaagtcaaggatagacctgacttagctttagatttagataatcttatttgtttatgtgttgaacatcataatgaagttcatggcagatatcttacagcattagataaacaagagaagaagatagaaagctttgctaacttcgatgcaagtgaaaggtggtaagtgcatgatcatcaatgataatggcagagagtatgatacagaaaagattgaagagtattcatcttatactcagggattaattaaacgtttgatatacgttcgctatgtaggtattagggatctgttatcagataactgttgtagtaaatacaaagtgaatcaagtaagagaagcgttgaataaagataataacgtcgaaagaataaaaaatgtttttggatatagtattgaagagattaattattacattgacttcgctgaagctttcattccgatggtgagataacccccccttaaaataaatcgcaaattttttgggggtgatgaaacggagggggctgtcaggaaaagagattttttcgaactttatcatgaaaggagggctaaaatgtttaaaaacgaattgtctcaaaatcgctacagagaaaaattacgccgctctttaataagccaattggaaagtcagaaaacaaatattgagccattcttagataatgttgatcgttatatcagtttatgggaaacggcgatatcactggaagaagatatatccgagaacggcattagactggagaatggtaaaaagaatgaatcagtagcgttgcttgtttctgtcaacaaacaaatgggattgatgttggataaacttgccattactcctgaattggtaggtgaagcaaatgaatcaattcctgagttataagcatattgaaaattggttcaaagctatagaagaaggcactatcaaggtatgcaaagagcaattattgctaaaaaattatctagaagaaagagtctttactagagaagatatttacttcgataagcagatggtagaggattcaatcaatataccagcacaatactttccattcgaattaattccgtgggaaaaatttctacaatgttttatttatggtgttcgatggaaaaaagataaaacactagtgttcaatagatatctttcattaatgggacgtggtaatggtaaaactggttttgcttcttggaacaacttctttctactaaccgctaaacacggtattaaaaattatgatattgatatctatgccaataatgaaagccaagcaaagactagttttgatgatgtatttaaagtaattaaagatcatcctgatttagataaaaaagtatttaaagctacgaaggaagttattcaaaatatcgctacaaacagcaaacttcgttataacacggcaaatgctagaacaaaagatgggaagcgaccaggtgcaaaccgctttgatgaaattcacgaaaatgaagattattcaatgataaatgtggctacttctggtggtggtaaaattcgagattatagagaattttatgatacaactaatggtcatgttcgtggtggtccgcttgatgacattatagaagaatcaaaaatgattctttctggagaacttggaattgacaaggatggagcagaattttctagtttgtttccatttatttgtcgcttggataacgataatgaagttgatgatcccgacatgtgggaaaaagcttgtccaactattaattacaatgcagatttaaaacggaaaatgtttcaagaatactctcaaatgcaacgtaatgctggtttaagacttacgttcatgaccaaacgaatgaacagacctatggaagatacacgatttgctgttgcttcatatgatgatgttctgcatacgaaagaaaaagaatttcctgaaaaaatggatgaagtgataggaacagtcgattttgctgatagacgagattttgccagcgttgggttgctaggaaaatacgataaagatgtttattttacacaacatacttttatccacgaatcagcccttcgattacaaaacatcaaacgagaggttatagatatttctatagatcaaggaaaatcacagatcgttcatggaaaaaatatagaagctgattatattgtaggttggtttcttgaaatgagtaataaatattatattaaaaaaatcgctatggatatgtaccgtgcaaaaatattgaagcccgctttagaagaagcaggttttactgtggaaattgttcgaagcggatctgttacacatggtatgttaaaagatctggttgatgacctttttattaatcaacgtttattttttggtgacgatgcgattatgcgttggtattgcatgaatgtatatgaagagcatatttctaatggaaatatacgctatgaaaaaatagaacctgaaactagaaaaacggatggctttttttcattccttcatggtttgaattttttagatgatatttatgattctgctcctgtaacagtcacaaatagctcagtagaaaatacaggaactggatttactcctctagtattctaacttgaaaggaggtgagaaagtggggatttttcaaaaggcggtaggatacttcacaaaaaaagcaacggttcctttagaagaatacttttgtaaattgcaagttgattttgtgtatcgaaaatttgcgattgaaacttgtattgatttgattgcaaatgcgatgagtaaagcggaattcaagtcatatgaagatggaaaaaataaaaagaatgatctttactataggctgaatgtagctcctaataagaaaaataatgcaacagaatttagaaaaaaactgatcaggagattaatattctacaatgaagtattgatcgtttctccgtctaataattctagcgaaatatttattgcggatagttgggatgtcacagaatatgcattgaaagatgatgtgttttctcaagtgcaaattaacaacatagtccttgatagagaatttctagaaagtgatgttatctatataaaatacgcagatcaacaaattaggcaactagtcgatgcgtattatcaagcgtatgggaaactcatttctagtgccatgaatgtttacaagcgctctaacgctcgtagatacgtactgaaagggaatttattccgaccgcaagacaatacaacacaagatcaaatcaataaaatgatgacatcacaatttaaggcttttatggaagctgataatgcaggtgcggtatttcaattacaaaatgagtacacattagaagatttcagcggaaacttccaaagcaattcaagagatataaaaaacttaatagacgacatctttgagatgacagcagcagcgtttcacgttccgaaaaacctactaaagggagacatgagtgggttatcggatcaagtggacgcttttttaatgttcgaaatcataccgattgctgaacttattcaggatgcgtttaacgctagtctctatgaagtagaagaatacttgtcagggaattttgtacgtgtggatacaactatgatcaagattactagcttcaaagatttggttgacgctattgatgtaggcattagaaatggagtatttacaatcaacgaaggaagagaacgcgttggaaatgatcgctctgataaggcgatggcagatgaaatatttataactaaaaacaatcaacaagtatcgaaaggaggtgaggcgaatgacgacaatgaaaacatttctagcagtaaagaatgaaggcgcagtaccgcaaatttttattcagggatttattggttctagttggttctttgaagggaatactgacaagggaatcaaaaatattttggatagtctaggtgatcaagaagaaattgaagtagtaattaattcaaacggtggagacgtatttcaagggattgctattgggaacttacttaagtcaaataaagcaaaagttaacgttgtgattaacggcttagccgctagtgctgcttcaattatcgcaatggctggcgatactataaaaatctacaacaatgcacaattgatgattcaccgcgcttccacatacggagaaggaaatgtcgatgacttccgtacgattgctgaccaactggaatcaattgataaatcggtaaaggcttcatataaaacacgattcaatggcacagatgaagcattgcaagaacttcttgaaaaagaatcgtttatggatgcagaaacagctttgagttatggattggtcgatgaaattatcgatgcagaaaatagctcaggtactgaagctaaaaaagaacaaagcgttgaagaaattttgaatgacgttaaagaaaaaagagcagaaaaaattgctgcatttacagcagcattaaataaaacatttggacaaggagatgtaaaataatgacagttaaaaatttaaaaggtgtaacagctgcaagcgaccaattgatgaaagcttttaaagatggtaacgaagaatcttttagcgcagctatggtaagcttatctaaggaaattcaggataaaattttagaagaagcaacagcaaaaaatcaagatcaattagtattaatgaaccgtggtcagcgtgtattaactacacaagaaacaaaattctataacgaagtagtgaaaaacgaaggttttgcaggggtcgaagaattagtgccagctactgtatttgaacgtgtatttgaagatttagaacaatctcatccactattgcaaaaaattacttttgttaacacaactggtgtaacagaatggattgtgtcacgtggagtcaatccagcatggtggggtaaactttgcgaagctgttaaaaaagttttagataatggctttgatgtaattaacatgaagcagttcaagctatcaggttatattcctgtatgtaaggcaatgcttgatttaggtccagtatggttagatcgttatgtccgtactgttttagtagaatcattgagaattgcattagaacaagcaattgttgatggtactggtaaagatatgccagtcggaatgatgcgtgacatgagcaaacaaactagcggagaatatgctgaaaaaaaagcagaacctattacagctttagatgctgtaactatgggcggtttgatggcgcgactatcaaaattcaatatcgaaggtgtgaatgatccgatttatcgtaatgtgaatccttctgatgtggtcctaattgtgaatccaactgattactggtctaaagtattcccagctaagactgtactaactgctaatggagaatacgtacaagtattgccagtaccagtttcagatttgcagtcaacggctgtgccagaaggaaaagcagttattggggtagcctcagattacttcatgggtgtaggatctacactaaaaattgaagcttcagatgaataccattttgttgaagacgaacgcatttatctagctaaacaatatgcaaacggtcaacctaaacgtaacgatagtttcattgtattagatattagcgctttgggaactactactacaactacaaaaccaacaaccacaacaactacaacacaagcgtaggtgatcagaatgaagtatattctttgtcagccggcaatcaatcggtttaaatgggagcttgaagtttgtttaactaatctgaagaaactaggaatcaaagatatcgtattgcttttcagcagacacgatgatcagattcctattttttttgagaaggaatatggtgttgaagttcatgtgtacgatgatctgcgggacgacaaagagtatattccttcgattaaaccatatttatggtggaaatatttagaagaagatcattcgcgtgaggacgaccgatatttctatatcgattcggatgtcattttcaataaaagaattaatttgcgcaaattgccttctaaagatgatgtttggtattgtagcgactgctgtagttatctaagtcttgattatattagaagctgtgaaaacggagaaaatattctaaaagatatggcaaacattgtaaatgttacagtagaatctttggaaactataaacactaattcaggaggcgcacagtgggttattaaccgtcctaaagcgaattattggaaaaaggtttatctggattctaatcggctatatcgctaccttagagggcaaaaaacaaatatacaaatctggacagccgagatgtgggcacagctttggaacatgatgtatttcaatattggtcctaaagttcacgaggaattagacttttgttttgctactgatccaatagaaaaagttaaagaagtaaaaatcttacacaatgctggagtaacaacaaacgatgaagatttatttttcaaagggagatacgtgacttctacgccttttgatgaagatttatcatttgtaaacaagaaaaaatgctcttacgcatatgttaaagcaattaaggcggtggttagatgacgcctgaacaagtgactgaagaattgctaatagctgtgaaggataatatttacgttacctggaacgaagaagatgagtcaattaaaaagatgatagctaaaaatgctgtttatcttcaaagtaaagtgagtacaacactttctttttctcctgaaagcttagaatacggattgctaatcgaaagatgtagatacgactggaatcgtgctttagatgagtttgaacaaaatttcgctagtgagttattaggtttcattcaacattatgcgctacaagaatatattgcaggtgatgtgaatggcgaataatcgtagactcgaagaaacattcaacgatggttggttaaagattttgacgcaaactaccaaaagaaatgaactaggaaaaaagattggtgtagaagatacagaaatcacttctttaaaatttagaaatctttccatgagagatagtgatataacagctatggatgcgatgggatcgaaattaactaagaaagtaaagactccatttcatccaatcgccaagaaatttaataaagatcaatattttatcgtaatcgatagtatgcgttacaacgttatctatgccgattacgataatttttatatctatttttatcttgaaagtgtgggtgaatatggtgattgataattctaaagaaaaagaacgtttaaataagcaaatttctgctatcaaaacttccttagaagagcattttggcctcaaactctttcaagactccgtaggcgaggatgagctacctgatgattttaattacttcattctcgaaacaggagaaatagaaatgatcactgagccaaaatatagcgtgggtcaaaatctatatctaactttctattcagaaaatagagaagatttaacaggagactcactagatattatttcattgattcaaaatcgttcgattcgttttcagagaatggatcccaatcatttaaaactagagaaccaagatcgctatatcgatcaattggtatttacgtttagacgattattgaagagtgattgtcatggctaaaaatagttgggagctaaaaataaatggacatgatgaacttcttgtgcggatggaacgctattcaagcgagagcgaacgactgattaacgaagcattgaaatcaaaaggttcggctattgcagtggataggattacagaaaaaattcctgtttctgaagcagatttaagaagagggcaccaacacgcaaaaaatagtcgtccacttaagactcaatacattaatttgggtttcatcattagacctacaagaaaatttgagtatttaaaatatcctgatttggggataggtacttctaaaagaaatcagccggacgaatttatgagaagaggattaggtcttgcacttgatccaattacagaacttctgattcgtcaattcgataaattaaataaatagggggaacaacaatggctaaaacaaaaactgtagtaacaacgttcgataacgtaagtatcaaacgaattgcttttaattttaagaacgcaggaaatgcaatcgcaacgaattgtaatggacaattagatggcgaaacagaaatgcaaacggtggttaaaaaatgtggagcgacagaagtaaaatcaaaatctaaaccaatcaatatgacggtaacaattactgcacatgtaccgatggaagtttatcgacgtttcaatgggttgaaacaagatggacgtattaaaccaggcatttactcttacggtcctgattccgtaggcgaagatttctcacttgctgcagagatcgtggatgacttcgaagaaaatagaaagttagttggtatgttagcatgcacttcgaatacaggattaacattctctattgaaaatggtgcggatgaagtagctgcgttagaactagaaacaaaagttatgcaagatgaatttggtaaattttatcatgaagcaattgttgcagaacttgaagaagacttaacagatcaatggatgacgaatctatctgctgatgtgattaaaaaaacttcagttgtgacaactacggccactcaatcacagtaaaaaaacggaggtagcgaaatgaacgaagattactcaaaaattgaactaaacgatggaacaattttgaatttagaacctaaactgaatatcaagaaattattgatgatcaatagagattttaacacagacgagtttgcaaaaatgactgtgggaaaaggatccatggatatttctgttattcaaggtgcaaaggctgtgtatattgcttaccgccaagcgaacatgactgattatatttcattcgatgaatttatcgataaatgggattttgatatggctactgccagctatatttatcaattgatgatgttcaaacaagcacgcgatgcttatcaaaaagaatttgaaaaagcaaataaggaaaaaaagcttcaaaagtaaaaattccaaagctcttagttgaaacgtgggtcgatgtctattcgatgttgaccgacgttttttctatgccttcagatttggttttaagcgatatctgtttagatgacattttgcaaatggcttacaacaagagtgcttatgaaggatggaaaaactatgcaataaaccaatcccagaaaaactaaagaaaggaggtaaaaaatggctaaaaagagaacagaagcagaagtaactttcatagctaacgatgacggattgaaatctacgttaaaagaaatcagtgctgaattaactaaaaatagagcagaattaaaactagaacaagctcaattacaacagactggttctgaatcagacaagttaggaagtaaattatcttctttagaaaagcagtatgaattacaaagtcaaaaagttgaagtaactagccaacgtttagccaatgcgaaaaaatattatggagaaaattccaccgaagttcagaaacttgaaagagaactgattaatcaacaaacagcgcaacaacgtttgtcaaacgaaattgataaaacgagtaatgcactagctcaagcaaaaggcgaaatacagacgtacgagtctacaatgcaacagttggatagcgaacaaaaaaatgttcaagctagtgcttctctgattgaatccgaatacaaaaaatggcaagcaactgctggtcaatcagcttctgaagccgagaaattagcgaaagcccaagaatatgtttctcaacaatctgaaaatgcggagaaaacgatagatatcctaagacgacagttagaagctacacagtctgaatttggcgctacatccacagaagcaatgcagatggaagcgaagcttaatgatgctgaacgtgaatttgaagagttaggacaagctgctaaaaatgtagatacaactaacttggacgatatcggaagcaaaatagatatgaataatttaatggaagcttctgacgttttaagcgacattggcgataagcttacagaattagggaaacaagcagtggactctgctaacagtgtaggtagttcccagagtaagatacaagctaattttggtttgtctaaacaagaggctgaagaattaacgaatgtagccagagacatttattataaaggttttggagaatcgttagatcagtccacagatgcattgattttggtaaagcgtaatttaggagatttaaataatcaagatttacaaaatatcacggaacaagctatggtcctagaaaacaccatgggcgctgatatggatgaaacgttacgtggtgtaaatggcttaatggtcaatttcggcttgagtgctcaagatgcaatggatttaatggtttcgggtactcaaaacggtttagataaaacgcacgaattaggcgacaatatggcagaatatagccaattatggagtcaaatgggatattcagctgatgaaacgttcggaatgcttcaaaatggtttagatgcgggtgcttataaccttgataaagtcaatgacttagttaaggaaatgggaatatcgttaacagatggtcgatttgagcaaaacatggatatgtttagtgaaagtactagaaaagcttttgaagagtggaaaaatggcggaggaacacaaaaagacgttattaattccatgattcaagattttagcaatatggatggtcaatacgaccaattaaataaagcttcgacaatttggtctgcgcttggcgaagataatgcgatgaaagttgtccaatctttaactgatgttaaccatacatttgatgatgttagtggatctgcacaaaaaatgaatgaagattctactactccgttgcaagagttgaacgggaaaatagctgaattaaaggattcattagctcctataggcaacacaatcatagatgcactcgaaccagtaattgattttctaggaaagatggctgatgcgtttaataatcttccacaaccagtacaggatttcattgttgctataggtggtcttacagcagcatttggcatactgttaccggcaatactagccgtgtcatatttatttggtccgatgatgcttataattggaggaattatagctgttatagcaggcgttattgtggcaattaagaactggggtgcaattactgactggtttagtggtttatggaaaaaatttactgattggttgggtgatacttgggaaagtataaaagacggagcctcatcagtttgggatggggttaaagaaacctggtctggatttgtagattgggttcaagatatttggcaaggagtttctgattggtttggagagctatggagcggattagttgaaggagcttccaacatctggcaaggagtccaagaaacttggcaaacattcgttgattgggtttcaaatatttggaacggagtcaaagaagtatggtcgattatttgggcagacattgtaggaattgttcaaataccatggacattaataacgtcattgattcaagctggtattaatattatcgtgggtatttttgatgtagctggacagttattgggcgcagcttggcaagctgtttggacacctatttctgatttccttaaaaatacttgggatactatgacacaatggataagtatcgcttggaatgggattgtaactacattccatactatatttgatccagtagtggcatggtggaatggtatatggacagctattagtactacggcttcaaatatttggaattcaattagtgcaacagcttctagtatttggaacagtatcaagaatacaatcactagcttggtacaagcagctgctacagtaattcaaaatatttggtcaactgtatctagttggttaggtggaatttggaattcaatcagctctacagcatcaaatatctggaatagtgtgactagtagtataagcaatgctataaacgcagctaaaagtgccattcaaagtgtttggaatagtatatcttcgtggattagcggaatttggaacggtatcaaaaatactgctttgaatctttggaatggaattacaagcactattagctctaaagtaaacgatggaaaaaatgcaatttcaagcggttggtccaatctaacaggtattgtttccgacatattcaataatgttaaaagtacaattgctaacatatgggaaggcatcaaaaagactgttagcgctccaattgattggattagagacaaaatcagtggcatttttgataatttgaatatttctataccacatattccgttaccggaatttatcatggaaggcagctttaacccgctaaaaggtcaaatcccccatttgcgtgtaaaatggcatgctaaaggaggtatctttactaaaccaactttactaggtggaatgaacggtgtcggtgaagcaggacctgaagcagttttacctttgaaaagatctgttttgcaagaaattggtgatcgtatcttgagtagcacatcagtttcatctagggcacaaacgattcaacctgtgaataactacgaattcaatttcacaattgatggtaacgcagatgaggttactatgaagcaaacaactcaacaaatcattgatagcattacaaaaattcaaaatgataatgcttcggcatggcgttaaacaggagagtatttctcctgtttttttagtattaaaaaggatgtgaaaaaatgactgattgtatacattctataatcgatggatttcctgattatttgcataaattggctttagctgaaagaccaaccataccttctccaaaaagacagagagttgaaacttctgttttaggtaggttaggtggcttagtacaagattactcgtttgaagatatgtcgtttacattgcactataactatttagaggatgtggaagaccatcaagcgttcaagcaatcgttttatatcatgcgtcattggttaaactatgcaaagaaattagaattctctgacgatcccaacgtctattacgttatccagactatcgatattggggatgcagaaaacgatattgttgaatggggagagttcgatgtaaatattactgcgaaaccattcgcaagagttcaagaagatgtacctataaccgtagataaaccacagtcatttaacttgctgaataatagtttagaagaaagttttccaaagattatcatcactccttcagctacttcatgccagttcatcttaaatgattatgtgtttagtttcgaaggcttagtagcaggaactgatgtagtcattgatagtgatttgatgctttgctacgaagagcaatcggacggagatattttagatcggtccaacaaaatgaagaccatgcaatatccgacattgcaagtggatatcaatcattttaattgcactggtttgagcaaaatacaaatttatcgtaacgggttaaggtaggtgaaatagatgatcgataatttaataactatttacgataaaaatgacgcgaataatttagctgaacatttatatgatacgcaaggtttaggcgctttgtcagactggttaacagctactgttagcaataaactaaacggagccgagatatttcagggtacttattcaataaacggaactaatgcagatttgattgtagaaggacgtattattcagtgttatgtagatgaaaatcgagcaaaacagcgtctacggatttattatgcaaaaacttctgtaataggcaatacgatagaagtaaaagctgaacctattttcaatgatataagaaaatcggtgttgaataaatatgacagcggaacagaaaagatcactgctactcaggcatggcaaaacgcaaaagttttagcgaaaccagctatcccttcgcagttttctttctcgtcattagtagatacgcttgctaatgtgaagatagaaaaggcgaattttttagaattctttggtggaaaagagggatctattctagatcgatttcatggtgagtttctaaaagataataacacattacgtcatgaaaaaagtctaggtacggatcataaaatcaaagcgatttatactaaaaacttaactggtcttgacttagagattgatgctcaaagtgttttagttggagtttatccattcattagcagctcttcagaaggagaagacgagatcactctaccagaagaagttattttcacggattacgtggatgattatcctgctggatatgtttcttttgttgattttaaagacaaagcgactgatgtagccacattaagggaagctgctaaagactggttgaaaacaaacatagataaacaaaaaccacaagtgagtggttcgattgaattagtaccattgaggcatcaaagaggctatgaaaaatttgttgatctagaaaaagtttcgatgggtgacggagtagatgtgtatcatccacagttaaaagtgaatatgtcagcgagaattgtggaatatacgtttaatgttctaaccaattcatacgataaattagttgtaggaaacgtcaaaacaaacttcttagaaaacacagagaataatgtcagcaatttgattaatgatgccattgatcaattgaaaaacggtggcgaaatcagtgatttactcaatgatattgtagatcatcaaactgatatgattactggtcaaaatggtggttatgttttattagatcctaaagaagcgcctagtcgtattttgattatggacacaccagataagaataccgcaaggaatgttttacaaatcaacaatgctggtattggtttttctaaaactggcattaatggaacatatgaaacggcatggacgttagatggcggattcaatgcctcgtttattacggctggtgaaatagtaggaattactattagaggtactacattaattagtgatggtgctgattatagaacaagtattgctaatggcaaaatgacttggtactcaaaaaaagttaacaaagatattatggagctagaagcacgtgattatgtaagtgctgatgccggtattgtatcatacaccatgaaaactggtggtggtttcatgattagaaatccacagggtaacttggtttttagtacgtgggataatggtaataacagaccgtttctatcttttggtgcgcccaatttcaggtatagcaatgctagttatgtaacttctggcgacggtagttctttaagcattaatggtagtgcgggtaactcatgggaatttaaggtagctggtaggactatgaaatttactagtgatggtatgctaacgttaccaggttgtttttttggttcatgggaagatgggaaacttgctaggtttgaacaatcaacggtacaagtatataaagattttactgttagaggtactaaaaactcaactgtaccaacagaacattatggacaacgactattgaacgcttatgaaactccagaatattatttcgctgattatggggaagccgttacaggtgacaatggtaaagttcgtgttgatattgaccccatgtttgctgaaacagtaaatctaagtcggtatatgacacatgtgacacctacagaactagttttgtgtgctgttactcatgaagatattgaccatttcatcattgaaactagtaagccaaacgtattagttagatggaatttagtggcacaccgtctagggtatgaagatattagattaaaagaggatacagcatatgatagcacagtgcttgaccaaaaacgtttttaaaacgaagacaaggaggtatataaatggctagcagtttatataatttggctttagatttcagcaaagaattaaactacaccaaagctattatggctcgtcaaggtgataaagggattacggtgacggttaaaccgtttctaaatggcttgcagatggatacgagtggcggaacatttactttaaaaggaacaacaccatctaaccgttacgtagataatgttgcaactagtgtaactagtgaagaagtcacgttttctcttgatggcacatttatgagtgaagcaggatattataaacactgctacgtagaatatagaaaagacaatcaaattttaacaacgcaagatatcatttttttctcactaggagtgtctgacatttcgcaaggccaagccgatgaatatgtttcgcaattagaagagttgattcgaaagtacaacgaaacttttgatgcttttatggctgaaatcaaaggtagagtggatagcttaaatcaacagattactgatttaactggtcaagctaaaacgctacaagacaagttagatgctctgaaagaagaaatttctaagttaggtaacttacaagtgatgtacagtaacagcatcgacttcggggactatgattattcggagaacccgaatttaatgccatatattacagaaccttgggttggacctttgttaggtaatggacatacagttaaagatagtgttaaaagggttataactcatactaaaactagaacagctaattccggcgacatattatcgcttggcttaggtattccgtgtacagcggaagctaataataggtatcttataaccactttacgaccatctacgacatacacattaagcgttactatgagtgtcggttcagattggactggagagaccaatactataggggttaggcttagatatttaaatgaacaaggtggtatagaactgcccattaatgcattaataccagcaaatgtagaacgcgataaaatggtcactcatacatttactggtataacaaaagataatgtaactagcataacaaactgttatgttgaaatattctcacttaatagtgaatataaaggaacggttagtgtcagctatgacgttaagttaaaagcacactaccctaacttactagatggcccttactggttaggtaaagttcctttaggcgagaatattgctgaccctacagttgtctttccacacaaaactagtgaatatatggtttatggtagacgcaatacagaaaactatatcgctgaccaaacatataccatatcaatgaaagcaactaaactaacagttcaatcgtttgccgtgtatattgctgctggccgcgttaaagtaggagacatgaagcctactgaggggttagctaatacatgggagttaacttttactgtaactaagcaacatatagatagtggggtaactaattatctggaaatataccaatacccgtcagctacaaaaggagctgttcaaattgagtggctcaaactagaaaaaggcaatactcgaaccccgaatattagtgagtataaatatcgtggtactggtatgcgtgattcaaacaatccaaaagattatgtttgggatctagcaccagaatatgtcgaagataatttggccacagatattaaaatttctgaaattactggtaaagcaaacaattataccgatgggaaagtatcggagattaattcgcagttgactgcttcaattaatgaagtagacaccacagctaaggatgctcaaacaaaagcgaatgctaatgcgactgctatagatgaattagacaataagatcgatgaacgcattaatgatacagctactaccacattaacagttacaaacgggaataccggatcagcaaagctttatcgtgaaggaaaaacagtttctatatattttgtggctttaaacggaaaaagcagtggtggaaatgattcaacgatactaacaattccagaaggctatcggccaccaattagttttgagcaactggttggctcgatagaccgttctactttgaacagtgctcagttatctattggtgcagatggagccattaaatggcgaagaaactcaagttatggatcggattatacctttgcaattacttacacgatttagaaaagcgtgaatcgatatgaaggcagcatatagaccaattgaaccttacggattcgagcaaatcattgtgaatgatgaagaacatttaccggaagaatgcacagaagtcgaaccaccgattccaaattggaaaccgaaattcaattactgggagggaaataaatgaaaaacatttggaaatatggacgtactggcggagagtacgcaggaaaagtattggacgacatgcttgtatccgttccttacacagatcagccaccgcttgaaggaattcgtgctgatggcgaaccgttaacaatcgctgatcaaatgtttgatcctaaattgaatcaatggattattttagcgaacgcactagatcacaacgatttaaacaatctcaaagcaatgtatgagtcgttagaaaatgagaacggcgatttaaaacagatcaatgccaaactcatgctaagcgatgtagcaattaaacaggaaaatactgcattgaaagaaaaagcggatagtttagcacaaatcaattcaaaaatgatgcttgcttcgttacaaaatagcaaagacatttcagaaattaaagagcaactaaatccagcttcaaagggaggtgagtagtatgtttagttttagcgatgtgaaaatgatgtatgattggggctgtttcactaacgaacaagtaatggttttcgttccgttgtgcattactgaagaaaaagcagataaaatcattagcaaagaagagagcgcatcttaattgatgtgctttttattttgattcaaggagttgtcacatgattaatttaggggaatggggagcgatagcaggatcaataaccgctatcgtttctttgattttattagtaataaaaccaattactgcatctttctcgaagattactgagactctttcaaaagtaagtcacaatttagatttgctgactaaagatttagaatcgagcaaatcagatcgattgatgattcatgaagaactaaagaaacacgatgaaagattagatacacatgcagaaaaattggtagaacacacgcaacaaattaaaactttatttagggagagaagaaaatgaataataaaacgttcgaagtactaaaatggttcgcactggtaattattcccgcactagctactttcgtggggttagttggtaaagcgctcaattggcagtacacagatatctgtgttgtcatcattactggttttggcgcgtttttagggagtgtgttgggtgtatcaaatcgaacctacaaaatgttctcggctgaaagcgaagaaggaggaaacaaatgaaaaagaaaattactattactgcgatgagcctgttaacggctctttttttattacccattaatacgtttgcttatactattaatgacgagtataatttagcgccgaatcaaggagactccagattagcaattcctaacaaaattattttgcacgaaactggaatagatgcaccagcaagaaacgtagccgccaacatgaaaaataattataacggaagcaattcttatactacagatgttattggtgacggtgggattgtttaccgtgtgggtgagcaaggatatgtttcgtggggagctggtaacgctaatccttatgcgcctgtacagattgaattacagcgcacatatgataaagcattgtttgaaaaaaactatcgagcttatattgaatatacaagagatagtgcaaaaaaatatggaattccattgactcttgatcaaggaacttctttatttacaaaaggaatcatttctcatttgtgggtgacaaattatgtttgggggaaccacacagatccatatggttacttatcgcaaatgggagttagcaaagaaaagcttgcttatgatttagctcatggatttaccgatgaaaatccaacaacttctgaaaacaagcctgtcattgatccaacacgagctggtgcagctaatcctacgctgacagatggaacaaatcacgcccacattgatcagtttggggaaatcgaaaacgcaaacttgcatgtggctggatggcacattgctaactataaatacgagtatattttcattatggactacaatactgggaaagaattagctcgagtaagagctgatggaatttatagaccagatgtaaaccaagcttataatacttctggaaatgttggttatcatgtatctttcaatatgcgtaattttcctagtaagaaagtctatgtaatgatgcgggcaacgaatgatccagagggaaacactaaaggcggtgcgcaagatttccatgacaaacgttggtatttaaatattcctaaacgataaaaatagctcctcgttgaggagcagtacataactatattgacaactataaaaattattcgataaaatagtgatgttatcgcatatcttcactatcacccataaatagtcacactccaagctatgcgataacaggtttgttgccacacattctactggttgattgtttatggctttatgtggcaacaaccagtacccttagctcagttggtcagagcagacggctcataaccgtccggtcgtaggttcgagtcctacagggtacattaacgtagccatttgaatcgttctgtgttagaatttttttgaagagtattatacaagctaaagcttttcttcattgccactcaaatgagtggcttttttatgtatccttttatggattaatgaaaggatgtttcacatagttatacttctgtatatttgaaaagttttactttgatttttaaatagaaagacatttgggttaaattgtgagataataataaagaagagtttaaagcgcaccccaaaccacttccccataagtgtgttacgctttaaactcttttatatttgaagccattaaaaagcataccatatttttgaaaaaaagtgagaaaaaaggcttacaattggagtggtagttaattagtgacttatttttgattttatagcactgatactataaaatatagatatcatcatattacacaatcttaatactaacttaaaaaatatctcctttcacaagtatggtgataaaattcgttccgggctacctttttaggtagcctactttaatctttatacctttctggatcaacgaaagtatactttatatagtcataacgccgatgatcgctacgtgcgtccggcacgtcagtcatgaatcggctacactagactagacagaaaaaataaggtgtgtagaataataaaaaacacactggaggatttttcatgtcaagacgtcaacgaagaacctattcaaaagaattcaaacaacaaatcgtcgatctctatctcgctggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaattgatgccaacaagcataaatattccatatcagcgatgtgcaaaattctaaatatttctcgtcaaacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccggatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtggggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagaccggggaaaggaatttgataaccaaaccattcatgagattctgaatggttttggaattactcgttcattgagtaggaagggttgtccgtatgataatgccgttgtggaatcaacctataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaattgaatgattgtgcttctgccggagaaaatcagatccgaggatgctcattgtcaagggcaatcgtagccataacaccgcagcattcacaacaccttataatttttgtcaaaaaaagtgttgccattccacttttttaaatatgcgttctctgctcttaaacgaataacttcttcttcaagagactcatctttaagttttttaggaatgtttagcttggaattcatactaatttttctgccccttttttggctctcaagtgaagaagcaccgccttcttcatattgctctatccatttacttagagttctatttgaaccgatattaaattttttagcagtttcttggatagaaagaccatttgtttccatatattctataacatcaagtttaaattttgtagtgtagcttttgccacctccaaccaagccttcccaaccatgatagttataaatccttacccaatgtctaaccagtgtacgatttatttgatatttatgtgcaagatatttgtagccgccttcgttatttaaatagtctgaaactacttttttcttaaaaacaaatgtatatttccgcaaaaaaagcaccccttttaattagatttctagtctaacttttggggtgcacatcatttttgaggggaagtacatatagttgttgatatagttgctaatattgttagctaatttgttagtaaaactgtatacgaatttagatagtaaaaaaacagtttgttccttatatagaggcacttttactactgattaaatgtcagatatgcttacaaatatacttataaatatgcttacaaaattagctaatatttccgttgacaaagctttgttactattgttaaactaaattgactagcaaaagtgaaacataaatttattaaataaatgtaaaaattaggagaaatcaatgtcttatagagtacaattaataatttcagaagatgtagaaagtcagcaatttggcactaatgttattaataaagtaattaatccagctctttctattaatgcgcctttaattcctactgctttatcattttctgtaacagctgtggtgtctgagatagaggatacagaaaagataaaaatagtagaaattgaagttttaaacaagaatgaaaaacaaattttttctacgggtgaagtatcggtaagcttgcctcctcaagttaacgatataaactttaatataaacgccagaaatgtcttggttgaagaagcaggagagcattatgctgttgttaaatttaatggaactgagattggaaggcaaatctttgatatcaaggtcaacaaaccagtggaaaaaaattaaggagacgatacggatgcttgatatagtaccatcaaatacacatcggagtggtagcttaataaattttgctgcgatttttgcttgcgcatcggtaattctagcatctccagttgttgtggatgcaagttctactccgaaaactaaaaatgataatcaacttgtaattactacaaaaaatgagattaacacaatttcaagtaatgatggcaaaatttttgatgtgataaatacggttttaaaaagaaaagctgaaatcaatataaaatatgatgaagatttaaacttgtatttctttgttatcaaaacaacatctgaattgttttcctcagattacgatgttttggatactctcgataatgtattatctgactataaatatatggggaaatctgtagtagcaactttgggggaataaaatgtttgactttaatgaatatttatctatttccaaacaaattgaatcagatgataaatataattctaaagaatcttatagaagaactgctgtttcaagagcatactacagtgcttttaaaaaatctgatgagtatttgaaagaaaattatgatattatttataatggaagtagcggaaaaggaagccaccaaaccgtttggaatttgttttcaacagttaaggaattgaataccttaggaatacataatagtgggtatagaatgttagagaaaagaaaatgtgctgactatattcctaatgaaaccattacgaaaacagatatggcgctgatgaatcgagaagcagaaaaaataataaacaaactcacctaatgaatttcaagcgagtttgtttgttatttttttatttaatctttgtatctttctggatcaacgaaagtatactttatatagtcataacgccgatgatcgctacgtgcgtccggcacgtcagtcacgatatcaaacaaaaagtatacacccttcttcattctagttttcgcagcaggaattttgaaatagttcttattagaatagtagagattgattaataagctatcttcgattgctaaaaagaaaacttctgaattccatactttataaaaatctttgataaatctattcgaagggtcaaatttaaaccataattgtgtttttccttccatcagcataaaagttcacctcaaaaagagtatacgaacgaatgttctttttgtgaaggcggaatttaatatactgaataatagaaaacaagtacttgtgccaaattatgtgccaaaaaaattcgaattcaacaaaatgtaaacaaatagaaaaccttctatattaagatttcctgcaataacaaacacaacagaagacgtgtaatagttagtcaggaacgtacaaataacccctgtatcctttgcggtacagggggttattttgtataagtagacattgtagtttctaaactgctatgtcctaaacgtttcgatacgctaagtatatttactccttgataaagtaaaatagatgcatgcgtatgtcttagtccatcaataaacagtcgaagagaaaatagggaaaaattgattactaaagaaaaacttactaggtcgacggtgtagttgattttcatacttcaatagattcgaattaaacgatttcgattggcttataccagtcctatccaacgaaagatatatcgttcttaactctagcggtataacttgaagctttacgtaaagccaatgggaatgaactggagatgactttttattatttttagtaatagctgatgggttaatacttacaactttccttttcaaagtaccatataaaaaaacggtggggttgtttagcgaaataaaggatctaagccaatagcttagatcctttattctatgctttatattattttttgcatgtgtgcgaaagtatactcaagcccaatcgccatttcggaaaatcggtactgtagagccatcttcacggattccgtcgatatccatcttgtcagatcctaccatgaaatctacgtgggtttgacttctattcaatccagcttctgctaattcttcatcggacatttctgtaccgcctttcacactgaaggcataagcagaacctagtgctaagtgattcgatgcgttttcatcaaataatgtattgaaaaagatgatgccagattgagaaataggtgaagggtcaggtacaagtgcgacttctcctaaacgacgcgcaccttcatctgtatcaagcagttttgctaagacatcttctccttgttcggcagaaaaatcaacaacttttccatctttaaaagtaaatttcatacccgagatgatggtgccagcataactcagtggctttgtacttgaaatgtaaccatctactcgatgactgtcaggtgctgtgaacacttcttccgtcggcatatttgccatgaatttttctccacgagcattatagcttccagcgccttcccaaagatggtttttaggcaatccgataatgatatctgtaccgggagcagtatagtgaagggcagaaaattgttctcgattcaattcttctgctttttttgctaatttttcatcatgcttcttccatgctaagacagggtcttcttcatagacacgagtcgttttgaaaatctgatcccataatgcctcaacttgtttttcttctggcagttctgggaagacttttgctgcccattgtttaccagccgcagccacgacagtccaactgactttatttgcttgagttgccttgcgtaaattcattagtgctttgccattcgctgattgataagacgctactcgatggctatctacaccagcaaatgcatcgggatcggcagaaacaacgctgatcctgcttgctcctttttcaagccattcatccgcttgatcgattttagattgtggtacattctcaatacgatccgttgcagcatgtaaaagaaattctctttggatctggtcgtcagtccattgaacgataacctcagcggctcctagtttataagcttcttgtgtgatcaatcgagcaaggggtgcctgttccacgctgatctgtaaaacaactgtgtgtcctttttctgtggctacgccagtttctgcaattaagcgtgcatatttttttagaagttcattaaaatcagataacataataaaaattcctcctcaccattttttctggtaactattagcatgataccatttaattatgattcaaacaatgaggctttaaataaaaaaaggaggttatttttttaaggttaagtttcatgatatatgttactacttgctatttcagcttgtgaagaaaatcaaaaactaattttgcatatcaaaaaaacatgttacaatgaaattaatcaatggtggaagcgttataaaaaaattaaggagattaaaaaatatggcaagaaaaaagacgattactagagaacagattttggcagctgcttatgaagtagctgccaccgatggatttacacgatttactgcgagaaacatcgcgaacaaaatgaattgttccacgcaaccgatttatcttgagtttaaaaatatggatgacttgagacaagctctttttgagcagatctatgatcatttacaatatgaagtgttcactgttgagcatacagggaatacgattatcgatcttgcttttaattatatccattttgcaagaagagagaagaagttgtatcgttcactgtacttagaagaatatggtggaggaaaagagatgcagaatttctcttatacttactttgtgaatacagtgaaacgcgatccagcttatgtgaatctttcagaagagcagatcgaatctttgtataatgggacatggatcatagctactgggatcgcagctttgatgtcttcaagcatcatccatccaactgatgaacagattgaaaagatgatccaagacagtatagatgctatcttgaaattcaaagaaccaatcgaaatcgattgaatatactcaaaagttccacaaatcagtaggtaacaagagatgtgtcaaaataaggaaaagttcgtttttcttacagcgtatgcatttttaactcccgaagaactcttccatgaatgcaatgaataaaagagccatacagattgaataaatctggatggctcttttattgcaagtatattaaatttttgcgactagttctttagcgaaagcttctaaattttcgatatcttcttcttcagcattcagatccactttaacattttcggctccttttgatgcgcctgtttttgcaaaagcagcatcgaaatcatccaccgatttgcagaattcatcgtaaaaagtatcaccagatccgcagacaccgtaaatttttcccaatagatccaattcttgcaagtcttcataaaagtctacgatctcatcaggcagatcgccatcatcgtatgtataagtagctactacgcaaatatctgcctcctcgaattcatctgcatctacttgggtacattcgttgatttcgacttcgatatccagattttcaaatgcttctgcaacaatatcggcgatttcttcagtgtttcctgtcatgctagcatatacgatttttgctaaagccatgatgtgcctcctcgtttataattatttaacaattatgaattataccaaaacatcattgaaaagaaaataaaacctaaagacacctggggaatgtcatttggctaaatgtatgccgctatgttaaaatgagagggatttgtaaaaaggagacgaaaatatgattactttaaaatcagcacgtgaaattgaaatgatggcagaatctggagctttattagcagatgtacataaaaatctgcgtgattttataaaaccaggaatcacaagttgggatattgaggtatttgtcagaaactatatcgagagtcatggcggaattgctgcgcaaattggctttgaagggtatgaatatgcgacttgtatcagtataaatgatgaaatttgtcatggattccctcgtaaaaagcctttgagaaacggtgatttggtaaaagtcgatatgtgtatcgatttgaaaggcggcatttctgattcttgttgggcctatgtagttggagaatctacacctgagatcgaccgattgatggaagtaacgaagaaagctttgtacatcggtattgagcaagcacaagtagggaatcggattggtgacatcggtcatgctatccaaacttatgtagaaggcgaaaatctagcgatcgttcgtgattttattggtcatggcgttggtcctacgattcatgaagaaccagcagttcctcattacggagaagctggaaaagggttgcggttgaaagaaggcatggttatcacgatcgaacctatggttaataccggaacttggaaaatgaaaatggatcctaacggctggactgcgtatacaagagacggcggactttcttgccaatatgaacatacattggctattactaaagatggtccaagaattttgacatcacaaggagaagaaggcacttattgatctatccagtcaataggtacgggagaggtacatgaaagtttggaacaaaataaaacaaaatgaaaatctgatgcgctttattgagacgactcaaaagcgcatcactgattcagaaatgagtacgacctctgtcgtcgttgcttattatttactcttgtctttatttccattgattattgcttttggtaatattttaccgtttctccacatcgatcaagagactgtactgacctatttacgagaagtgattcctgagaccgtttaccagtttatcggtcctgcaatcaaagaccttttgacacaaagttcaggaggcttgttatccgtttctgcattagcggctttatggtctgcaagtcaaagtatcaatgctttgcaaattgcgatgaataaagcgtatggcgtagaaaatagaaaaaattttttgatcgtccgtttcttctcactaattgtcattgtcttgttcatgattgctattagtggggtaactatcgttcttgggttgggacagctgattttggatgctattcagccaatcgtacaaatacccgtgaactttatcgatcagttccaaactttgaagtggccaatcacattggtagctttatttgtcatcatgttcttgatttatttaattgtccctaatgctcagttgaagttgaagacgatcattccgggcacgatcttcgctactgtcggctggatgctgttatcacaagtgtttagtatctatgctaggtattttgcaacgaggatcagcggttatcagatcataggaagttttattgtactcatgctttggcttaattttgctgctacgatcatcattttgggcggaatcatcaatgcagttgttcaagaatacgtgacgggtcatcaaatcaaaaaacgtcgagatccaagccgaaaatggttcaataaattgaaaactaaattttctcataaaaaaaagtagaaacaagagttcttattgtaaatttatatcagtaatttataataattatgactcttaattaaagtaggtgcccatatgcttgtttcttttagtatggttataagattttttctgacaattttattatcactgatattaacacctgtattcaaaatcatttcagtacaaacaggtatggtcgacaaaccaaatgaaagaagaataaataaagttccaatgccttcagcgggcggactgcctatctttatttcatttgttatatcgactttattcttattccgtaaaattatccctcaatcgtatattgtaccgatcttgattgcttctttagtaatcatagtcacaggagtgctcgatgataaatatgagctgacacctaaacaaaaaagtatagggatcttgattgcttctcttattatttattttgtagcagatatacgtattgattccttcacgcttccttttattggatatatccaactaggctggcttagttttcccgtaacgattttttggatcttcggtatcacgaatgcggtcaatctgattgacggtttggatgggctggcggcagggatttcattgatcggtttaattacgataggaatcattggatattttttcctccatgcttctacagtgtatattccagttgttattttctgtcttgtagcaagtattatcggtttttttccttacaatttttatccggcaaagatttatttaggcgatacaggagctctattcctagggtttatgatggccgtcctttcactacaagggctgaagaacgtgacttttgtttcatcgatttctttgctgatcgtcatgggagtgccggtaacagacacgttttttgctatcattaggagaaaagcaaaccgtgtttctttttctacagcagataaaaaacatcttcatcaccgactaatcagtttaggctttactcataaaggtgctgtcctgacgatttatgcgatggctttgatgttttctttcacagctatggtcatgaattatactggaagaatcggaacgatcatattgattattgccatgttgtttgctgcaattttattatttgaattgattggtctgatcaatgagaaacatcagtttattttaaaaacattgcgatttttagggaataaagagtaccgtacgcaagtaaaacagaaatatttgaagaaatggaaccgtcatatagatgaataacaaattaaaccagccgatccttattagtattgtgacggcaaacagtgataaaatttttcggacactagataattttatttcaactgtaaaagatgaaacagcagtaaaaatccgaatttttgacaacaattcacttcccgagtacaaaaaaagactaacagagtataggaaatatccctacatcgatatctattttcatgatgaaaattccggatttggttatggacataatcacaatctgatagctagcgattctcgctatggcattatttgtaacccagatattttagtggatgaagagacagttacagcattggtcttgttattgaaagaacatccggaatgtgcgatgttagcacctaagattcttaatgaagatggaacaactcagcacctcatccgtgagcagctggctgtttttgattacgttttgcgctttgtgcctttcaaatgggtcaaaaaaaagtttgacaaacgactggctgtgtttgaatgccgaggattgcctactgatgctaatagttatgtacggatgatctcaggtagttttatggtagctgatattgataaatttaaagagataaaggggtttgatgagcgtttcttcatgtactttgaagacaacgacttgtgtttgagttttgaaaaagcaggttacaagttattgtacacacccttttatgcagttatccatttttacgggaagggtgcgcatcgaaatgcaaaactgtttcgcgtgtttttgacttctatgatgaaatttttcaataagtgggggtggcgttttttctgatgaaaccagaaatattagtagtcgttgtgctttatcagcaactattcagtcaatctccagcttatggaccattaagcaaagcacttagcgaaaagcaaattcagcttattatttacgataatagtcctcaaaggcagcaaaatgagctgtttgaaaaagaaaatatcgtttatcatcatgatccgcaaaatcctggtttagcggtggcttataattttgcgttgtctcaagcagatgaaggaacacgttgtctcgtcactctggatcaggatacgaggctagtcgacgattattttgaactattgcgtaaagtaacctttacagatgaatgtgttgctgcagttccgatgattttttctgggagccgacaagtttctcccctatattcagatcgttatatcaatcgtacagctcaagcagtagaagttgaaggcccaacagctgaacgaatcatggcaatcaattcaggtgttgcctggtctgtcaaatttctaaaaaagattggcgggtttaatcctgctttttctttagattttttggatcattggctgttttggaaagtggatcagttggaaaaaactgtggagatccttcctgtacgaatggaacatgatctttcggttttagactatgaaaaagtttcaagtaatcgataccgttctattttacaagcagaaaatcgattttatcatgaatatgatcaaaggcatttatccagtcaccgacgacaattattgttaagaacagctaaacagttcttgaccgtcaaaaaccggcatatctggcggatgactttgcgctcatatgttaagaattggaaggtgtgaattcgtgcgttcggtttgtatagctacctttaatggaggcagatatttaagagagcagttagatagtattttatctcagctttcagcagaagatgaagtagtcatttctgatgatgggtcagtagatgatacatgggatatattaactgaatacgcagaaaaagataagcgaatccagcttttttcggggcctcgtcaaggattgatcgctaattttggttatgcgatccagcagacgaaaggagatctaatctttttggcagaccaagatgatgtttggttggagacaaaagtgaaaaagatcactgactattttgagcagaatccggatcagctagtagtagtttctgatttaatcattgtggacagcgagctgcaagagatccatgattcgtatttttcgtttcgaaattccaaagaaggatggcttaataatgtgataagaagtcactatattggtgctggtatggctttccggtcttctttaaaacccgatattttgccgatcccgtcagaagtgccgatgcatgatatgtggattggtttgctgggaggaaagaagactgggttcctaagagaaccgttaactctgtaccgaagacatgatttaaacgcgagtgagattgaaacacattctaaattacggcaaaaaatttcttggcgtgttcatctgattacggcgttgatcaaacgaaaatggtttaaacgttgataaaagatgtttaaatccttaatatttccatgacaaatataacaattgatgagataataacaaagtgaaatttgaaatcaaaaaggagagcagatatccatgaagggaatcattcttgctgggggcagcggaacacgtctgtaccctttaacaaaggcaacatcgaaacaattgatgccgatttatgacaaaccaatgatttattatccaatgtctactctgatgttggcgggaatcaaagaaattctgattatttcaacgccacaagatacaccacgtttcaaggaattatttggaaacggaaatgatttaggactgcagatcgaatatgcagtacaagaaagtccagatggattggcacaagcgtttatcattggagaagaatttattggagatgatagtgtctgcttggtattaggggacaatatttactatggtggcggtctgtctaaaatgttgcaacgagcagcttcaaaagatacaggcgcgacagtatttggctatcatgtcaatgatccagaacgctttggtgtagtagaatttgatgagaatatgcaagctttgtcgattgaagaaaagcctgctcagccaaaatcaaattacgctgtaactggcctttatttttatgacaatgaggtaatttctatcgctaaaggtatcaaaccttcagaacgtggagaactagagattacggatgtcaataaagcatatttggataaaggaaaactatccgtagaacttatgggacgcggatttgcttggcttgatacaggaacacatgaatcattgcttgaagcatctacctttatcgaaacaattgaaaaacgtcagaacttaaaagtggcttgtttggaagaaattgcttaccgtatgggctacatcgataaggaacaattgctggcccttgcacagccattgaaaaaaaatcaatacggtcaatatttattgaatttggccgctgaataaggagtccttacagatgaaagtaacagatacaaaattaacagatgtcaaaatcgtagaaatggacgtctttggcgatcatcgcggtttcttcacagaaagttattcaaaagcaaaatttgcagaacatggattgaaatatgactttgttcaagacaaccattcactatcagctgaagctggtgtccttcgggggcttcatttccaaaaaggagaagctgcacagacaaaattgattcgggtagtcactggagcagttttagatgtagtagtggatatccgcaaaggtagcccgacttatggtcaatgggacggatttatcttatctgaacataatcatcgacagttgcttgtacctaaaggatatgcccatggattcgttactttgacaccaaatgtgaacttcctttataagtgtgataattactataatgcagaagcagatgggggcatcgcatttgatgatccagatttagcgattgattggccaattgatccatcaagagcgattatgtcggaaaaagatcaccgtcatccgacattaaaagaatttgaagcagaaaatccatttgtttacggagaaatctaagaattaaggagaaattttcttatgaaaaacatcattgttaccggaggtgccggattcatcggctctaatttcgttcattacgtggtaaacaatcatccagaagtgcatgtcactgttttggataaactgacttatgcaggaaacaaagagaacttggctggacttcctagcgatcgcgtagaattggtcgtaggagatgttgcagatgcagaattagtggacccgtctagtaaaagaagcggacgcagttgttcattacgcggcagaatcccataacgataattcattaaaagatcctttcccatttgtacaaacgaatatcattggtacgtatacacttttagaagcttgccgcaagtatgatgtacgctatcatcacgtatctactgacgaggtttacggcgatcttccattacgtgaagacctgccaggacatggggaaggcgaaggagaaaaattcactggcggaaacaccatataatccttcaagtccatattcttctacaaaagctggttcagatctgttagtaaaagcatgggtgcgttcttttggcttacgtgcaaccatttcaaactgttcaaacaactatggtccttatcagcatattgaaaaatttattcctcgccaagtaacgaatatcttaagcggtattcgtccaaaattatatggcgaaggaaagaatgttcgtgactggatccatacgaatgatcattcttcagcagtgtggctgattttgacgaaaggcagaattggcgaaacctatctgatcggtgcagacggtgaagaagataataagaccgtgatggaattgatcttagaaatgatgggtcaaccaaaagatgcgtacgaccatgtaaacgaccgtgcaggacacgacttgcgttatgcaatcgattcgacaaaattacgggaagagttaggatggaagcctgagtttacgaacttccgtgatgggttggctgacacgatcaaatggtacgaagaacatgaagactggtggaaaaaagaaaaagaggccgttgaagcagcatatgccaaaaatggacaataatacagagaaaatgtcactgtattaatggaaaaacacatgtgaggcaggcgctcgcctgtctcttttttaaaataaaaatcaaggagcggataatcatatgtttttattaactggaggaaatgggcaactaggtacagaattgcgccatttattagatgaaaaaaatctgcaatatgtttcaacagatgcaaaagacttggatatcacagatgccgagaaaacaatggcttacatcacagaattaaaacctgatgttattttccattgtgcagcttacacagcagtagataaagcagaagaagaagcaaaagaattagatgagaagatcaatgttgatggtacaagaaatgtagcacttgcagcaaaagctgtgaatgctcaattcgtctatatcagtacagactatgttttcgatggaaaaaacaaaaatgtagaatacgaagtagacgaccaaacgaatccactaaatgaatatggtcgtacgaaattattaggcgaaaaagcagtagaagagattttagaagactattatatcatacgaacttcttgggttttcgggatctatggacacaatttcgtcttcacgatgcaacgcctagcggaaacccgcgacaaactgactgtagtaaatgaccagtttgggcgaccaacttggacacgtactttggcagaatttatggtatatgtcatcgaagaaaaagcaccatttggtatttatcatttgtcgaacgaaaatagctgttcttggtatgaattcgcaaaagaaatattgaaagatacagatgtagaagttgcacctgttacgtcagaagaatttccgcaaaaagcaacacgtccgcagtattcagtcatgagcctgaaaaagacagaagagttaggatttgtcataccaacttggcaagaagcacttgcgcaaatgctggaagctgccaaaaaaatgaataagtaatttccttttatcaaatagaatttggagcatgatatggaaaaacaaacaagaagtgcacgacgaaaagaaaagccaaaagcgaaccaggcagattcgaatttggtgcttgacctgtttctaaaactccgctatcttattggcgttttagtcatcgtggtcatcgttacttttaatttaaacggaagttcacttggtgtttgggataaatatgtgtcgcaaagagacgatgggaaaaaaactgatgtgatttttggacagaatcgggaagtgcggtcagacgaatggctggtgcagacacctttttacctctcacaagctgaagaggactttccgttggtgaacgaggattattcattaaacggacaaaacatgatcattgcgtataattctcctgtaaaggatattacggttatcggaaaaccattcaactggggattctttttcctcggaagagatcgaggactttccttttattgggcgatgaaattagtcgtcatggtcttgcttggattcgaagtactgatgatattaacgaagagaaaaaaagctctatcgctaatcggtgcatttgcgctgacattttctccagcagtccagtggtggttcatgcaacatgtgggcgatttgattttctttactttgggactgatgactgctttttatcattatttctacaatcatgataaaaaatggctacgaacgttgatgatgcttttggtggttattttcggtattgggtttattttagtgatttacccagcccatcaagtgatgctggcgtacttgctgattttttattttgttggcctgcttatttactatagcaagaaagtttcatgggatctgttggatgtagtgttgattggaggggcagttttatttattggcggagtcatggttcatttctggctaacgtcaaaagacgcattgttagcttctttgaataccttatatccaggaaaacgggtaagtactggaggaaagtggacgattggcgaatttttttctttccttacaaattggaaaattccttttgaagatatcaactattcgaataactctgaagtggccctgttctatcacttttttccaactgtattcctagcaagtccatttgtgttatttggcaaaaaagatagcgaacaaaagttactgggacgtattttgatgattttttgtctgttttctatcttttggattaccgttgggttgccaaaatggctagcagaaatcactctgctgtcttatgttcctccattaagagccatccttacttttagttttgcggcttgtttattatcgatctggtttatcgcttatatttggagagaagatgttattcctatttggtataaattcattttgttggcagtaaatgcatggtcttatttctatgcgattacgcattcgaaaatggataattatttttcggattttgaaaccatcgcagttgctgtgttgggaacagtgattttagcttttgcattatttggctggagacgcttgttttacctcgcttttgccgccttagttatcgtatctggctttttcgtcaatccagtcgtagaaggtacaggagcgatttttgaaaaaacactggcaaaagaaatccaaaaaatcgatcaacaagatcctggtaaagtttggttgtctgaagatgaattatataacttcaccccaacattgggagtgaaatccttcaatacagtacgcttttatccagatatagctgcatggaagaaaatcgatccgaaagaagaatacgagaagtattataatcggtatgctcatacaagagcttttatcgctaaggaagatacaaagttcattttagatcgtccagatatgttttcggtcacgttgaattttgaagacgcagaaaaattagggatcgactatgtgatcagtaaacgaccattaactgattacaaccaattatatgaagcgcagttcacgcagctatatggaccggataaagacggttatatgatttttaaagtagaatatccggattatccagatgtaccacaaacacaaactcaggaaaatcagctagtcgtacagtaataggctagctgagaataatcctgaaatgttagtagaaaggagagtggagataattcaagcaatcgtacaaaaatttgtcaacaaaatgagtgtcggtttcttgcttttgttactgacgctagtcttttttgtttggacagcagggttaggttttccagcaactttgtttatatataacaatagttcattacttatcgcttttagtgtggctattttgctcattttaaatgtttataaagcaaaaggcgtcgattttctttatctaggtgttgcgcttgcccttttcattttcttttcttactttcgggaattaagaaatgagtctttatttggagacttactgtttcctttgattattttattttgtttagtaattaaatggatcgagtggacaaaatgggatcgcggtatttatctgattgtcttttcggtcttcctcggaatcacgttatatcgtgtatttacagagatccaagtaccagaaggacaaagcatctgggctccaggcaattcgctttctgatatttggatcaatacgaatacaatcggaagttctttgatgactcttgctttattgatcagtggatttgccagttcttttgaacgatggtatgtacgaatcatcggtgcagtagcagttgttgcagcttttctcgggatttgggtctgccaatctagaggtgcattagtcgcgttgattgtttttgcgatattggatcttttacctaaatcgttgatgcgtgtcattcgtgcgccatttattgcttacacggttacgattcttttagctttgccgatttcttatctggcggctgtctctgaaaaagtcaatttgtttaccggtcgagaagatatttggcataaattctatcagacgctaggagaaaaatctgaacaaattttactaggaatgaaaacatttatcttccaacgaggaaaccaatttttaggaaaccacaatagttataattctattttgaatatctatggattgataggatttgggattgctgctttgctgcttatcctttttattggtcgcttaacgttgaaagcagatttatccaacgggcagatgacttttatctgggccttttttgcggtgatgatgcagtcatttatggaggatacattgacttcatacccatgggttccgattatttatatcctgttggctatggccgttcatcgatatgatgaaccagaagttgcggaggaattctatgttatggaagaggcatatgacgatatgacttatgatgatacatcttatgaggaacaaccagatagcgctcattcttccaggatccaacgctatcattgataggcacaaaatacgagagaggctgtgacaaccgtcgcagccttttttggtttattgcaattgtctagcatcttctgtaaaatagaaacgttagagaaaatcttgtatcatagaaaattaagaaagaaataagaacgcagctcggtaccaaaaatatggtaaaatggcacttgactgtaattcactgaaaatcgcttggaggaacacaaatgtttaaagatttgtatttatttatgaaggacatttatcagaacagaaaattattgctacagttttcgatcaatgacttcaaatcaagatatgcaggatcgtttttaggaatcttatgggcgtttatcaatccgctatttactgtattgatttattggctggtatttggtgttggactgaaagcacaaatgatcgatgcaaaatacccatttatcgtatatttagttaccgggatgattccctggttcttcttctcagatgcatttgcatcaactacggttgtttttcgggaatatacttatttagtaaagaaagtcgtattcaatattcgtatcttgcccacgacgaaaatcctatccaatctgtacacccatttattcttcattctgattggcatagctgtcgcgcttataaatggtatatatccttcagcaatgtctttacagctgatttattatttattttgcatgtgtgctttcttgacaggattgacttggctgacggcatcgatccaaccatttttacctgatatcatgcaattaattacgatcgtgctgcagttgatcatgtggacattaccgatattatggagccctaatcagtttgattcaggtcttgtaagcatattgaaattaaatccgctgtactatgttgttcaaggttatcgtgagtcatttttaagtgaagcttggttctgggagcatggaacatatactttgtatttctgggttttcacgttagtaatgttcgtaatcggctctgcagtgttccgtagattgaaaccacatttttcagatgtgctgtaaggagaatagctatgacagaatatgcaattagactaaaagatatcacaaaatcttataatatgtacgcaaaaccttcggatcgatttcgtgaagccctcaatccttttaagaaatcctatcatgatgtattttatgcgttgaaaaacgtgaatgtagaaataaaaaaaggtgagatgatcggtttcgtgggagaaaacggatcgggaaaatctacaatgttgaaaatcattacgggagtactgacaccaacatccggcacgatggaaatcgaaggaaaaatctcagctttgctagaactaggatcaggattcaatcctgagtattctggctatgaaaatatctatttaaatggaatggttctaggattttcaagagaagaagtcgatgaaatggtcgatgatatcattgaatttgctgacatcggagaccatatttatcaacctgtaaaaacttattcaagcgggatgttcgttcgtctagcttttgctgtagcaatcaatgtgaatcccgatattttgattgtggatgaagcattggcagtaggcgatcttgaatttcaactaaaatgtatggaaaaatttacagaaatcaagaactcgggaaagacgattttattcgtttctcatgatatcagttcgattcgtcgtttttgtgatcgttcctattggttgaaaaacggagaagtcgtcgaatatggcgatacgatggaagtaacgacgaattatgaaaactttttaaagaaaaaatcagttaaaacagtggatcggaataaaaaccaagtagaacggttcgccgctccagatatcgtcgacgtgacgaaagcggaattgttggataaagacaaaaatccggtggatatgctggaacaaggagaaaaactatacgttaaagtaacttatgaagtaaaagatgatacaatcaaaaatccggttttaggaattgcgctacgaacagtcgacaatttttatgtatgcggacttaatactctactagatggtatcaagattccttggaaaaaaggagagaatatcttttatctggagtatgaaaagttaggtttgttagctggtgaatattattttgacgttgcggtctttgaagaaaatgcaacggttcctttggtatataagacaaagtacatgaacttgtttgtcagcggttcttatatcggagaaggcatcgtggtcttagaccataaatgggaagaagggactcatagcaatgaaatatgattttgaaatggacctagatgaacaaagcagtgtgggaaaaattgccgcacagatcaaaccaggaagtaaagttttagagtttggtcccggaaacggccgattaacgaaacatttaatcggagcaaaacaatgtgaagtgagcattgttgagttagataaggaattgttcgattttgtcagcgaatttgctcaagatggattttatggtgatatcgaaagttttgagtgggcaaactattatgctggacagacatttgattacgtcttgtttgcggatgttttagaacatttggtagatcctggaaaaacattgaagaaagtcagagaatttttgaatgaagaaggagagatcctgattacattccctaacttggcgcataattctgtcatgatcgatttgttcaataaccaattgccgtgggcttcttatggtctcctagatgaaacccataattctttttatactcatgatggcttccaaaaagtttttgaaaaagcgggattattcattaatattgaagattatttgtacttagctgtaggtgatacagaattaaaatcaacttatgaagaattgccggaagctgtacgctatgatttcaaaatgcgaccatttggtgaagtctaccaatactttttctcattgatgaaacatccagtagcacaaagttccattgcagagccacaaaattctaattatgtaaaagtgttagaagtaacccagcaaacgaaacaagatgaaacaatccaacaaataccattcaataatttcacaggggaaaatgagacactaagtttccccgtatcagaaacaacagaaagaatggtgtttcgcttcgcgcaacaacctagctttatcgaattcagcgcagaagctgccggagaaaaactaacatttatcgattcgaatgctgtagtcaaaacagtaaatgattgttatttgtttgatgggaaagaattaccagagttcgttctaacggatatttctgggaaagaagtgactatccattgtcactatcgctttatcggggaattgacaccaacaatgaaagaattgttggaaacgattcgtcccatggctgaagtcacaaagcagctttctgagaaaaatgacgaattagaaagagaaaatcatcatcttcttgaggaaaatacaagactagaccatacgttaaaaacaaccacaaatcgctattgcacattgttggaaagtgatgaatggacaataaaacatagactaggacgacgtaagaaagaaacttcgaaaaaaatccaagaaaaagaactttctatatgtattgacgagaaaatctgggatgcagaaacaaaaatattaaaaatcatcggatggggaatcgctaattcggatcgccagcccttgtcctataagttatcagctgaccaatcgccatttttcgaagcaattcctgtttcacgagaagaagtcaatcaagcagaacagctcgcaaaaggaacagaagcgggatttgagttacgaatcctttgcgagcaagaacgttcattcttagtggaagcagtagctcaaaatggccaatcatggatcattgaaatgtaaataatgattaacttataaagataaggagtaaacgaatcgtgcaaaaaaaagaaattgccgtatttatcgatcaaatcactcgtgaacgggccactggcgatttgcttattgtgggctgggcaattgatgaagtgaccaaagaaatccctacgataaaggtagaaaaagaaaatgtgattgctgaagcaacacatgtcgtaagattggatatcaatcatttatataatcttgatgttaagacccaaagcggtttcaaggtacgtttatcagggaaaatgagaggaaaagccatcttagacttccaaacagcgagacatcaaaatggcatagctgtgaaattaaacggtaaatacccttatgatgacggcattgaatcttcatgggaaagaaaaaaaagattactgaaaaaagggataaattatgcaaggactcatggcgtaaaaaaagcgatccgtcgggtcaaattggaattgaagccaggatcgatcgactatgcagagtggatcagtcgtcatgagaaaccagatttgaaagagcaaaggaaagaagcacaaggatttgcgtaccgtccattgatttccatacttatgcctgtctataacgttgaaatcaaatggctcgaaaaatgcattgattcggtactggatcaaacgtatgatcattgggaactatgtatcagtgatgatgcttctactgatccagctatccgaaagtgtctggaatcctatcaagcaaaagatgatagaatcaaagtcgttttccgaaaagaaaatggacacatcagtctggcaactaattctgcattggaaatagcagaaggagaatttatagcactcttagataatgatgatgaattaccgccatttgcattatatgaagtggcaaaagtgctaaacgtacatccagaactggatgtgatctacagtgacgaagataaaatcgatgcagatggcaatcgctttgatccgcatttcaaagcagactggtcgcctgatacattgatgggaaataattatatctctcacttaggcgtatatcgaacaagcattgttaaagaacttggcggtttccgtaaaggctatgaaggttctcaagattatgatttggtccttcgtgtgacagaacaaatccctgcagatcatatttaccacattgaccgagtcttgtatcattggcggacgatcccaggatcaactgcaagtaatggcgaagccaaaagttatatctatgattccggagtgaaagcattgacagatgccctgtctagaagaaacatcaaaggaagcgtacgtcctggcagaatttctggattttatgagattgcttatgacgtcttgcaagaggatttggtcagtgtgatcattccaacgaagaatggctatgaagatctaaaaacttgtgtggattcgatcatcgaaaaaacgtcttattcaaattatgaaatcattattgcggataacggaagtacagatccaaaaatgcaagaattatttgcagaatacaagcatcagctgaaagaccgctttatcgtagaattgattgacattccattcaattattctcgaattaacaatttagcagcagaaaaagcaaacggcaaatactttttattcttgaataacgatacagaagtgattgagccagattggatgacggtgatggtttcttatgcacagtttgatcgaatcggctgtgtaggagcaaaactgttttatccagatgatacaacgcagcatgcaggagtattattaggaatcggtggtgttgcagggcatgcattgaataactatgatcgaacacattgtggttatttcggccgattggtcattgacgtcaattacttagcagtcactgcagcttgtatgatggtcaaggcagctgacttcaatgctgttaacgggtttgatgaaacattagaagtagcattcaacgatgttgacttgtgcttgaaagtttatgaactgggtcgttacaatgtctatgcacatcaagcagaattgtaccatttcgaatctaaatcaagaggttatgaagatactccagaaaaacaaagacgttttgctggtgaaatcaaaaaaatgcaagataaatggccagcatatattgcgcatgatccattttacaatgataatttaacaaaagaaggaatcggcgacttttcgttgagaccagattaaactataataaaaagctgttatgttgtgattcgctcgcacataacggctttttatagttttttgtcaaaaaaaggcagaaggtgccgactcaaaaaaataagtcgaggttgggacagaagtgtttaactccgagaaataagaagaaattcacgaaaattgcttttcaaatttttgtgaatttcggcttatttaagaagaagttgcttctgctcccaccgtttattcgtttttaaagaatgagacaaaagtgtttcttacttttgtcccacgctcttattcatgctcagagcgccaatagatacaaaatcatagccaaagtttcacgaaccctagctgtcaaagaatcgatattttattttaatataggctattttaaaataaatggtttaaggtattcctctacaaaagccactctatcaattatcatgggtttaaaataagaagtgatggagataaccagattgttcttagcgtcaatataaagaacatttccactattaccaattgctgaatatatttcgttctcagaatctaatacccaccataaatagccatatctcatattttgtaagtcttctaaagcactggttctaggtttgaacatctcgtttatccacatgggtggtacgatttgttttcctttatacatccctttatttaggcataatacaccaatttttgccagatcacttgccgataaacacaaaccatatcctgccgtcccgatatttagtggatcacaaaaccagacattggttttaggagacttatccattgtaaactgcttatgttcttcagctgtttcagcataataattgacatggtttggtatccctataggatcaaatagatacttattggcaaaatcaacagttgttagcttacttgtctgatacaacaagccagttaatatgtgtaaacagacagtttgatagttgaattcgccggttataccttttcttcctcccaataaatctagtgatgtttttgtccaatcttcacttgaacagacttttgtccatggatcgcctttacatttgtagggtgctttcattgttagcaagtgcttgattgtaatagcgtaaatagttttctccccgcgtttcactttatactctggaaaataatctaatactttatcatcgatacttttgattaatccttgctctaaagcaatgccaatcagcaaagatacaatacttttcgttgctgacatgatatgacaagtatcgtcttttttataaccattccattcatctgtataaacttctaccccatccttatatgcgacaatttgacatatatttggttgtcgaaaaccaataaaatcatgcaactcttgtttattcataagatattacctcactttcttctataagcataatgtcattaaaaatcgatttcaattttttcgattcttcacgtaatacaggtattcttatggactagacagcgctttgggaagatggattctctgaaaaatataaaggttcactttatgagtggataaaaaaagcagcaaatacttcgacttctttaatttaccaacattagtgaaaatcgattcatctggagatttgtaatttagagtccttgtcttgattagaggtgtataaagctttttattagacatttttaaattccattacaatttgcttataaactaggtttttaaaggtgactatggtaagataatagagatattattttgtgattaggagtgtatatatgaataaaaatggagaatggagtgctgcacgacggatattcattatattaatggatgttattgtatacaatgcagcaatatatagtagtttcttactgaagtttcgtggagagatcccattacgaaatttagaaactttccaacactcagcaattattatttcagtgatttttattgcgttgaacattttgttgggtgcatatgttttttataatcgaatgatcagtgacatcgtgtttgtcacagtcatcggtcaggtattgatgacactagggatcatggtagtgacttttgcgggccgctggtttgcttttccacgtcttgttatcttactttcatttgttctcggtacgcttttcttaagtatctatcgtattctcgtatataaactttatttacgcgtaagtcgagataaaaaggtcgtcattattgggttagaaaaggatgtcgcaccagcaatccaaaattttggttcaaagaaaaacaacaaacataaagtcgaagcagtcattcttgataactattatgcaaacatcaaaaatatgattaaagacatcgatattgtctatcttgcttctcatatcgaagaaactgaaaaaatcaaaatctatcaattagttactaaaaatgaaaaaaaattgtttttgaatacaacatttgaaaacttgacattgatcaatccaaatattatgaatttcgaagatgaaagtattattgaagcatctggatttagaatccaacctgaatatgaactattcaaacgtttgtttgatatcatcgtttcacttgttttattagttattgcttcaccatttatgttattcacagcaattttagtcaaagtgacatcaccgggaccaatcatctataaacaagtgcggatcacaaaaaatcaaaaggaattttcaatctataaattccgctcgatgaccgccacagccgaagcaaaatctggaccagttttagctaagagcaatgatgcacgagtaacgcctgtaggtaaatttattcgagctgtccgctttgatgaattaccacaaatcttcaatgtgctgaaaggcgatatgtcgatcgtaggaccacgtcctgaacgtcctttcttcgtcgatcagttcaatgcagaaaacccttattactacttacggcataatgttcgtgctggtatcactgggtatgcacaagtctatggaaaatatgtctctgattacaacagtaaattacgttttgatttactttatatcaaaaaatattcattgatgcttgatttaaagatcttgctgcaaaccatcaagatcctatttgataaaatgtcctctcaaggacttgaagaagacgaaaatgtgatctcattggcagaaattgcttttccgaatgaaaaaatctttcgctagttgggaggcgtaaaaatgaacaatccgaaattcagcataatcgtaccagtatacaatgcagaagcaactattggtcgaacgattgatattctaaaagaattggattatgaagagtacgaagtcgttttagtaaatgatggatcaacagatcaaacacaggaaatcattcaagaactgattgaaaatgatgaacgttttgaattgattactacgaccaatcaagggcccggattagcaagaaacgaaggaataagacagtcaaaaggagaatatctcttattcttcgatgcagatgacacgccagtaaaaacgatcttgtcagattatgatcatttgctagaaaagagtccaaaagcggatcttgttgttagttcgtttgtttttcgtacaatggacgagggaagaatcgtttccgaaaaagaaaacttagttacagaatgtcactatctaactcacgaagagtttataaaagacatgtatcagttaatgaatgaacagttgatgtatgttgtatggaacaaatgctatcgtagcgatattctgaaaaataaccaaattctatttaaaacttataatagttgtgaggatcgaatatttaacttacattattatgaatactgtcatcaagtgatcatgaacccaaaagtagaatatatttatgaatttgaaggtgggaaggggatcactaatcaataccgacctaacaagttcgaaacatttaaagaattctattcattagcaaatactgtaacagacgatattaataaagacggtatggcggcgcttcttttaaaagggacaacttcagttattttttctatttatagtacctctgcaagaacttcaaaagagaagaaagacgaagcaaagcagatattgagtgatccagtgatccgagaagccaagcaaattgctaagacggattcttcagcaaaaaaaataacaaagttgctttacaatatgccagctccactatttttatctgctgtaaaagttggaagcttcgttgaagtgaaaatgccagggttaatggctgctttgaagcgagtatattagttaatggaggaaaatataatgaaaagaattttgcattttcagggacgaatgggtttaggtggagcagagtctttcatgatgaatttatatcgtaaaattgatcgtacaaactatcaatttgattttttgatttatgaagattatgcagatgttcaagactatcattcagagattgaaagattaggaggccgtatttttgttgtacctaatcctaagaaaaatatttttaaatatttaatagaagtgaataagttactaaaaaaagaatctttttctatagttcacaatcaggtttattttggcgggggaattaatttatggttagccaaaaagaatggaatcagacagagaattgctcatagccatgcaactgaagatggaaaatctcaaaatattgtaatgaatgtattgcgtaaatttttaaccaaattgttgttacaaaatgcaacagactaccttgccgttagtcaagaagctggtgaaagtctgtttcaaaaccatccctttgagatagttcataatggtattgatttagagctttatagtaaaaattcagaagctaaggttaataagagaaaagaattggatatctcaatgagtacttttgttgtgggaaacattggacgattagagaaacaaaaaaatcaatcttatttgttagagatttttttagaaatactaaaaatgaattctgattcttacttgattttagtaggtgaagggtcacttagaaataaactgaaagccaaagcagtagaattggatatagagaaaagagtaaaatttttaggagaaagaaacgatattcccgagttattatctgtgatggatgtttttgtaatgccttctctttatgaaggtctgccaatggttggattagaagcacaagcagcaaaattaaaattagtcttagcagatactatttccaaagatacaaagttaacaaataatgtggattttgtatcattagatgaaacaccacaagaatgggcaaaaaaagtaataaaagagccgtatgctaataaaataacacaagaactaaagagttatgatgtttcgtacactactgaacaaatggagagtatatatagtagagatcattaaaaatgttcaagatattttaggagtgattatttttgaaaatatgttatttgatattggcatacaatgatattggcaacttaaagagattggtcaatcgattgaacgaaaatgcagtttttattattcatatagataaaaaaactgatatagaaccatttattgaagcatttaaatcatatgataatgttgaatttttatgtaataaaaaccgtgttaaaatttattggggtggtttttccattgtacaagcagaaatcaatttagtaaagagagcattacaaaatgagaaatatttaaaatatgtattattatctggtgctgattatccaatcaaagataatgagtatatttataattattttaaaaagaatagttcagtggagtttattcgtggaatagatctagatcaaattaaacataaagaattttattataaacatatagatgtatatcaaaaacatgattatcctagaattaataggaataacacaactgcatttaaaatttttagagctataattaatcgttgtctgaggatgattaaacttcccccaaaaattagacaccataaatttgatttgtatcatggttctcaatggtgggctttgtcgaaagaatgcctaacagaattaatacaaatgtatgaacaaaatcaacaagactacctgaattttaaaataggtatgtttgccccagatgaaaaattttttcatacacttttttttaattcctcgttcaaaaataaaaatgttattggaggaccagatttaccacttgaattgaaaaatattgaagaaactactttacaaacttcgaaattagcaaatattcatattattgatccttccatgaacaaatggtttgatgaaagggatatagatcaaataaaagaaagtgaaaaattatttgtaagaaaagttaaatcggattactctgataaactattaaatagaattgataaagaaattttgaaagttggaaatatagatgaatagaatagtacctgttttagagaagagtttattaagtcgagatgcgtttcgagtaataaatttaatcatttgtctgctttattttatgcctagtacttttaatgtaactaatatcccgatgaaaatagcttttgcttggggtggaattatagttttgtatgaggtttttataaagaaaaatttttttaaaatgcgtttttcttggctactgattggagcaatgattagttttatcttaactataatcattaacagagaaaattttttaattccatctatttataattttggatatttgctgattactttgatagtaatttttcctgcagacttttcacaaagtgaagaggaaaaaaagaaaaaaatggtgtattttaataatgttttcattatcataatttttttagctgcgctaatatctatctatcaatttatttttttgatttcttatcatgtcccaacaggaacgccaggattacttgcaagacaaggttttattgaacatcggttatttggtgtctatacaagtccaaatgttggagctatgtttggatatacttctattattttaagtttaattagtgtattaatttcaaaaataacaaaaacgattcgtgttttttatatgatgaattttatcgtacaatattttatattacactttcttcgtctagaggtgcccaggtagtaatttgttcttttttagtattatttcttttgttgtttgccaattcaaaatttagaaagagcattagagaagtactacctgtaaaaatcaaatggatggtaagcatattattagttctattggtatatttttcttttggtactaattatgctaaggattttttagcaacaattcctgtatcgattgatagaaaagtagaagttatagagtcaaatgaatcagataaaactccacttccagaaaaagaagtaatattacagcattctagtgataactccgaaatttcagctggtcgttttacgatttggaaagctgcgcttaaagttataagaccaactttgttatttggttatggagagaccgatttctatgggaatagcgatgcaaaatttttgaaaaaagtagatcttgatactacagatgtgaatgaactaaaaagagcacatggaaacatgcataatggatttcttcaagtacttgtatcaagtggtataattgcttttatatgtatctatgctttctatgtgttaaatatctttagtttactcaaaacattttttagaagtaaagtgaattatgcgtttcttggtattgttttaatttttatactatctatttttatagatgaaatggtggaggctcatgtacttttcaataagcgcgatgtcatttcaattgttttctggtattatttgggaagcatttcttacttgtatttaaaaaaggagaattaatatgaagacagctttcattgcttggactcctttacatttgattaatatattaaatgtttatcaaaatttttaccgagaatcaaaaggagatttatttatttattctgaatttgaaaacgctagaagatatagtgagcgtataaaagaattagggctatttaatgatgttgtttttgtgaatcaccggaaaatcggttcttcctttaaacgtaaaattaacttgttaactaaccataatcaatttttctcggatgatttatccgtttatgatgaaatttttatacagggggaaaattatttcacaaaaatacttttctccaatgtttacaaaaaaaatccagatgtaaaactaaattatatagaagatggtttgggtacttatttgaagaagagtatattttcaacaagtaaaaacgttcaaagagtttttaaaatattaaataaaaatagcatcttcaaaaaaaaaattgacgattattttgtctattgtccggaattgttactttatgatgtaaaaaatataaaaaaaattcccaaaatagatgaaaacagtaaattgatgaaaaacatacaatcaatctttgggatagaagaagtttttgtcggagataaatgtatcttttttgatcaacctttattatctgatggttatggcatagatgaaacagatattttcgctaaagtaaatagtatattttctggaaaaaaagaaactttaattaagcttcatcctagagcaaggacaaatcgttatggtgaaaaaaacatattgaattccagtttaccgtttgaagtcttgctacttgaaaatgacttctcttcaacacttttgattagtcctatatctacaatttctttttcaccatctatgatgtttgaaaagacgatcaactctattatgttggctaaattaattttaaatgaatatacagcattatctgaagataaaaaagaaacattgacaaatattgttcttttctgtgaacattataaccgtctatcagaagaaaaaattttactcccagaaaactgggcagaattaagaaagttggtagagtatgggattatttaacacactttccaagtcaaaattagttaagtccagtttctggtatactatagggaatttttttattaagggaatttcattcataactattcctatttttgtaaatattactactcaagcagaatatggtttgattaataatttcacttcatttgtatcaattttttcgattcttgttgggctaagcctaaattcggcaattaataatgcaagttttgactataaagatgacataaatgaatttatgtcatcggtactttctctagctacactttcgttaattgtgttcttattaatagggaacatatattttttgttttcaaatgctttttttgatatgaaccaacttgtatttaatttgatgttattacaaagttttgctagttttgtaattagttatatccagtcttattttacgattaactttaaccattttaaatatttgattttatcttttatatctacttttttgaatattgcaatctctgtagctttgatgcagacattatattttgatgataaatatgttggcagagtagtcggcggaacactgtcatttgtgttgataggtttagtaatttatttaagaataatgataaagggtgctcatttttttgataaaaaacagtggagatacgctttaaaaatctctttgccgctaatcccacattccttagcaaatatagttttagcacaattcgatagaattatgattaattcttatttaggtcctgctgcggggggaatatattcctacattagtaacataggtattattctaagcgtaatatggatgtctactaataacgcctgggttccatggttctatggtgagatgagtaaaaataatgaaaaaaaagtgaagaaagttagtaactattatttagtagtctttactttgattacgatgattgtaatggtagtttcgattgatttagcaaaatttatggctccgaaagactattattctgggttatctttagtggttccgataaccttaggctatttctttcagtttttatatagtttaccagttaatgctgaattttatgagaaaaaaacatcgtttattgcgattggtacagtagcaagtgctatagttaatatactattaaacatgattttcatacctaggttaggaataattgctgctggatacacaaccgtatttacgtattttttactttttatttttcattataatatcgctaaaaaaattacgaataaacaattatttgacacaaaaaaaatatgtatcataataatttttgtatcaattttttctttgatacttcatattttaatcaatcaaatgttgattcgttacgttttgacatcattattgataattagtttagttatatattttttaaagattaagaatcgaattatagatgactataattcataggaggagatataagtgtttaaaggaaaaacaatattagtaactggcggaactggttccattggaagtgaaattgttcgtcagcttttaaaatatgaaccaaaagctatcagaatttatagtagaggtgaagaaaaacaattttatatgcaacaagagctctcaaatcacactaatttgagatttttaattggtgatatcagagactctcaaaggattgattatgcatgtcgtgatgtggatattatttttcatgctgccgcaatgaaacacgttccagcaagtgaatataatcctatggaagctgtaaaaacaaatgtgatgggaactcaaaatgtaatagatgcagcgatcaaaaataatgtaaaacattttgtaggtatcagtacagataaagtagtgagtcctactaacaccatgggtgcgacaaagttattgagtgaaaaattaataatagctgccaatcagtataaaggaaaaacagaaacaatattttcttgtgtaaggtttggaaatgtcatggggtcaagtggatctgttattcctctttttagtaaacaaataaaaaacaataaagatattactttgacagatgttgatatgacacgatttatgatgtcaataccggatgctgcaagattagttctgtctgctgctatgaattcaaaatttggagaaacatatgtcttaaaaatgccggcaatcaatattttaactttagctcaatcattaataaaaatatataatgatacacatgatgaaaaatatagaggtgaaataaaagttgtaggtatcaggccaggagaaaaattatatgaagagctaatgactacagacgaaattgaacgctcatatgaaaatgataaaatgtatatcattccaccacactatcatgctactgacgaactgtacaaagattatgaaaaaattaaaatcactgcatactcttcagatgcaacagaattaatgagtggacaggaatttattagaatcgcaaaagagaataatgtcgtgacttggtaaggagttttatgatgaaatcagaagtatatgtaattgcagaaattggtgtaaaccataatggaagtctagatttagctttagaaagtattgataaagctaaagaatgtggagctaacgcggttaaatttcaaacatttaaaacgaataagctagtttccaaaaaggctccaatggcaaaatatcagaaggataatcttaaagaggacagttctcaatttgaaatgctaaaaaaattagaattatctcaatctgattttattagaataaaagattattgtatacaaaataaaattgattttttgtctactccttttgatgaagaaagtgcagactttctaaaacaaattggtgtacaaggatttaaaattggctcaggagatttaacaaatttaccttttcttagaaaaatagatatgtatgggttgccagttttattatctacaggtatggctgatattcatgaggtcagtgaggctgtagattgtttcatagatagtccagttactattttacattgtacttcaaattatccggctagttctgaagatattaatttattggcgattaacacattaaaagaaatgttcgggatacccgttgggtactccgatcattcattgggatatgatgttggtatttgtgctgttgcgatgggtgctaaggtaattgagaaacattttaccttggataaggaactacctggtccagatcataaagcttctttagatcctcaggaatttgcagattttgtaaagcatattagaaacactgaaatatttttaggtgatggtgttaagcgagcaatgccttctgaacttagtacaaaagaagtatcaagaaaaagcctagtggtcactgagaatttaaatgtgggagatattcttacagagaaatctcttacaataaaacgtcctggaaatggaatagctcctaagtttttatatcaatatattggcaaaaaagttaaaagaccaataagtgcagatagtgttctgcttgaggaagatgttgaatgaaaaaaatacttatagtaagtggaacacgagctgattatggaatatataaacctgttgctgagaatttactacaagataattgggatgtatcatttgttgtttctggaatgcatttatcccataaatatggatttactaaagaattgatcttagctgacggatttagaattagtggagaagttcaaagtttgtttttagagaacaataagggaaacatggctcggtctgtggcattagagataaatggtttcacaaatatatttgaacaaactagccctgattttgtattattactaggggatagaggagaaatgttggcagctgcgatagcttgtttgtatcttggaatcaaaacagcacatattcacggaggcgaagtgtctggtactgtagatgaatcaataagacatgccataacgaaaatagcatctgttcattttgctgctacggaaaaaagcaaagagcgtttaataaaaatgggggaagattcttggagagtttttcccgtcggagctcctagaatagatactattttaaataatagattacctagttttagagatataaaagaaaaatatcatctaaaatttgaaaagaaaaaatacgttttgcaagtatttcatccagttgtaaccgaactagaaaatatagaaaaacaaattttagctttgatcaattcaatggaacaacaatctcaaccaattatttgcattttacctaatagtgatgctggtagcgaaattatcagaaaaatgtaccagaaatatttaaaaacggatattatttatattacgaatttagagccggaggaatacctgactatattaaaagagtgcaaatttatgatcggaaattcttcttctgggataattgaagctgcatcattcaaaataccagtaataaatttaggaaccagacaaaatggacgagaacaatctaaaaatattataaatgcaaatctaaatgaaaatgaaattgaaactgctttgaataaaatacaagatcctcagtttataaaaagcttgaaaaatgttaagaacatctacggtgacggcaacagttctagaagaataacaaaaacattgaatcaaatattgaatgatggggaagatattaagtggattcaaaaacaaatagcttattaaaatatactagtgatccatacattattattggggctggcggacacgcaaaagtcattattgaaaccttaagattagaaaataagttaatatatggattttttgatgataagcaaaataaaatgcaagatctgaaatatcttgggaaaataaacgaattgaatagctgggcggatagcaaaaaaaaaatctataaatttattgtagctattggtgactgtgtagtaagaaaaaagattataaaaaaattgaatatgccaagtgagcaatatggaatagctgttcatccaagtgctatagtggcaaaagaaatttcaattggttatggaactgttatttttgcgaatgctgtaattaacccagatgctgtaattggagagcatgctataataaacacaggtagcattgttgagcatgattgtagaattaataactatgttcatttatctccaggtgtatgcttagcgggtggagtacatgtaggtgtaggaactcaaataggaattggttctcaatgtatccagatgaagaaaattggatcttggtgtatgataggcgcagggagcactattgttaaggatattccctcacattccttagcttatggcaatccagctaaaattaagaaagaaggaattaattttgaattctagaattttattatcaagtcctcatatgggaggaacagaagaaaaatatgttgctaaggcttttaaagataattggatagcgccattaggtgaaaatgtggataaatttgaagaaagtattacaaaatatactggttctaagggcggagcttctgcgttaagttcaggtacagctgccatacatcttgccttaagactgcttaatgttggaaaaaacgatattgtctttgctccttcatttacttttatagctacagtaaatcctattttatatcaaggggctgtaccagtgttcattgactcagaacctaatacatggaatatgagccctgttgcactagagagcgcattagaagaagctgaaagaaacaaccaattacctaaggcaatcatcgtagtgaatttatatggtcaaatggctgattatgaacgaattttagctattgcaaaccaatttaatgttccagtgatagaagatgcagcggaatcgttaggttctacttataagggaatttcgtcaggcttatttgggacaattgggatctattcatttaacggtaataagatcatcacaacctcaggtggaggagctctagtgtctagtgataaaaaatatgttgagcattcaagatttttagcaacacaagcaagagatcaagcaccgtattatcaacatagcgaaataggttataattaccgtctaagcaatatttctgccggtatcggacgtggacaaatggaagtattgaatgatagagtagctaaacgaagagaaattttcaatcgatataaggaagctttttctggaattgatagaattgaaatgatgccagaagtggatggcatggtgccaaatcgttggttgtctactttaacgatcaatgattataattctattgatcaagtagttaacgtaataaataaactaaatgaaaaaaacattgaaacaagagctttgtggaaaccactacatttgcaaccagtatttcaaggggtaaaaatgtattaccatgataataatcttagtgtgtcagaaaagttatttaatagcggcttatgcttaccttctggaagtaatatgacagatagtgaacaagaatttgttattgatgagtttaaaaaaatattcaagtaggtgtgatattttatgaacataggaattattggtttaggttccatggggaaaagaagacttagactcattcaagaacactttaatgatattttactatgtggtgttgatactaatgaggcgagacgaaaggaagttgaaaaggaatttggaataccaacttataatagtctaacagaggcaaaaaatttgtttgaaataaattcagtttttgtttgtacatcccctataacccatgaatttattataaaagaggctttaaatttagattgtaatatctttacggaaatcaatttattaaatgaatattatgatgaaataatcgaagtagctaaaaagaaagatagattactttatctatcttctacatttttgaagagaaaagaaattcaatatattaagtctaaagtgacgcataataaaaaaatttcttatcaataccatgtaggacagtatttacccgactggcatccttgggaagattatcgcaatttttttgtttcaaacaaaaaaactaatgggtgtagagaaatattcgctattgaattaccttggattatagatacatttgggaaagttaaatcgtttactgtaatgacccagaaattatccaatcttgatattgattattcggacagtttcactcttattattgagcatgaaactggtatagttggaactttaagtgtagatgttgtttcaagagtagctaaaagaaatttaactataattggtgaaaagattttaatagaatgggaaggtaacccggattctctattttcatggaatgaagaaacttctagtatgacagatattcaattgtacgatgaggttatgcatgataataattattcacatactattattgaagatgcatatttagaggagattaaagaatttttcacgcttttggaaaagaaaatggaaccccaatatacttttgaaaaagataagtatattattaacttaattaacgacattgaggtaaattaatgatgaaagtaattttttttgggttagggtcaattggaaagagacatctaaaaaatctaataagctatggaaaaaagaattctattaattttgatataacagcttatagtagcagtggaaaaaaagagtttgaagaaataacgtatattcaaaatagagacgatttggatacacattatgatatagcttttattacaaatccgacttttaagcatctggaaacactaaatgtaattgttgaaaaagttgattacatatttttagaaaaacctgctttttctgagagtattgatcttactcaatataattatgattacaaaaatatttatgttgctgctccactgaggtataaaaatatcatggaagttgttcgtaatagtattcaaagtaaaaaagtatattctgtaagagctatttgttctacttatcttcctgattggagaaaaggtactgattatagaaataattattctgcctttaaatctatggggggaggagtagaattagactgtatacatgaattggattatattataaacctatttggtttccctaaatcagtaaaaaaacagtttggtaaatattcgaatcttgaaattaacagtaatgatttagcaacatatatattgagatacgatgataaaattatagaaattcatttagattattttggaagagttcctacaagaaaatttcaattgtttactttagatgaatgtatcaatgttgacttattaaataataaaataagttttgaagaaaacattgttaaagaaatgcctgaatctgctaatgatatgtatgagaaggagttgaaatatttctttgaaaacgtagtaacaggcaaagaaaactggaatgatttatatcatgcaaacgaagtattgaaaatagctgaggagaaataaatggaaattttatttactatttgtggtagagctgggtctaaggggtttaaaaataaaaatttgaaatatttggcaggaaagcccctagtccatttcgctttagcaatgatagatatctatcaacaaaaacatcctgaacataattgcacgacttgtttgaatacggacagtaatgagttagtagaattgacgactaagttaaatccgtctgtgaaaattgtagaacgtaaacctgaattagctacagatactgtagggaaaattgaagtgatacgtgattcattcttacaactagaaagagaagataatatatttgatttaattatagatttagatttgacttcacctttacgtgaagtttctaatcttgaagaattaatagatgaacatctaaaaaatttagataaagacgtctacttttcagttgtttctgcaagacgtaatccctattttaatatggtaaaaagaattgaaaatgaagttactatagttaataaatcaagatacacatctaggcaacagacacctgaagtttttgaaatgaatgcctcaatgtattcttttaaacctgaatttctaaaaaaaagtaattatatttttgatgggcaatgtgggataataaaaatgagagattatctaattttagatattgatagtgaagaagattttaaatggttagaatttttgtttcctaaatttttagaagattcttcggagcttcaagatatctataattatttatatcggaggtaaaaggatgagctgttatcttatcaccggtggggctggcttcattggttctaccttagccaatcatttaggagaagaacatgtggtaatcgtcgtcgatgacttatcaatgggaaaagtagaaaatcttgatatgacgaaaaatatcacttttattgagggagatgtcgctgagaaatccttgatggaagagatcatgaaagctaataaatttgattatatctttcatttagcagcagttgctagtgtggcagattcagttgcccgaccagtagaaacacatcgtgtgaattttgaaagtgtattaatgattttagaattgatccgcaagtatcaacctgatttaaaacggatcgtgtttagttcttcagcggctgtttatggggatgaaccgactttaccaaaaaaagaagagtccgtgattcgcccattgacgccttatgcggttgataaattcgctgcagaacaatatgtgctagattattgtcatttatatgatgtacccggtagcgcagttcgttttttcaatgtctatggtccaaatcaaaatccgaattctccatacagtggtgtgatttctattctcgtagatcgctataagaaacaaatcgtaggagaagcaacttcatttacattatttggtgatggaagccagtctagagactttgtttatatagatgatgtaatccaagcattacttttagttgcgaatgaggaagctgcactggggaaacaattcaatgttggaacgggtaaagcaaccacacttttggaattgattcatgcaatcaatgaaattctcggtgtagaattgacacttgaatacaaagaagagcgttcgggtgatatccatgactctctagcagatattactaagatccagtcaattggctatcaaccgaaatatggtattttaagtggaatgactaattatttgaaaactgaaatcaattaaaacatactaagataagattagagggtaaattcaggctctttgtcaataaggactgatgagttttgtaaaatcaaatctgggatagaagggctctttgtcaaatgatgttggtaaagagaaatcttagaataatttggacagaacagaaagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcaaatagtgactgatctcttttctttaccgcataaagaatgtcttggtataactgatagccttggcgtaagttgggacaagcagctaacagtcgatcggcaatctcactttcagtcaaataatctttaaaactggcacgccaaacccgtttttcatagtttaactttgcttcttctttttgtaggagtttccaatagcgcttcaatttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaatgaaaaccgagaaaaatagcgttctaaataaggcaagcgtcgattttcgacaatatccaataatgcatggctttgtccgtccatcatgataaaactcattgcactggcaacacttcgaaccgatttgaattcatcaaagcataagacctttggcaaagtctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtcgtaagcgccccatagaacagtaccttactaacaaatgcacctcaagatatacttgagctatcaagaagtctggaggttttctatgtataaattaaatgagattgttcctgtccaattaggaaacgaaaagagtgcaccagaaaaaggtaaacccgcggctgccaagttagcgatgcgcatcaaaagagagaatggttctgaagttttgatctataacggtattaacaattatattcttcaagctattttgaaagaactgttgtccaatgctttatgatttacttcaaaccaaacatatttatattgtgtgcggaaaaacagatttgcgaaaaggaattgatggtcttgccagtcttattcaacaagagtatcaactcgagctttacgaagatgccgtttttttattttgcgggaaccgtcaagaccgtttcaaacttctctattgggacggtgatggttttcttctctgttataagcggatagaaaacggcaagttaaaatggcctcggacgaaagacgaagttcgaaccttaacgaaccaacaggttcgatggttgttagaaggattaagtatcgatcaacctcgagctattttgccaggaaaaaaggagttttttaagctggggggttaacacaaaaaatgtgttgaacccctatttcttgtgcgtttcttgtggtattctgtaacaaaatcagttcgattcaaggtggtgaaaaattttggaaactacagatacgttgcttcagttgcttcaagaagcccataaaaccaatcaagcacaacaacaaaccattcagaatcttacaactgaaatccaactattgaatgaaaaggtcaattatttaaccaacaaattatttggacgctctaaagagactctctttgaggaaacgaatgggcaattgaatctttttagtgatgaagaaatttctgtaagtgttccagaagcagctgccaccattattccagtaaaaggacatcaacgagttgtaggaacgaaagcagacaaaatcaaacacttacctataacagagaaagaacatctccttcctttggaagaacaattttgtgaacattgcggttcacagatgaaagatatcggacggacaaaagtacgagaagaaattcgtttccatcaggctatgttggattgtctcacccattatcaacatacctattgttgtaaaagctgcgaaaaagaaggactttcttcttttaaaaaagcgatcgttcctaaacctttgatttctaatagcttaggttccaatagtttagtggcggaaacgatccggatgaaatttggtcagaaagttcctgcctatcggcaagagaactattggaaacaaacacatgggttggatatttcgagagataatatcaccaattggcatattaaagcagtgcaaaacgcgttagaccctttaggagaacgattaagagtctatcttaatcaagaagagattctacacggggatgaaacaagttatcgtgtgattgaaagtgccaaaacagatacctattactggcagttttgtacaggaaaagacagtcagcatcccatcgtttattatcaccacgacgaaagtcgtgctggagatgttccgaaaacttttctcaaggagtttacagggtatttacactgtgacggctatagcgggtataatgccgtggaaagtgtacgacttgtctattgtttcgcgcatgttcggcggaaatttttcgaagcaattccaaaaggaaagaaaaacacggatattcccgcagctcaagcagtcaaacaattggataaatggtttgtcctagaaaagaaatggaaagacttttctcctgagaagcgattaagctgtcggcaacaagaactgcgtccattatttattgctttttatgagtggatggcaacgatagatcctgttgcaaaatccaagttggatgcagccgttcaatatgcgtgtaaactacgaagtggttttgaacctatttttgaagatggtcgtttagaactcacaaataatcgtgcggagcgaaatatcaaagagctggtgataggacggaaaaattggttgcattccacaagtcttgaaggagcacgaacttcaggaatcattctgagtgtatataaaacagcagaacttaacggattgaatcctgtaaagtatctagagtttctatttgataagataccaaatcttcccgtactttcagcagaaactttagatcaactgttgccttggaacaaggatgtacaacaacatttttctcgtaactaaaaacgccaaacattcccgattctattctataggtcgggttatttgacgtacaggtactgttctatggggcgcttactttaggtctagaatatttagggtatctttgataagctgagtatgagacatcttgaatcctcctatgaattggtagccaaattaattctaaaggatttcagggtgtcttttctatattttttatacaaaaaagatgttggtgaagttcaccaacatcaaaaagtatagagccgatagaaggactgaccttctgtctcagattttttgttatttcacttgaatcaattgattgatcaaaaaaatcctgattttcatgttctcaaatgatttaaatccataagataatcgtttcagtgtcttgatatggggaatcttggcctctattttgccattagaatacgggtaaatcatagcattgtaaataccttcttcatacgttaaaaggttttgaagtttcgtgcgaagttgtgcatcaagtgtttcaggaagattttttaataacgccgtttgtataattaagcgagacaaataaaaaagccatttatgttacactccaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgagcgtaaaaaagattatgtcgttttcgaagaagaatttggacatttagagggtgatacgattgtcggcatccaccataaaagtgccgtcatcacgctcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatataaggtaaaaaataagtctgattccttgtctctaaaggcttcggtcagctcatggaaaaaagtataggcgtcctttaaaggcgttgaaaatgccagcaatcgatcaatcatcattgcttcagtgagtagcgggtatttaggtgcacgaaaactgcgccatgttttgtaatcatagtgattgattttttgacggttttttagaagaaagcgccagttctttttcactttctcggcttcccgtcgttgccctaactggtgtaatcttttcatttcttgtacacgaaaatcattgaacgcctgattcaaatgtttgatgatatgaaaacaatcaatgacgactttcgcatttggtaagacacgttttgtcagttggaagtaggcggcgttcatatctgtcactaaatattccaccgcttcaggatttgcacagcgactaaaatagtgtgttaatcgagacaattttcgtgtaggcaaaatatcaatgagttttccagtctcgccatccgcacaaataaagctcattttatccacaattgaagcgtgcgaacgaaattcatccaccatcaatacttttggcagggtcctttttgacggcttcggaagatagtttttcaactctttcaatgtacgaatcatatacctaaaataacaatgggactgaagaatcaattttgattcatcagtcccataaattatagagcctatattttgcgaattgcgctacggtttcttcttttcttttgtctgtaatatgaatatatagatccataatgatttgaatagaagagtggcctaaacgctcttgcacatctttaatatttgcactagcttgctaaaagcaagctagcatgtgtgtgtctaagaccatgaatagtaattcgtttaagattgtttttcctgatgattacatctaaccattttcgagatttagataattgaaggtgttcatttctttctggtaaaaatttaaatatataactacattttctctactaactttgaaacactacttttgtaatataaaaaatattttattaataataaaattaatcacattttatatagtgactaatctagtgttttaaaaaaataaatgatactatatgtaatataaaaaaacatgaggtggtatatgaatttgaaaaaaattttttctgtaaaaatatttatagtttatgcatttgttagtttattatatttatttccagcatttaaaaacatggaaatatttggcttttatgatacggcatttcacattaatcgtgcgttaagtttagaatctatttttagctcccctattaattttgaaacgtttagatcatatggcatgcaagtaaataatttttacccatggttaactctatatcctttatttttattgatcaagtttactaatttagcaataggctataacctttttctttatattgttacgctcattactctatttatatgtcattatgtaatgtatgaaattaccaaaaaacatgttactagctcctttttcgctattatatatacaacatcttcttttaggagtgtagaaatatttcttcgaggggcaatgggggaattactcgcaatgtcaatacttcctcttattttactcgggtttataaagctttacgactcaaaaaaagaatcttgggttatgttggcgattagcatgactttattaatttacactcatgttctttctgtagctatgactatggtaatgattataattgctttaattattcaattttatcggaaaaagaaaatagaaatcttcttaattattaaattaataaaagctgctatagttactttacttctttcactagcgtttataggtcctatgattgagcagacattgtatcaagatctgaatagaccttatgtggatatattacaaaaaagagcaatttatctgggtaaagagtttttgattggaagtatagattcagaattactatcatttggtattggcttaactttgcttatttgtttaattatactaacatttaactttaaaaaattaggaatcttatctaaaatcacttatataatgggtataatatctattctactttgtacaaaaatatttccatggtttgccttacaaaatactcctttaaatattattcaagctccttggcgttttatgatattttcaacattgttcatatctttttcagtatctctatttatttctccacagttggaaaaattttcttatacaaggagaagaaattttatactattattaatattagctatttcaattttaaattattcatcagtagttaacatggtgaaagaaatgaattttcaaggaacttattctaatgaacaaatggaaaataaacttgaagaatttgagaattttgattatgtacctataggctataaaaaagatcaattgcttttgaaaaaccatcaagttacagaagatggtcaagttatttatagtagcttttctccaaataaagatgaaattacatttacgtttaaatcttcaaaaggcaaaacaatagttttacctgtattccggtataaaggattaacggttactgttaattcaaaaaatgctacagtactaaaacaaggaggtccttttgttacagtaaaaagtgaaagtggaataaataaagtaacaatcaggtattcatacacatttttttctaaaatctcattatttatttctataatcacgctaattgttcttcttttttattgcataaaattaaaaataagaacaagccatgaatgatttgctagcacatattttagcaatctaaagatactattttagatttaataggccctttgtcaaataatgttggtaaagagaaatcttagaataatttggacagaacagaaagaagaacacctctttctgttctgtttatttggaattaaagtctgtagcaaaaattgatttttagatttgtcccacactctttcctacgtttagtcgagtactttttttaagcaaatgctattcaaagaagtagtatttgctatcttttcatcatatcagctatttgccaacttagtagttccttccatcaggtcatagatttggtttcttagatcagcagtaggcagtttgatagttttgtcagcttttatattgctttccatgatgatagcatcctgtgaatctttgctaaatatagcagatgtatcaaaagagtcgatatttccttgcgacaggatataattatctccgctatataccccaccactatatggatgtccattcgcattttcacgccataatgagaagagtaagtctttggaaactagttttccagataaaacttgtgtaaacagcgtatttaaatcatagacggacatactgatattaccagtccctaattcgttatggatctctgtttcagattctgtcagtggtttaaagtaatcatcctctttagacatttgataggatagtgcatgattggatgaatttttgacttggtcataaaattttgtatgctgtaatcctaaaggttcgatgatatcatcggtcaataatttttcatacggttgatttgttaatttgatcaaaattccagtcaatatggtaaagttcaatgaatcataatgagaggtctgataatctgtaaattttaagtgctgaatcgcaaattgaacgacttcttcatcagtcatcggtatggttggagaagcagttcggtgcaagcctgagcgcatatacagcaagtcacggatagtaatttgctggctgccagcaatttgtggatagaattgagccagcttagtatctaaagaaaggtgcccacgctcgacttgttttaaaatcaaaagagtagtcaatgctttttgaaccgaaccaatctgataataaagagaaggatcatttggttgttgcgtgagtttattcgcatagccatagcctttttccatgatgatgcgattatttttctttacgtaaattgagccaatataatcattttttcttaatagttgatcgattttttcaacgagctgttgttcattggtagtcagtatcaactttttttgagctgattgagcatgggcaactatctgagagtgttcattattgtaaaattgccatccaagaatagttcctgtagagaacgcactaaggctaaacaacacgacaacgatcattaaaaatgaatattttctttttttagcatgttttccttttttcataatagtttatttagtctcctttcttttttacagaaagaataaagctaaaatagcttgtatcttgataacatttattttaatcttatagtaatggatttactacttacatttttgatagaatatttaaataaaatcattcacgccaattcaaatatcatgtataatgaataaagttacgaacttgatagtaaggaggagttgttttgtcaggaaacaaacaacacccaagtaaagataaaaaagaagccagtaaggcagctacagcagatataatcgacaagcggagaaatctgcgtaaaaaagaagataagattgtgaggaagatcattttagtgattgctcttacattattgattattggcggatttcttggatttaccgtgtatcgttatgtagatagcgggttgaagcctttagataaatcagatgaccaattagtccaagtcgagatcccgagtggctcttctaacaagcagattggtgagattttggagaaggacaatattattaaaagcgggattgttttcaattattatacaaaatttaaaaatttaactggctttcaagctggctattatcagttagcgcctaatatgactcttgacgagattggcaaacagttgcaagaaggcggtacttctgagccaacaaaagttgcagatgggaaaattgccattccagaagggtacgatatcgatcagattgctgaacgggtagcgaaggtaactggtaaagacaagaaagaatttttagatttagtgaatgatgagactttctttaacgagttgcaccaaaaattcccagaactgttggaaagtgcatctaaagctgagaacacaaaataccgtttggaaggttacttattcccagccacatatgattattacacgagtacttcgcttaaggatctagtgattgaaatggtgaacaagacgaatacggtcatgcaaaactattattcagctatcaagcagaaaaatttgactgtacaagaagttttaactctagcttctctagttgaaaaagaaggcgtaaaagaaaatgatcgtaaaaacattgcacaagtcttctttaaccgaatcaaagcaaatatgccacttcagtcagatatctctgttttatacgcattaggtgaacacaaagaattagtgacgtatgaagatacagctgtagattcaccatataatttgtataccaataccggctatggacctggaccttttgacaatccaagcgaagaggcaatcaaggcagtattagaaccagcagaaaatgactattattatttcgtagcagatacgagcactggaaatgtttatttcgctaaaacttatgaagaacatatggaattagtggaaaaatatgtaaataattcttagaaaaacaggctctagacattgatcatttttagaaaaacatttacatttgaagaaaagcgtggtaatcttttttggactatattcctcaaaagattaccttttgcggtattttatcgaaaaaaggagacgttacacatggtagagaaagtttatccaatgactctagaaggtaaagaaaaattagaaaaagaattagaagaactaaaaacagtcaaacgcggagaaatcattgaacgaatcaaaattgcccgcggtttcggagatctttccgaaaactctgaatatgaatcagcgaaagatgaacaagcatttgttgaaggaagaatcacaacaattgaaaatatgattcgttttgctcaaatcatcgataacgacggtgtagatgcagatgaggtatcaattggtaaaacagttacattcatcgaactaccagatggagaagaagaagagtacacgattgtcggaagcgctgaagcagatccgttttctggcaaaatttccaatgattctcctattgcgcaagcattgattggcaaacgtaaaaatgatgaagtaactattgctactccaggtggcgatatgttagttaaaatcgtcaaagtagaacaagcgtagtctgactgaaagatctagagagttcatcttactgatgatacactctagatctttttctctttgtgtattttagatttcaacaaacgatcttacatctaaagtcctatagccaacagttaaaaaaataggtatgatgaaatgagaatgtgtcaggagggagaaagagcgatgaatagttcttggcgtttttttgtggtagttgaagcactactgctgttatttgctgtttggcaaatcgtaaacaatactggacttttgcttttagtgatattcggtattttcaatatatatctagctatgcgcaaacatcctcgtactaaatttcaaaattttcaattgatattaggaagtttggtcattttttttagcttagtcaacagtcctgctttatggatgatggctgtatttgccgttttatttattggtctgaaaggtgtagagatttcagggatagatttaaccaaaaatgctttttggcgaaagaaacagatcatgatgatccaaacagagcaattaaaaacacataataatgagcggaaaagacagcaattattcggtaaccaacgtattggaaacgacgtctatgaatgggacgatatcaacatcgccgtcatttctggtgatactatcatagatttgggcaatacgcttttgccaaaagatgataatattgtgattgtaagaaaagggataggcagaacacggatcttagtacctttgggcgtagccatccgattagagcatgcgacattagtaggaaatgtcttgtttgaagaagagcaattttctttgaaaaatgaacaaatcaaaatctacagcagtgattatgatgaaaaccctcgtagattgaagattattactaataccttgattggagatgtcgaggtgatacgaatatgatgggaaaaatatccagagcgatgctagctgtttattcggggattgcggctttccttattattctattttcacttttcacttatttttatgccagcaatcaaagtcattggtggggagaattactgcgtgcacgtttattatatgttccgcttatcttccatttgttagccatttccttaggtgtaggattaattgtctttctattattatcacttattcaaaagacaaaatacgggaaaatcgaagaaaagctgcgtgcactttcttctggcaattatgaatccaaattgttgcttcttccgatcccaagtgcatcggacgatttatacatcaaagatattgataaggaaatcactaagataaaagaaaaaatgattgaagtatctagtgaattacaaattgtaacgagccgtccccaatatgtagatggacaaaccaaagaagaaattttagaattagaaagacatcgattagcccgtgagctgcatgattcagtttcgcaacaattgtttgcagcaatgatgatgatgtcggcattgacggagcaagcagaaaaaagcgagacaccagaaatgtttcgcaagcagttgaaaatggtagcagagatcatcaacgcttcccagtctgagatgcgtgcgctgcttcttcatctacgtccagtcaatttagaagagaaaagtttaaagcaaggtatcgagcagttattgaaggaattgcaaaataaaatccagatttcgctgaaatgggatgtagaagatgtaaaactatctagttccattgaggatcacttgttccgaatcgttcaagaattgttatcaaatacattaagacatgctaaagccaatgaattagaggtatatttgcacaaaatagacaataatcttttgttacgtattattgacgacggaacagggtttaatatgaatgaaacgaaaacgggaagttatggattgaacaatatcaaagaacgagtagctggtattggtggaacagtaaaaatcattagttttaaaggtcaaggtacaagtgtagaaatcaaggtccctttgatgaaggaggcatagataaggatgataaaagttttattagtagatgaccatgaaatggtgcgcttaggcgtctcttcttatttatctattcaagaagacattgaagtaattggagaagctgaaaatggacgacaaggctatgagaaggcgatgacacttcgaccggacgtcattttaatggacttagtcatggaagaaatggatggtatcgaatcaacaaaagcaatcttaaaagattggccagaagctaaaatcattatcgtaaccagttttattgatgacgaaaaagtttatcctgccattgaagcaggtgcagcagggtatttgttgaagacctctaccgcacatgaaattgctgatgctataagggcaacgcaacgtggcgagcgagtattagaaccagaagtgacaacaaaaatgatggaaaaaatgagtcggcgaaatgagcctgtattacatgaagaactaacgaatcgggaaaatgaaattttaatgctgatttctgaaggaaaaagtaatcaggaaatagcggacgaattgtttattacactgaaaacagtaaaaacacatgtttccaatatattggctaagctagaagtggaagaccgtacacaagccgctatctatgcattcaaacatggtttggtgaaataaaaacgatgataaagaggataatcaaaagctgagaaaataactattatttttcttggcttttttacaataatgatgcttgcttttgtttttgtaaaggctttgttatactgagaaaagaagatactaaaggaggaaaacggtgaaacaaaattttgcaattgtaggtcttggacgatttggcggaagtatctgccgaacactgatcgaagctggtcaagaagtactggctattgatagtaatgaagatcgggtcaatgaatatatgaatatagccactcatgctgttgtggcaaatgcacaggatgaaatgacacttcgatcattaggcataagaaatttcgatcatgtaattgtcgctattggagaagatattcaagccagtatcttagttactctgatggtaaaggaaatgggcgtaccaaatattttagcaaaagcccaaaatgagtatcatgccagagtacttgaaaagatcggagctgatcgcgtcgtccatcccgagcgagacatgggaataaggattgcgcataatttagtgtcaaagaatattttagattacctagagttgtcagataaatattctttagcagaaatccgagtctccaatcctaaatttttcaacaaaacattagctgaattaaatttcaggcaacgttttgacttaacagtagtcgccatacgaagagtagatcaaacggttatcgcttctcctgcagcagatgaatatgttcgtgaaaatgataatctactggttattggagagacaggcgatgtggatattctagacgataagatgaatcaatagaaagaaaagagaaagtaggttgttgggatgaaattaacggtaacgccaaaagcacaaaagtggtttgactcagaaattgatctgccagaaacttacggaatacgtttttttggaaaagtctacggcaaaacagaggttcatgatggtttttcgattggaatgtcagttgaacagccagaacatcctgtaaagaaagtggaaatggatgggacacttttttttatcgaggaagcagatgaatggttctttaaaggatatgatttacttgttgattatgatcccaacctggaggagccaacctatcactttaaaaaacaataaaaaaagagagggtgacacaatttttgtcaccttctcttttttcttttgaaaatattgttttcagctattaatatcctgcagacaattttacttgattggtttgaagctcatgggtggcaaagtagcttttcagattggttaaaaaaatagccattaatttcttttgaaaatcaggtgtcaaacctgcaatgtgggaagtaatcagtacattgtccattttccaaagaggatgatcttgtggaagaggctcttcctcaaaaacgtctaatgctgcaaaggaaagttgctggttatttaaagcctgcaccagatcttgtgtcttaacagaagcaccacggccaacattgatgaatacagattttggatcaaagtgttcaaacatatgctgatcaaagagcccagttgtttcctccgttagaggtaagatattgactacgaaatctacttcaggaagaacttcctttagttgatttaaagaaaaagtcttttccattccttctgctggatgaccggatgtattgattccatagcagttcatgtctaatgctttgcatttttttgcaatcatttttccaatatggccagttccaatgattagtatttttttcccttggatagattggtaatggaccgatgaacctaaccatttcatgtcactctgtgccttttgtgcttgaaaaagaccacgagaatacccaaggatgattcctaagacatgctccgtaatcgattcactgtggatgccactaccatttgaaagtaaaatatgtttctttgaaaaagtctcaaggggtagctgatcaacaccagctgagatagattggacccatttcaaggtagaagaggctaatagtttttcttggtagtctgagttccagcccaaactgatctctacattttgtagatcctctggttgtaattctgttttaaagatataaccaggcgctatagtatggatttcttcgataaattcatcacgaaatggacgatctgcataaatgattctttctgacatagttaatttcccgcctttctttactctaagtgtagcgcatacaagaagaactttgaagcgccttgcttgttttttgagaaagaaatatttttcaaataaaaaaggggctgtgacaaaaaaatgtcacaacctctaaaagggtctattgaagtagaaataacgagttgtctttatttcttaattgatcgatatttttgcccatcctttgacagcttgagcaaaaataaagattcctgcaaaagcaatgaaggcgctagtgtcaaaagaaggaagaaagaccatcaagattgttgcaattatagtaggcaatgaaattgaatagatcaatgtttttaaacaatcaagaaaagtagcttttgttagtcgaaagcgtgcatagagaaaagcagcaatgttggtaaatagcaaagtgatcagcagattcagaaaactaggataaatagaaaatataaatgtcaggacttttatccaaagtggtatagatgcttcacttaaaaaagaacggagctgcttacctgttaagttttttaaagattcattggtgtagggaagttctaattggttattgttcaacaaagcagaagtcgtgcctgtattaggaagagctatgataagtttgttttttaacatcccgacactaacaaaattccccatcaaatcagtagagatgtcctgttctgttcgttttccctctggatcaaatgtgaagataatggagtttgtttggtaaatgaatccttctttttcttcggtttgaagctgcccgttttggattgtaaaatcaggaatgcgagtagcaatcttttgcccatccaattgaatgttgtttaagacttgaaaaacttgaaaagagattggcaaagccataattatactcaaaactaaaagatagacaatggctttccaaaatgggacatttctcgcctcctttaggtctttgaatcgtataaaggaactgataattaattgttttgttgtcataagtactcctcatctagtagtgtcatcacttgcaattctagcgaagtatcaagtgaaatacaagtgctttaaggaaacagctgaatgattggtgaaatatcaaaaaaatgttattcttgtctaaagactatccaatataaataaaatggaggaaggaatagtgcctacacagccacagagatcatcaaaaaaactatttggagtagtggttttgaatgcggtgatcactttatcagaatttattggagggattatgtcagggagtttgtctcttgtttcagatgctttccataaccttagtgatacattggcaattattttttcttacggggcacaaaaaatggcccgaaaagaagcaaataaaaaacgtacgtatggctaccagcgtttagaaatattgagtgctttcatcaactcattcatattgatcatattatccttgtttttaaccgttgaagcattcaagcggttcacttcaccagaaaagataaatagtcatttgatgctaacagtagcagttattggattgctcgcgaatttgttctcagtattattattacgacaagaagcagatgaaagtttgaatataaaatctagttatttgcatttgttaagtgatacactgtcttcggtaagtgtgattatcggagcaattttgatccgttttttcgatatctactggatcgatccagttattacactgatcatttcgatatatatattgatagaagcgataatggtgatcaaaaaagctgccgctattttgatacaaagtgcacctgctatcgactatgaaaaaatggaacaagaaattgaagcaatcgatggggtaaaggatgttcatcatgtccatatttggcagtatagcgaaaagataattattttcgacggacatattgattttgaagatcagctactaagcgagattgaaaagatatatcctcgtataatttctttattaaaattaaaatatggtattacacatgtgacgatccaagcagagacaaaggcaaaggatcaaaaaaaattaatttttttaaataaagatgaaagttattgaaatatagagtatgataaataagaatttttaataaggtaggttggctcatgaagcagtatcgacagttaaaaggatatttagaagcaaaaggatattgggagatactagtctatctcttttttggtggtttggctacgattgtaaattttgttagttttgctctcgcacgccaatattttgatttaagtatggccttatccaattctatttcgtggttttgttctgtattgtttgcttttgtaacgaacaaactttgggtattccattcaaaatcaccgaattttacacatgcacttattgaatgcggtaagttcttcttctaccgtatcctttcttacggattggacatgggggcaatggtattgttgatcaatgttatgaacagcaatgagtatgtggcgaaaatcatcactcaaattattgttatccttgcgaactatattttcagcaagttgtttatttttaaagaaactgaggtttttgaagaagaagtaggtcaaagtgaaaaagacgactaggcataacaattgaagaatttccttctctttgttactctttgtaatgtagacattattaagaaaacattgaggaggaatttttttatgacttacacattaccagatctaccttatgcatatgacgcattggaaccttatattgacgaagaaacgatgcatctgcatcatgataagcatcacaatacttatgtgacgaatttaaattcagcaattgagaaatacccagaattaggcgaaaaaacaatagaagaattattatctgatatggacgctattccaacagatatcaagacagctgtacgtaacaatggtggcggacatgctaaccattcatttttctgggaaatcatggcaccaaatgctggtggcgaacctacaggagaaataaaagaagcgattaatgaagcttttggtgatttttcttcttttaaagaagaattcaaaaaagcagccgctggacgatttggttctggatgggcttggcttgtaatggaaaatggaaaattagctattacctctactgcaaatcaagattctccattgatggaaggaaagacaccaattctaggtttggacgtttgggaacatgcttattatttgaaatataaaaatgtccgaccagattatattgcagcattctggaatgttattaattgggatgaagtaaacaaacgtttcgaagcagcaaaataaccatttcctccgtcatatcagtcttaaaaataatttggaaaataaaagagcgaaagcttgctagcgttttctaaattgggtataatgttcttgcaaggttacttgcaagaacttttttggaggatatacatttatggaacacggaacggttaaatggttcaacaatgaaaaaggatttgggtttattacagtagacggcggagatgacgtatttgttcatttctcagcaattcaaggagacggcttcaagagcctagaagaaggtcaagaagtagaattcacgattgttgaaggtgcacgcggacctcaagctgctgaagtgactaaattataataatttgttgaataaagacacgacttcttagagagtcgtgtctttttgtctatttatgaagtttttagattttttggctaagtaaatgcatttgttcacttgacatgtcctaactaattatcaagcaaggaacattttcttcgttagtaatggattttaaagaaatttcagtttttggatgttgaataaaagaccatttgtgaaaccactagtatacatactcattaccatgtcaattctattactttaaaagaaaatcgttttactttgaagaggagcatatctatccattaaaagatgatggtaatgcaatcactagttcgagtcattttaagagccatgcagtgagctggaaataaaacgaatagaagatgggtttaacaaaaggaccagtcataggaagaaattgtcgtgaaatcgaatgataatctgaacggtaggcaaagactgttaaaaagatgggaaaggtatgtgcgatcattttactgcacgattatttggaaaataccttgttgttcgctttttctggaaaaaatacataaaaaagataaaacgattgcgaactgcgtgtattcggtctttcgatctttttcacggtatggtatgatagttaagaattttgagaaattttaaaaaataataatcgttacacaaaaatgttttttaaagttttcttatgattaaaaagtgaatttgctgattgaacagttatatgagacaatattttagaaaatgtgaaacagaggtgtattatgaagcgatggcaaaaagttctattaaccttgttaggggtattcgttttgctgattgccggattatcagcatacggaatcagatttatgggagaagcgagccaaacagtaaacaaaatttctaaaaactctaatcgaatatcctccaaacgttctgagagagtaagcattgatgacaaagaacctttttcggttttgctattaggtttagataccggtggattaggaagaacggaacaaggacgttctgatacgatgatggtagtaacagttaatccgaaacaaaaaaaatcaacgatcatcagtttggaccgagatatttatacgaatatcgtaggttatggaacggtagataaattaaatcatgcctacgcatttggtggtgtcgaaatggccatggattcaattgagcaactgctcgatattcctattgatcattatgtaacgatcaatttggatggcatggaagatttgatcaatgcggtcggtggcatcaaagtgaataataaaattgactttactttggatggtgtccatgtaccagtaggtgaacaaacattgaatggagaaaaaggtttagcctattctcgaatgcgacacgaagatccagaaggcgatatcggtcgacaacgtcgtcagcgggaagtagtgacgaaaatcgtcaataaagttttaagtttagatggcgtaagcaattatagaaaaattttaaaagcagttgagaacaatgtgacgacggacttagattgggatgacatgcttgatgtagcgacgaactacaccccggcgtttgaaacaatcaaacaagaccagttgcaaggcgaaggacaaatgatcaatgatatctactatcaaattttaggaaaaaatgatcttctttcgatccaaaatgaactgaagaaacaattaaatataaaaacaagcgatacattacctaatttgaaaaatgagaatgcttcaatgatgttctttgatgattcggaagatggcgattcgacaaacggtgatggatcgaatagtgaagggtacaccgattattcttcctattcagaaaacacatatgatcagtaccaagatccgaatacctattatcagcaaacagaagatacaagtcagtactatacaccaagtcaagatactcaaagttatgatccttacgctggacaggaacaaaatggttatggttatgaccagaataatgagtatggaacaacaagtgggtactagaaaaaaatagtttggttaataaagagtgccacctaaattagacaaaaaatctaacttaggtggcactttttctatgtgttaaattacaggacgtctctttttagcgcttagtttaaaaaataaattgaataattcaatagagttgcgaatagtacccataaataataaggaatcatgagccacattgccaggcgatgatgcagccacaactgatacataagcactgacaagaaaataactaaaagtgtaatatcgattgctgcaatgaaaatatttcttaaattaaaaaatagagcagaccatataaaattaaaaatgaactgaatcacaaaaagaccgacaagattgtttcgctgttttttgttgttgtgattaagtaacaaataaagagaaatacccatcaatatatacagtaaggtccacatcggcccaaatatccagctaggtggtgcaaatggtggaagttgcaaagaatagtaatattttccgggatttccgctaagcaaccctgataaaaagcctaatatgacaattcctataacacaaacccaaaaacgaatatcttttatcatcttcattttactaactcctttctataatattagtttaccatgaaggctcacagcaagacctgtatttagtttgtgaagtaagaaaaaaattgataattgttgttattaaaaagttgaacatttgtttatatgaatgatgtttttgaaaaagatcatatgatttgattctcatgttttctatttgtacttttctcgtctacttctgttataatctgcatcttacttttttcaccttttttacttcaacataaaattataaaagcataatgtttgtgttaatacaataaagcgtttacaatgtggttatcaaatgaaggaggtttctacatgaaaaagattagtacgttattgtttattgggttagttagtttagggttgttcggttttagcattccaggttttgcgcatggttatattacttctccaggaagccgtgcatacctaggaacatcagcagcaggaaacttaaatcaaaatgtcggaagagcacaatgggaaccgcaaagtatcgaagctaccaaaaatacattcattgatggaaaaattgctagtgcaggagtcagcggctttgagcctttagatgaacagacatctaacagatggcataaaaacatggttaatccaggaacattaaatattacttggaatttaacagcacaacatcggacaagtacttgggattactacattaccaaaccaacttggaatcctaatcaacctttgaaatttagtgattttgaattgatcacaaaaatagacgacaaagcaactgttccaccaaaaacagtcaaccaaacgatcacacttccgcaggatcgaaaaggatataatgtgattttagcagtatggaatatcagcgatacgacaaatgcattttatcaagtgatagacgtgaatatccaataataatcaaaaagggctgtgacaaaaactatgtcacaaccctttttttaaataaatagtgtcctcctgttaactcttcggtcacaagtacagtattcataaaacatgaagagctatttttgtttggctgttcttattacttgatacagggcagactttttcacaacctctttcatttagtcagcgagtctcgtcatcttcacgacaacttcacaacgtgcagtctgaggaaacatgtcgacggactgtaaatattcaatcttgaactttttacttaaattaaccagatctctggcaagtgtagaaacattacaggagatataaacaagtttttttggagggtatttcaataatgattggatcaatgcgttatccaaacccgtacgtggtggatctacgatgataccatcaggctgaaaaccttcattcaaccatttaggcagaacttgctctgctgtcccgacttcatatcgagtgttgtgatatcctaatctttccgcatttttttttgcatcagcgattgcttgaggaacggtatccattccccgtacttctttggcttgttttgctacacttaagccgatcgtcccaactccgcaataagcatccacgatcgtttcattaggctggacatctaatgctttgattccttcgccataaagcaattcggtctgctgaggattgagttgaaagaaggcacgaggagaaagatcgaaagtcacttcattgatttgttcttcaatggcttcttttccccataagtggatcgtttcatcccccatcacgagagacgttttttgtgcctggacattttgcatgattgaaacaacttcgggcagtcgttcattgatctcacggatcattgcgtttttttgcgggaattttttactgcgagtaataaaaacaacttgtaactccccagttttaacaccgattctaaccatgattgtgcggaagattccactgtttgtccgttcatcatagatgggtgcatcaaatttattcaatagttgaacaacagtattcattactttttgtgttcgaggttcttgaaccaagcagtctgttatagggactaactgatgagagtttgcttcgtataaaccagcttcaattttttgagtctgcttattttttcgtaactgaaattgtgctttgtttctataatgccaaggctcatccatcccgatcgtcggcaaaagttgataagatcgaaagcctgctggtttgaatttttccaatgcttgcaaaagcagatcctttttaaaatccaattgagcttgataagctaagtgttgtaattgacagccaccgcattcatagtaaacaggacatggtgccactacgcgatctttgcttgtttttttgacttttattaattctccttctgcatagcgaggagttgctttcgtgattttcactagtacttcttcttttggtagtgcatatggaacaaatatgatcaaccgtttgaaataaccgattccttcaccatttatgcctaaacgcttgattttcaaaggaaccgtttgtccagttttgacaattgtttctgccataagtatctccctttttcttttttctgtggtttattctaacatataatacctgattacggggattttctgtggtatgatagagaatatatgttcgaggaggatgtttatgttaaccgttacgagaatcagtaaaggcaaaggccctttctatcgcgtagatttatctgaaggagaagctttacaagtatctgaagatgtattagtacgctatcgattattaaaaggacgggaattagacgaagaaactatccaagagatcaagaagagtagcggagctgatttcggttttcacctagcaatgaattacttaagttatcagttgcgatcggaaaaagaaatccgaacatacttaaaagaaaaggaaatccttcaagaagatcgaaataaaatcgtagcccgcttaaaagaattggaccttgtcgatgatttggtctatggggaaagttatgtgcgcacgaatatgcgcttaagtgacaaaggaccaaagaaattagcgcagcagatgcagcaaaaaggtttgaaacctgaaatcattgaacaagcgctcagccaatatacatttgaagaccaagttcaaaatgcacatcagacagccgaaaaagcgtttggaaaaaatcacggaaaaagccaaaaagaattattgagaaaaatccaacaaacattgatgacgaaaggcttttctcaagaagtgatccaacaagcgatagctgatcttccgcaagaagcagatcaagaaatagaatatgattatttagtcaaacaaggagataaactatggcgaagaaatttaaggtttgaacctaaaaaaagaaatctaaaagtaaagcaaagcttatatcaaaaaggatttgatttggatatgatccagcgattcattacggaaaaggaagaggaaagtgaataaagaatgggaaaaatggacagataaagaaacaaaagaatttcaagatcagttcattcaatggtatgaacaagaaaaaagaaacctgccttggcgctataatcgtgatccttatcgtatctggatctctgagatcatgcttcagcaaaccagagtagacacagtgatcgattatttttatcgtttcatggaatggtttcctacaattgaagagctagcaaatgctccagaagaaaagcttttaaaagcatgggagggccttggttattactcaagagcccggaacatccaagctgctgctaaacagatcatgtcagaatttgatggggaaatgccgcaaacgcctgaagaaattagctcattgaagggaataggaccatatacgacaggcgcgattgcaagtatcgcatttggacttccagaacctgcagttgacggcaacgtgatgcgagtagtcagcagattgttttgcattgaagcagacatcgcaaaagcttctagcaggaaaatctttgatgaagcgatgcggaaaatcattgatgaaaagcatccaggtgaattcaaccaagcaatgatggatctaggttcagctatctgtacaccaacttctccaaagtgtgagacttgtccgatccaagccttttgtttagctaacaaacgaggaatccaaacgagttttcctgtaaaaacaaaaaaagcaaagccaaaagacgtttattatatcagtgcagctcttcaaaatcattctggagcgtattattttgaagaaagagatagccaaaaattgctggcgaatatgtggacatttccaatgatggaagtgacacaagaggagtatgagcgattgaaaaaagaatgggaaacaaagccagaaatcgatctgtttgatgacctagtagcagaagaagagcaaaatctcccatttgaaaagcaggaactctttgtttggcagacacgacatttaggagaagttactcatatttttagtcatctgaaatggcatgttctccttttttacggacgggcaaccgagggagcagaacaagaatttaccgagaacaaaacttcgaagtggttgaagcctgatgcatttgattcggtcgtttttcctaaggtccaaatgaaactggtagatcagttagagaaaaatcgaaacaataggaatcctttctaggcaaagctcatttttattgatataataattatgatgtcggtgtaatgaacacccaaacacaaagcacaaaatgctgcttaaggaagggttgctatgggagttccaaaagaaggagagtttgtgacgatccaaagttacaagcacgacggcaaattgcatcgaacgtggcgagataccatggtattaaaaacaagcgaacactctatgatcggcgtgaatgatcacacattagtcactgaatctgatggacgccgatgggtaacgcgcgaaccagcgattgtttattttcataaaaaatactggttcaatgtaatagcaatgatcagagaaaagggggtttcctattattgtaatctagcttcaccttttttgctggacgatgaggccttgaaatatatcgactatgacttggatatcaaggtatttcctgacggcgagaaacgactattggatgtcgatgaatatgagatgcacagcaaaatgatgaattacccgaacgatattgacttcatcctaaaagaaaatgtgaagattctggttgactggatcaataatggagatggcccgttctcggaaggctatattgatatttggtataaccgttacaagcaattgtcgcgtaagtaaacacaaaaaagaacagtaagccagtgagagatttttctcaaaagcttgctgttttttgcttttttcgaaataaatttttataaagtctttttcatataaatatgaggcatgccagcatcttcaaaaggatcgccgtaagctgtatatcctagtttttcgtaaaaagtttcagctgtggactgtgcccctaataaaatcgtattatagccttgattcttagcaaagttttctgcttcttcaatcaatatttttcctaacccttggtgtctgtattcagaaagaatcgccatccgctgtaatttcatttttccgttttctaaaggcaaaagacgtacagttccttgcggttcttttttatctgagtacaggacgaagtggatacaatgggcttcatctttgtctatttctcgagacaaaggcacaccctgttcgactacaaaaacttgatgcctgatccgtacagcatctaagtaaatattgctcattgtatcttttgtttgtacaactttcatggtctagccaccttcctttcgtatagtatactggaaaataaaacaaataaaaagtatggcaagttttcaaaaataaaaaaagaataaaagaatttttaacgaatataatatatactagtaagaaagaaaggaggaaatctattgtttgaaaaacttagacagtctaaactaatgttttggtcgcttgaattattgatcatagctgcattgatcatgatttcatcagaaataaactttattttcgaaccgatcgggacatttttttccacgttatttgcacctgtactgattgcaggctttctttactatttattgaatcctattgtcaagctgttgatgaaagcaaaaatcaaaagaatatgggctgtcgcaattgtgctgctccttttagttgcagcaattatttggattttacttagtgtcatcccaagtctagtacagcaaatttcctcattggcatctaatatgcctgatttcatcaaacaggtagaaagctggttaaaagaggtagccgaattgcctttgttcaaggaagtagatatcaataaatattttgagcaattagacatttcttacgggacaatcattcagcaattccttagtggagtatccaatagtttaggttcgatcgttggaacgatcgcttcggcaaccgtagtaatcattacagcaccattcatcttgttctatatgttgaaagacggagaaaaactagtgccaaacatccaacagtttttcccagaaaaaagaagaaaccaaattgtggagttattggggcaactgaataaaacattggctaattacattagcggacaagcaatcgaatgtttattcgttggtaccttcacatttttaggatatatggtaattggtgtggattatgctttcttatttggggtcattgcgggattgacaaacctaattccatatttaggaccttatctaggactagcacctgcatttctagtaacagtcttcaatgatccggtaaaagcattactttgttgtgtggttgtgctaatcgtccaacagttggatgggaatatcatttatcctaatgtaattgggaaatcactgaaaatccatccattaacgatcattatcgttcttctagtagctggaaatattgccggattgcttggtatcttcttaggtgttcctttttacgcaatctgcaagacgatcatttcctatataatcaaaatcgtcaaagaagacaagcaaaatgaaaacaagaagaaaattgctacgacctcgtaggtagttttagtacacttgtttttattgcaaagaaaattgctttgtgataccattttaacgtggctatagtgccacgtttttttctatcgtaaactaaaaattaattttataaggagagaatgcgattatgaatgctgaccctgagagtcagtcgctgttagcgcagattttattattgatcgttttgacattgatcaatgcttttttagcagcttccgaaattgctgttgtttcgatcaataagaatcgaatcgagcaaaaagctgatgaaggagatgtgaaatctcaaaagcttttaaaaatattgcagaatccaaataatttcctatcgacaatccaagtaggaatcactttggtcaacattttgtctggtgcttcactagctaatactttatcggaacggttagctccggtattaggtggcggcacagcggcaaaaaatattgcaaatatcattgtgctggctattttgacctatgtatcgattgtttttggagaattgtaccctaaacgtattgctttaaataaatcagaagaagtcgcaaagttcacttcagggctgatacgcttgattggtgtagtagctaagcccttcgtctggctgctttctgcttccacaagtttattggcgcgtatcacgccgatgacttttgatgatgaagattcaaaaatgaccagagatgaaatgcgttatatgcttgaaaacgaaggcgtattgaataatgaagaattagaaatgctccaaggggttttttctcttgatacgaaagttgcccgagaagtcatggtcccacgaacggatgcatttatgattgatatcaacgacactgtggaagaaaatgtgaatgaagttttatccgaaaactattcaagaatccctgtttataacgaagacaaagataaagtagtcggaatccttcatacaaagaatttactaaaagctgcccataaattcggctttgataatttagatatcaagaaaatcatgcaggagcctttattcgttcctgaaacggtctttattgatgatctgttatatgaaatgaaaaagacgcagaatcagatggctattttattagatgaatatggcggcgtcgttgggttagcaacactagaagaccttttagaagaaatcgtcggagaaatcgatgatgaatcagatgaagttgagaatctttatgaaaaaatcgatgaacacgaatatatcatccaaggacgtatgctgattgatgagttcaatgaagcttttgacagtgatctgcatatgagtgatgtagatacgatggctggttatttgattacagcattaggcatgattccggatgaaggcgaaaagttatcgtttgatgtcgataatattacgctggtttctgaagaaatggaaggttctcgaatccttaaaatccgtgtcatttttcatgatccggaagaaacagaagcggaacctgaagaagaacgaagatacttcagaaaagaattcgaagatgacgagccaagaagataattggaaacttggttatgaaagacgtgttgcttgaataaacaagcaacacgtcttttcttttagtcagctgacaaaaaaatatttgactcttatggtttggtggctttttcattcgctgaatccatgctatactgattcagttgtagtagttgacaaaggttgtgaaaaagctatcctgcattaagtaataagagcagccaagcaaaaacagcttttcgtatttttggcttgggtgggcttattgctgataggctgtctctagaacgccgtttactcggaaaaagagactgctacacggcttttgtcacagccctatatgaaattgtctttctttaagagatcggacaatctgtgcctagagaaaatataaataattgaatggaagaaatggagttaggttatgaataatccaaaattaaagcaacaagtggacaatcgcagaacttttgcgatcatttcccatccggatgctgggaaaacaacgattacagaacaattactattgtttggtggggctatccgtcaagccgggaccgtaaaaggcaaaaaaacaggtaattttgccaaatcagactggatggaaatcgagaaacaacgtgggatttctgttactagttctgttatgcagtttgattatcaagggaaacgagtaaatatcttggatacaccaggacatgaagatttttctgaagatacttatcgtactttgatggccgtggatagtgcggtcatggtaatcgatagtgcaaaagggatcgaagcacagacaaagaaattattccaagttgtaaaaaaacgtggcatcccgatatttacttttatcaacaaactagatcgtgatggtcgtgaaccattggaattgttagaagaattagaagagctattagatatcgaatcttatccgatgaattggccaatcggtatgggtaaagggctagaaggtctttatgatatctaccataatcgtgtagagttttatcgtccggaaaattatcaggatgaacgattagtagaattggatgaagatggactgcttcccgaaaatcatcctctaactgaaaattccttatatgaacaagtcttagaagaagtagaactaatcaaagaggctggagatgcatttaatcaagaaaaaattgctcgtggcgatcagacaccagtattttttggttctgcattgactaacttgggtgtacagacttttttagagactttcgttgaattggcaccagctccttatggacacaaaacacaagatgatcagatggtaagtccttatgaggaagaattttcaggtttcgtattcaagatccaagcaaatatgaatccagcccatcgtgaccgaatcgcttttgtccgaatctgttctggaacattcgaacgaggaatggatgtctggttggaacgtacaaataaaaaactgaaattaagcaatgtcacacaatttatggcagattcgagagaaaacgtcgaaaaagcagtagcaggcgatatcatcggtgtatatgatacaggcaattatcagattggggatacattgttcgaaggaaaactaaaagttgcttatgaagaactcccttcatttactccagagctgtttatgaaagtgactgcaaaaaatgtcatgaaacaaaaatccttccacaaaggaatctatcaattagttcaagaaggagcgattcagctttataaaacatatctaacggaagaatatatcattggagctgttggtcagctacaattcgaagtattccaatatcgtatgttaaatgagtataacgccgaagtaatcatgtctccaatgggacacaaaatcgctcgctggatcgatccagaagatttggatgagaagatgagttcaagtcgcaatatcttggctcgtgaccgtttcgaccaaccgttgttcttattcgagaaccaatttgcagaacgctggtttgcggataaatatcccaatgtaaaattaaaaagtttgatgtaaagaagtcttgacacaagctgccctgcatcaagtaataagaatagccaaacaaaaacagcctctcatattttgtttagagccgtgacggattttccgtgacggctctttttactatattaaaatcatagaaatgtctaatcaaaaaaatataaaaattattttgcgtacatatgattaaagaaaggagagtgtgacacatggaaacagaatggcaaagacgtgaaagaaaaaaacagaaaaaagaagagatgttacgattatgtcgattattagatgtaaaagactgggacaaaaacgagcaaattgcacaaaaagtacgatcaatcatccataaagaggaaaaagttaaaaataaagacacgcgtagaactgaaaatgaaaagagaaaagtacaaaagaaaagagaaaaatcaaaaagctagaaagaaaaagaggctgagacagaagcgtttaactccaagaaataagctggaattcacaaaaatttgaaaagcaattttcgtgaatttcagcttatttccgaaggagttgcttctgctttcgccgtttatacgtgtttagagcgtgagacaaaagtgttctttacttttgtcccacgctctttaattattatgttcaaaatttgtttacacggctaatgtagcgcctaattcatgttttggaatcgagatttcaacaaggcctgccaattcgattactttgatttcatcctcgtggtaaacggcgtctttgattttatctaagaaataattttatagcatcttcgatttctttcggctggattttacgtttgtcattgatcagcagaatttcattatgttcaggggcttcagtgtagacaatagtggtatttccggctgtgtagaccttgactagatgggcatcagtgttttcaagctggtttaatacaagacgggaatggctgtttgttacatttaccaatttcatggcgctcacctcttttatgtatttttaattgcttgtttctcttattataatttcttttttataaaatgaacagtattttgacttttctgaaaaaagaatgagacggcatttctcaaagaaataccgtctcacgctataaaactggatttattcagccgtttcttcggctgattctttagccaaacgttctggtttagaagtaacgatgatttttccatctttatccagttttgctttcaactcatggatagaagggtgatcaagataaaattcagcgataccatcttcgatttgttcttggatcgtgcgtcgaagaggacgagcacccatagatggatcatagcctaagtcaactaatttttctttgacattcgtaggaacttcgatgtgaagttgctgtgctgccagcatttggttgacatcgtctagcattagtgtgacgattgtcatcaagttttcttttgataatgcactgaattcgatgatcccgtcaaaacggttcagaaattctggtgtaaagtagttgtttaattggttcaatacagaacgagtaacaccttcgcgtgccgcaccaaaaccaacgtttgcttctactttaccagttccggcattacttgtcataatgatgatcgtatctttaaagctgaccgttcttccttgtgcatctgtcaatcgaccatcatctaagatttgcaagaacatatgcaaaacatctggatgagctttttctacttcatctaacaagacaagactgtaaggatttctccgtactttttctgttaattgaccagcttcttcgtatccgacataacctggaggagaaccaatcaatttagagacactatgtttttccatatattcagacatatcgaaacgaatcattgaatcttgtgaaccgaatagttcgtaggcaagttgtttcgcaagctctgttttacctacaccagttggtccaacaaataagaaggagccgattggacgattctgtttgtttaatccaacacggtttcggcgaatcgctttcgctactcgatctacagcgttatcttgtccgatgacatgagctttcaagtcatctgctaagtttttcagttgtgtctgttctttttcttttaattcacccactggaatacctgtccgttgttcaacgattttttccatatctttttcggtaatcacaggtgtttcctcttcagtgagctgacgttctttcattttttgaagtttattgatctgatcgcgataataagctgctttttcgaaatcttcttctcgagaagctaaaactttttgttcttctgcttcttgcagttttttctcgattgttttaggatcaacgatttggatcgtcaagtttttcttagaacctgtttcatctagcaaatcgatggctttatccggcaagaagcgatcttggacgtaacgattggataaagttgcggctgcttcgatggcctcatcagtatattttacatgatgatagtcttcataacgtttttgcaaacctttcaaaatactgatcgtttcttcgacagttggttcatctacccgtacaggttgcatacgacgttctaaagcagcgtctttttcgatgatgcggtactcatttaaggtagtagcaccaaccatttgcaattctcctcgagctaaagctggttttaaaatattaccagcatccatatttccatcaccagcagaaccagcaccgacgatttcgtgaacttcatctatgaataggatcacattttctgcttgacggatctcttcaatcaatttttgcatacgttcttcaaattgtcctcgtataccagtaccttggactaaagatacgacatctaaacgaatgacttctttgtccattaatttttgcggtacatcaccatctacgattttttgtgctaaaccttcaacaactgctgttttaccaacacctggttctccaatcaagacaggattgttcttggttcggcgatttaaaatttcaatgactcgtttgatttcgtcatcgcgtccgatcacaggatcgatatcaccttgtcgtgcttgttctgtgatattgattccgtattctcccaataaaccttctgtattgccttgaggtggctgaccaccattgaagttgttgtttccgccaaattgtgttggtggtgtttgctcataatttccttgctgttgcatttggcgagacatggaacggaaaagatcgtccaaactgccaaatccaaatggatcattttgggccatattagtcagacctccattttgttgatttttgattttttgataacagctctgacagtaatcgagttgtgtccgctgaccattgacagtggcatacaagtgaatcgttgcctcattcttgccgcagttttgacaaagcatgaatcattcacgtcctttcacaaaaatgggtacatccatattttacatctcgtttttcatgaggtaaaagaataacccctagttttttaagagatttatgaggtagaaaaggtgaaatctctattgaccattcctgacctttgactcttattatactaaaaataaaaagggaagcaagtaattcgtttcatatgaaaacaaagagggtcaaaggaaagaatgataaacgtcaggagaagagaaagcgacaagaaaaaggaaataaacacgtttgttataaaatgtgaagaaaaggatgaaaaagaatccggaataatttgaatacttttatctgaaattgaatgaaaactgttgtatctaacgaaaaaaaatgttaatctttacagatgaaagggtggcatttgttaggattctctgaattactaaaaaagaaaaccctcacataaaaacaacactcacttaaaggagaccgattaatatggaaaagaaagaatttcacgtagtagcagaaactgggatccacgctcgtccagctacactattagtacaaacagcaagcaaatttaactctgatgtaaacttagagtataaaggtaaatcagtaaacttgaaatcaatcatgggcgttatgtctttaggtgtaggtcaaggttctgatgttactattactgcagaaggtgctgacgaagctgatgcaatggcagcaatcgttgaaacaatgaagaaagaaggcttatctgaataatggttgaaatgctaaaagggattgccgctagtgacggtgtagccgttgcaaaagcttacctgctagttcaaccggatttaacattcagtaaggcaacagtagaagatactgcggctgaagaagctcgtttggatgctgcattagctaaatctactgaagaattgcagcaaattcgtgaaaaagcagcgcaaagcttaggtgaagcagaagcgcaagtatttgatgcccatttgatggttctttcagatccagaaatggtaggtcaaatcaagcaaaatattaaagacaacagcgtaaatgctgaatcagcgctaaaagaagtaacggatatgtatatcggtatgttcgaagcaatggaagataatgcttatatgcaagagcgtgctgcagatattcgtgacgttgctaaacgtattttagcgcacttattaggcgttactttaccaaatccatcaatgatcaacgaagaagtggtcgttgttgcacatgacttgactccaagtgatacagcacaattagatcgcaattttgtaaaagcgtttgtaacagacattggtggacgtacttcacattctgctatcatggcacgttctttagaaattccagcaatcgttgggacaaaagaaattactgctaaagtcaaagaaggcgatattttggctgtcaacgggatcgaaggcgatgtaatcatcgatcctacagatgaacaaaaagctgaatttgaaaaagcaggtgcagattacgcagcacaaaaagcagaatgggaaaaattaaaaaatgcagaaactgtcacagctgacggcaagcattttgaattagctgcaaacatcggaacaccaaaagatctagttggtgtccataataatggtggagaagcagttggtctgtaccgtactgaattcctgtatatggattctccagacttcccaacagaagatgaccaatatgaagcttacaaagctgtattagaaggtatggaaggaaaacctgtagttgttcgtacaatggacatcggtggagataaagaactaccatatctgcaattacctcatgaaatgaatccattcttaggatatcgtgcattgcgtatcagtttatctgaacaaggcgacgaaatgttccgtacacaaatgcgtgcattgcttcgtgcatctgttcatggtaatttacgtatcatgttccctatggtagctacactcaaagaattccgcgcagcaaaagcgatctttgaagaagaaaaacaaaaattgataagtgaaggcaaggaagtatctgatacgatccaagtcggcatcatgatcgagattccagcagcagcagtcttagcagacaagtttgcaaaagaagtagatttcttctctgtaggtacgaacgatttgattcaatacacaatggcagcagaccgtatgaacgaacgcgtttcttacttgtaccaaccatataacccatcaattttacgtttgatcaaaaatgtaattgatgcagcacacgctgaaggaaaatgggcaggtatgtgtggagaaatggctggagatcaaacagctgttccattgctagtaggtatgggtctagatgagttctcaatgagtgcgacatctattcttaaaacgcgtagtttaatgaaacgcttggacacagcgaaaatggctgaacttgctgatcgtgcattgaaagaatgcgatatgatggaagaagtcgttgaacttgttcatgaatatgtaaaataaacaacgtatcaaaagctggtgtggcttgtaaaagagctacgccagtttttttgttcttttttaagaaaacgtttttgtcagtaagaatagacaaaaatagggcttaagtttgagtgacagtttgtaggctatgttatactatataagtgaagggggacgtaaggtgaaggtattattatattttgaaagtgaaaagatgcttgcaaaatctggaatcgggcgtgcgcttgatcatcaaaaacgtgctctgacggaagtcggtatctcttatacactagatgaaaaagaagattatgacatcctgcacatcaatacatacggaatcaatagtcataatatggtcaataaagccagaagagaaggaaaaaaagttgtctatcatgcgcattctacagaggaagatttccgaaattcctttatcggatcgaaccagctttctcctatcgtaaaaaaatatctggtaggattgtaccaaaaagcggactatctgatcacgccaacaccttattcaaaacagttgttggaaagctatggtatccgtgtgccgattcaagctatttccaatgggatcgacttagagaaatatcaccctgatccaatgaaagaacaaaagttcagagaatatttcaaactgtctccggatcaaaaagtaatcatttgtgtcggtttgtttttcgaacgtaaaggaatcattgatttcgtagaaattgctaagaagatgcccgaatacacatttatttggtttggtcatgttcccatgtactcgattcctcggaacatccggaaaattgtaaaagaagatcatcctgaaaatgtcctgtttcctggttacattcgtggagagatcatagaaggtgcgtattcaggtgcagatctattctttttcccttcttatgaagagacagaagggatcgttgttttagaagctttagcaagcaaacaaaacgtacttgttcgagatattccagtgtataatggctggttagaagatagcaagaactgctatatggggaagacaaacgaagaatttatccgactgatccaacagattaccaatcaagaactaccgagtacgacacaagccggttatcaaacagcaaaagagcgaagtatcaataaaatcggtgaagaacttaaaaatgtatacgaaagtgtactgaatgaaaaagtctctagcaaattaaaaaaagtaaatcaggtcaaggactagtttggaggcgaaaaacatgaaaatcggcttttttaccgatacctactttccgcaagtcagcggagttgctacatcgatcaaaacattaaaacaagaattagaaagacatgggcatgaagtctatatttttacaacgaccgatcctaatgcggataagttggaaaaagatgtgattcgaatgccaagtgtaccatttatttctttcaaggatcgaagagttgttgttagaggcatgtggtatgcttatttggttgccaaagaactagaactagatcttattcatacccatacagaattcggagcagggatacttgggaagatggtagctaagaagttgaaaatacctctgatccatacttaccatacgatgtatgaagactaccttcattatatcggtaaaggaaaagtgatcaggcaatcccatgtaaaatacttgtctagattatttgcaaatcatacgacaggtgtagtttgtccaagtgaacgtgttattgatacattacgcagctatggtgtaatagcaccgcttcgcgtgattcctactggtatcgacattgaaaaattcaaacgttctgatatcactcagcaggatatcagcaaattaagggagtcactaggtcttcaggaaaaccatttgatgattctttctttaagcaggatttcttatgagaaaaatatccaagccttgattaatgggtttcctcaggtcatctccgcttatcctaacgccagattagttatcgtaggaaaaggaccttatgtagaagagttagaggaattgatctcagaactgcagttagaagaatttgtgcagttcacaggagaagtggacaacaatgatgtagcactttattataaagcggcagattattttgtcagtgcttctacttcagaaacacaagggcttacttatacagaagcgatggcagccggaacaccttgtgtcgtggaaggaaatgcttatttgaaccgattgttcgatcatccttcattagggaaaacttttgaaaccgacgaagactttgcaccagcacttattgattatatttccagtgaagttcctaaagatccaaaagttttagaagctaaactttatgatatttcatctacacatttcggcgaagctatgatcgaattttatcaagacatggttgtttatcatgaagaagagatgcgaagaaaagaagaagaagactcgattgaacgaatcaaaataaaattaaattcatttaaaagataaaattcaaacattttttatgaaaaaatccttgtttctagcgtatactagcatagaagcaaggatttttgatttttaggaggtcgaaaaaatgaaacttggttttatcggaacaggcgtcatgggaagtgctgtcgcacgccatctactagaagcaggacacgaagtagctgtctataatcggacaaaagcaaaagctgatcctttagtaacagaaggagctatctgggcagatacaccaaaagcggtagcagaacaaagtaatattctctttacaatggtaggttaccccaaagatgtagaagaaatctactatggacagtcggggattttttctgcagatatctcaggacatattttagttgatttgactacaagtacaccaagcctggcagaaaaaattgcaaaaacagcaaaagaaaaaggcgcagatgcgttagatgcaccggtatccggtggtgacttaggagcaaagaatggtacactgacgatcatggtcggtggagaagaagccgtttatgatcaagtactgcctttattcaaagaatttggtacgacatttacattgcatggttctgctgggaaaggtcagcatacaaaaatggctaatcagatcatgattgcaggtacgatgacaggaatgacggaaatgcttgtctatgcacaaaaaaacggacttgatttaaagaaagtgattgagacgctttcaggtggaagtgcagctaactggtctttaagcaattattctcctcgtattttaaaagaagattacacacctggtttttttgtcaaacattttatcaaagatttaaagattgcattagaagaagcagaaaaaatggatcttgtattgccagcaactacccaagcattgaaactatatgaagagttggcagataaaggttttgagaatgacggaacccaagctttgatcaaactttggtggcctgaaggaaaaataccagaaaaaaaatcataaaaaacgagtttttttagagaaaatcaatgcaagtaggctatgcttttgatacaatataacagaaataagaaaaggaggacctccgatgacacattcacaattagtcgcaatcataaaacgactggaggctatggtcgagtcagcagataatgaactgcaagttcgccgttttgaaaaagaaggcgtagagaagtgtacagtaacttatgataaagcgaccgatacatttgaattaactgaaacagatactcatcagcaatacgaatttgataatatcgatatcgtagcgatggaaatctatgacttaatccaataaattttaggataattgacatttgaagttgaagatgcctaaaagaagccgagaagcaactaatttagttgcttttcagcttcttttttgtttaacagttcaatttcaaactgttctttttctaattttttgcggtaactgatcaagatttgtacaggatcgatttcttcttttgacaattgacgtttcaaagataaatgagcttctttcttttcataatagaagtcaggagaaacgtcaccagaggtaatcattgtttctgcaagttgaccataacaaacgaggtagtgctttttctgactctcatctgctgctaatggcatgctgaaggtgagcgatggtgttcttaaaaactgcttttgttcctggatccgtctaataaaataagtaactaattcgatatctttttgaagcataccggctttttcgaaattcaactgatagatgaaatgttgttgtctttttttcaagtaagtcagtagctttttatttcggccttgaaacagcccttggagttccttttttttctgttcaaaagtcatttcctgtaggtcaggaagctggactcgcaaagctaacaaactaatttcagacaaccaaggcatttgataagtttcttccattatacgcaaaatagacggcatttttttatagagacgaaaaggcccgtatgttcgagccgtaggagtatctgttaatacaaatcccttattggtaatatgtacataattataattactgaaataattcatttgtcggttataaaaaggacggtaatgttggatcaattgacactcgagcaataaagcatctaattccgtgtctactacgacgaaatcaaaatctgttatatgatgaatcatacgtaatactttttttgaatgctgtttattctgatgaaaatagctgcttactctatttttgagccgttttgctttaccaacatagatgaccttaccatctcggtctttcataagatagacacccggcagcatggggagagttttcattttttcttttaacataggatctccttttacgctttgaataaaaagactataacaaattttgaaataatggacaagttttagggaattctatagttctgttcacagaaaatactttgataatcaaaatatgtgagatagatgatttttctaataaaagaaattataaatgctgatttatcagttgttttaaatgagtaaaatcttaaaaaaagctcatatagtaaaaaaatgatcttttaaggttgcattttgaaaaaagttaagatatagtttgaacatcaaaagatttgataatcaaactaattagtggacggtggaacatggaaccagatttaaaaacagtaaatgattatcttgttagtgtcttcaatgatattttgacaatcgaagagtctgagctgaaaaaatctcaattcaaagatctgtcaatcacagagatgcacacgatcgaggcaatcgggatgtacaagaaaaaaacaacttcagaagtagccaaagaactatcaattactgttgggaccttgaccactgctattaacaagttagtaaaaaaaggctatgtcgaacgtatccgcagtgaagatgaccgccgcgttgtaaagttgggactaacgaaaaaaggaaagttactatttcgggtccatcagcattttcatcgtgaaatggtcaagaacatcttagacggaatggctacggaggaacagcatgccttgctggatgcactgaaaaacttgcacgacttcttgcaagactataagtgaggatatttaatggaacaatttggaatgattactgcaacagccagcgtccttcctgaaaagattattactaataatgatctttccaagatgatggatacctctgatgaatggatttcgtcaaggacgggtattcgtgaacgaagatgtgtaacaaatcaggagacttctgatttatgcattttagtggcggaaaaattgataaaacagaaaaatctaaaccctaaagatttggattttattttagtagcaacaatgtcgcccgattacacgacaccatctgtagcagcacaagtacaagggaaattgggagcaactcatgctatcgcttttgatatcagtgctgcgtgctcaggatttgtttatgcgttaagcatggctgaaaaaatgatccgctgcggctcaactaagggactggtgattggtggtgaaacactatctaagctaatcgattggtctgatcgtacgactgctgtgttgtttggcgatggagcaggtgggattctcttagaagcgaatccacagaaaaaattgctgaaagaaaaattagcagctgacggtaccagaagtagctcattgaccgctggctaccagcaaaataaaaatccgttctattcagaagattcagaaggttcgtattatttgcaaatgactggcagagatatttttgattttgccgtacgagacgttgcaaacaatatccaagaagtcatgaaagacaaaccagttgattatctgcttttgcatcaggcaaacctcagaattattgagaaaattgcccgaaaagtaaagatgccgcaagaaaagttcctgaccaatatggataaatatgggaatacatctgctgcaagcatccctatcttattggatgaagcagtttctagtggaaagatcaccttaggaaaacagcagaaagtaatatttacaggctatggcggaggtttaacatggggaagtattctcatggagttgtagactgttaaattataaaaataaaaagcaaacaatatcggaggaatatattattatggtattcgaaaaaattcaagaaatcatcgcagaagaattaggaaaagaaactgaagaaatcaaattgactactgacatccaagaagacttagaagctgacagcttggatttattccaaatcatcaatgaaattgaagatgaatttgacgtgaaaatcgaaacagaagacggaatcaaaacggttcaagatttagtgacttacgtagaaaaacaaactgcataatcattaaaattaggttgggggctgggacatttcctgaaataggaatgtctcggcctttttgaataggaagaatcaaacatatattctggatatattggagaaaaacatgaaaacagcattcttatttagtggccaaggtgcacaatatcaaggtatgggaaaagatttatatgaagaagccgttgtaaagcagacatttgatgaagcaagtgagattctcggctacgatatggctgaactttgctttacagaaaatgaacgtttggatcagacgcaatatacacagccagctattctaacagtcagcatcgcgtattatcgcttattgaaggagcatggaatcatcccagatgcagctttaggactgagtttaggagaatattcggcattagtagctagtaatgcgctatccttcactgaagcagttgcgttagtagcaaaaagaggcgcttatatgacagaagctgccccagctggaagcgggaaaatggttgcagtgatgaatgcgccgattgaaacgatcgaggaaagctgtcatgaagctagcaagtacggcatcgtatctcctgcaaattataatacacctcagcagatcgtgattggtggcgaagaaaaagcagtagacgaagctgttttactattaaaagaaaaagggttcaaaagaatgatccctctaaatgtcagcgggccttttcatacagctattttagaaccggcagcaaaaaaactggcgaaggacctaagtcagattcaattctctgaaccttcttttcctatcataagcaacacaacaacggaaataatgaagaaagaaacaatcgcgggactacttgaacagcaagtcatgcaacctgttcgtttctatgagagtatccataagttaaaaacaatcggcatcgaacaagtcatcgaagtcggccccggaaaagtattaagcggatttatgaaaaaaatcgataaaacaataccagttctgcgtgttgagaataagcagacatttgatgaaacaatagcaatactataaggaggaacgttatggatgtaaaaggaaaaaatgtatttatcacaggtagtacaagaggaatcggcaaagcgatggccttagcttttgcaaaagctggagcaaatatcattttgaatggtcgcggagagattccaaaagaaaagatagaagaaatcgaagcattcggtgtaaaatgcgtaggagtttccggtgacatctctgattatgagaaagcgggacaaatgatcaaagaagcagaagaaaagcttggatcgatccatgtgttagtaaacaatgccggaatcacaaatgacaaacttgtgatgcgaatggatgcagaagatttcaaaaaatgtctggatatcaatttgattggaaccttcaatatgacgcagcacgtattgaaaaaaatgatgaagcagcgagaaggggccatcattaatctctctagtgtatctgggttgattggaaatattggtcaagcaaattatgcagctagtaaagctggcgtagtaggattaacaaaatctgtggcacgagaagctgcaactagaggcattacatgtaatgccattgcgccaggattcatcacaactgatatgacggaagttttagcagacaaagtcaaggaacaagcggaaaagcaaattccgatgcagcgtttcggacaagtagaagatattgcacaaacagcagttttcttagcacaaaatccatatatcaccggacaagtcatcaatgtcgatggcggattggtcatgcacggataagaaaaggagagcaaacaaatgaatcgagtggtaattactggctatggagtcacttcacctattggaaatgacgcagacagctttttgaatagcttaaaagaggggacgaatggcatcgcaccgatcactaaatttgatgcttcagaaacagggattaccttagcgggtgaagtcaaagatttcccttacgataaatattttattaaaaaagatagcaaacgaatggatatgttttcgatctatggaatctacgctgctttagaagcaatggagatgagcggtttagataaagaaaaaatgaatcaagaccggtttggcgtcatcatcggatctgggatcggtggtcttccaacaatcgaaaaccaagttattcgtctacatgaaaaaggtgcaaaacgagtttctccaatgttcgtaccaatggcgattgccaacatggcagctggaaatattgctttgcgtgtaggtgcaaaaggtatttgtacagctatcgtaacagcttgtgctagcggaacgaattcaattggggaagcattccgtaacatcaaacatggctattctgatgtcattcttgctggaggaacagaagcaacgatttgtgagatggggattgctggatttgcagctttaacagcactctcagaatcaactgatcctaatcgtggttcgattccgtttgacgaaaatcggaatggttttgtgatgggtgaaggagcaggcgttctagttcttgaatctttagaacatgcacaagctcgcggtgccaaaatctatggagaaatcgttggatacggtgcaaactgtgacgcttaccatatgacagctcctactccagatggttctggtgcatctaaagcaatgaagcttgcgatggaagaagctggtgtacagccggaacaagtcggatatatcaatgctcacggaacaagtacaccagccaatgaccaggcagaagcaaaagcaatccaaatcgcattaggtgaaaatttcagagatacttacgtcagcagcacgaaatcgatgactggacatttattgggagcagccggcgggatcgaagccttggcaactttgctggcattagaacatcaatttatcccacctacgatcaatgtagaaaaacaagatcctgagattgacttgacagttgtcaaaaacgaaagcaaacctgcaagttttacttatgcaatgagtaattcattagggtttggcggacataatgcggttctgtgcatgaaacgctgggaggaataattttggatatcaatgaaatcagagaattagtcagtcaatttgatcaatcctcgctaacggaattcgatttgcgtgaaggtcaatttgaattgtatatgaataaaaataaaacaagtcgaggcatgaatatggttcaaacaaacgaaacgttgccagtttcggagccagtcaatgtcatatctgaacaagcaacaactgctccagaaataatgaaagaaaaagaatcggcagtatttgatggaatcgaggttgtttcgccaatcgtgggaatcgtttatctgcaaccagcgcccgacaaaccagctttcaaaaaagtaggtgatcaagttgccaaaggagaagttatctgcattattgaagcgatgaaactgatgaatgagataactagtgaggccgacggagtgatcacagaaatccttgtagaaaacgagtcagttgtcgaatatggacagccactctttaggattcagcaaaaataagcaaagcaggaaagagggaaaacaatgaacatacaagaaataaaagaaatcattccacatcgttatccaatgcttttgattgatcgagtggaagaaatggttgaaggagaacggatcgttgctaagaaaaatgtaacgatcaatgagcccttttttcaaggacattttccagaagaacctgttatgccaggggtattgattgttgaagcaatggctcaagcaggagcagttgcattactttctcttgaacaattcaagggaaagacggcttatttcggcggattggacaaagcaaaattccgtaagaaagttacaccgggagataccttataccttgaagttgagatattgaaagtgaaagcttcagccggaataggcaaaggaatcgctaaagtagacggtaaaaaagtagccgaagcggaattaacctttatgattggataggtgaaatatgttttctaaagtattgatagctaaccgcggtgaaatcgctgtacgtatcattcgtgcatgccgcgaactagggatccaaaccgtagcgatatattcagaagcagatgccgaagcacttcatacacagttagcagatgaagcaatctgcattggcccggcaaaagccgttgattcatatctgaatgttcaggaagtactgagcgctgcaatcgtgacaaaagccgaagcaattcatccaggatttggttttttatctgaaaatagccgatttgcctccatgtgtgaagagtgcaatatcacatttattggtcctaaaagtgcaacgatcgatgcaatgggaaataagatcaatgcgcgtcaattgatgcaagaagcaaatgtcccagtcattccaggaagtactggtgtattatctacagtagaagaagcattggaaatagcagacagaattggttatccagtgatgctgaaagcagctgcaggtggtggcgggaaaggcattcggaaagttcaatcaaaagaagagctcccacagcatttttcttcagctcagcaagaagcagcagcggcatttggaaatgatgatatgtatttggaaaaaatcatttatcctgctcgccatatagaagttcagatcttaggtgatcgatttggtcatgtcattcatttaggcgagcgagattgttctttacaacgcaacaatcaaaaagtactggaagaatctccttctgtagtgatctcacaaacaaaaagagaagcactaggagacgctgctgttcgagcagctaaagcagtcaattatgaaaatgccggaacgatcgagtttctgatggatgaagaaggcgatttttatttcatggaaatgaatactcgaatccaagtggaacatccagtaacagaaatggtcacaggaatcgatttagtaaaaaaacaggtggagatagcagccggtgagcctttgaatgtgtgtcaagaagaagtagtattccaaggacacgcaatcgaatgccggattaatgcagaaaatcctgctttccattttgctccttctccagggaagatccaaaacttactgcttccagcaggtgggatgggactgcgagtagacagtgcagtttacccgggatatacgatcccgccatattatgattcaatgattgcaaaaataatcgtccatggaaatacgcgttttgaagcattaatgaagatgcagcgagccttaagtgaatttatcacagaaggaatcatcacgaacgcagaatttcagatggatttgattagtcatcctgcagtcatagcaggtgattacagcacagcatttttacaagaagaatttttaccgaattggacaccagaaacggagataggaggcgcatagatggctctgtttaagaaaaagaaatatattcggatcaatcctaatagagagagcaaacctgctaactcgccatctgttcctgataacatgtgggcaaagtgtccaaattgcaaacatatcctttatacgaaagacatcggtgaagaaaaagtatgccctcattgcggatacgcttttcgaatcggtgcatggcagcgtctagctttgattattgatgaaaaaagttttgaagaatgggatacggatcttgtaaccaaagatccgctagcatttcccgaatatacggaaaaaattaaaaaaatgcaagataaaacaggacttcatgaagcagtcctcactggtaaagcaaccattcaggggattcccttcattattggagtgatggatcctaattttatcatgggaagtatgggaacgattgtcggagaaaagatcaccagattattcgaacgagcaacaaaggaaagtcttccagtcgtcttgttcacagcttcaggtggcgcacggatgcaagaaggaatcttttctctaatgcagatggcaaaaatctctgctgctgtcaaacggcatagcaatgaaggtcttttttatctaactgttttaacggacccgacgaccggaggagtaactgccagttttgcaatggaaggcgatattattctagcagaaccccaaagcttgatcggttttgctggaagacgcgtcatcgaacagacgatcaagcaggaacttccagaagatttccaaaaggctgaattcttattatctcatggttttgtcgatcagattgttccccgcatggaattgaaacagaaaatccatacgcttcttgaattgcatacacagaaaggatggatagatcgtggataagacagcacatgatgtcgttcagttagcaagagctaaagaacgatggacaagcttggatttttttgaagagatcttcgattctttcgaggaatgccatggtgatcgtttatttgcagatgacgaagcgattgttggtggaatcgctcgattagatggcaaaccggtaacagtgatcggtattcaaaaaggacgggatctgcaggaaaatatccgcagaaattttggttctccccatcctgaaggctatcgaaaagctttacgactgatgaaacaagcggaaaagttcaatagaccggtgattaccttgatcaatacagcaggtgcatattgcggtgtaggagcagaagagcgcggcgaaggagaggctattgccagaaatctgctcgaaatgtctgatttaaaggtaccgatcatcgccatcatcattggtgaaggtggaagtggcggtgcccttgctctaggtttagcggatgaagtctggatgctggaagaaacgatttatgctgtgctttctccagaaggatttgcgtcgattttgtggaaagacggtagtcgcgccgcagaagcagctgagttgatgaaaattactgcgccagaactacgcgagttaggaatcgttgatcgagttattcctgaaacgttcaacggcgagcagttgccacgatataaagtcgcacacattatgaaaaaagcgttgattgaaagattgacggaacttgttcgattagatcagcataaattactggaaaaacgatacaagaggttccgccaatattagttgttttttgtttctaaatttttctgtgatcaatctttatttttggtcattttgtaaagaaatgctttttctgaaagacgaacgagtatagaggtagttttttttgctgatatgcagtataatacggggttgaggagtactttatgtgctccttcattttttgcagatgaggagacagcatgttttcaaattacaaaccaacatggatggtagaagccatctatcagattacacctgcccaattaaagaatctaggcatcaaagcagtattgaccgatttagacaatacgttgattgcatggaataatccagatggaacagaagagttgcttacttggattttagaaatgaaaaatgcaggaatccctgttgttgttgtttcaaacaataattcaaaacgtgtcgcgcgagcgattgaaaaatttgatcttttgtatgttgcacgagcaatgaaacctttagcaagagggatcaacatagcaaagaaacaattggatttagcagatgatgagatagtaatggtaggcgatcagattatgactgatatacgtggagccaatcgtgcagggatacgtagcatccttgtaaaacccattatcgcaacagatagttggaagacacaatttaatcgtttttgggaaaaaagaattatggcctatctattagcaaaacaccctgatatgggctggcgaggtggaatcgaatgacagaagaattacaatgtatcggctgtggtgccgttatacaaacaaacaaacccggtgaattaggatacacgccgcaaacggctttggaaaaaggtttagcttccggggaagtctattgtcagcgttgtttcagattacgccattataatgagatccaagatgtctcattgacggatgacgactttttgcgcttactgaatgaattagggcaaaaagatgcattgatcgtcaatgtggtggatatttttgacttcaatggttcactaatcccaggactacaccgttttgtcggtgacaatccagtacttttagttgggaacaaagtggatatattacctaaatcattgaaaaaaactaaattaacacaatggatgaaggaacgtgcttacgaagcaggaattcgtccagtagatgtattattaactagtgctaagaaatctcatgagatgacggaactattagaaaaaatcgaagaataccgcgatggacgggatgtctatatcgtcggagtaacaaatgtcggaaaatcgacgcttatcaatcaaatcatcaaaaatacagcgggagtacaagatgtaatcacaacttcgcagtttccaggaacgaccttggataaaatcgagattcctttagatgacgggcattttttgattgatacaccgggaattatccatcgccatcaaatggcgcactacttaggtaaaaaagatttgcggatcattgcaccgttaaaagaaatcaaacctaaagtttatcagctgaatgaagggcaaacacttttcttgggcggacttgcaagatttgattttatcagcggcaatcgtgcttcatttattgcttatgtgtcaaatgatgtaaatattcatcgaacgaaactggaaaaagcagacgaattttatcaaaaacatgtaggtggattattacagcctcctcgtcctgatgaagtcgaggcatttccggagcttgttcgttttgagttttctgtgaaagaaaaaacagacatcgtttttgccggtctaggctggatcactgtaacagcgccagtagtaattgcgggctgggcgccaaagggtgtagatgtattgaaacgcaaagcattgatttaaggaagaaggaaaattatgagtttaagaggaaaacaaaagcgttttttacgtagcaaagcgcatcatcttcagccgatttttcaaatcggaaaaggtgggatcaattcagcaatgatcgttcaaattgaagaagctttagaaaaaagagaactgatcaaagtatcgttacttcaaaatacagatgagattgcagaagaagcagctcaagtattagaaaaagaaatagattgcgaaatcgtccaaatcattggacgtgttattgtattatacaaaccttccacaaaagaaaagtatcaaaggctatcaaaagaagtaaaagcaatataaggagtgaccatgatgaatacgcaagctaagacatttgttcgttcacaattatttcctgaagaaatgcctcaattcttagagaagaaaaagcaagtagggatcttgggcggaacattcaatcccgttcaccttgcacatttagtgatggctgaacaagctggccggaatttaggtcttgaccgcgtatttttgatgccttcttatcagccacctcatgttgatgagaaacagacgattgatgcaaaacatcgactcaacatgttggaattagcggtggaagacaatccttttttgcagattgaaacgattgaattagctcgtggtgggaaaagttacacctatgatactatgaaggaattgacgcaaaacaatccggatacagattattactttattatcggtggggatatggtagaatatttgccaaaatggtataaaatcgatgagctgacttctatggtcaactttgtgggtatacgtcgaccaggatacacaacggatactccatatcctgtaatttgggtagatgtacctgagatcgacatcagttccacgaaaatacgtcaaaagatcaaagaaggctgttctatccgctaccttgttccagataaagtaattgattatattcaaaatgaagggttgtatgaatatggactatagtaatgaatatactgcttattctagagaaaacctgatgcaaaaaatacagatgagaatgagcgaacaacgcttcaagcatgtgcttggagtagaagaaacagccgtggctcttgccaaaaaatacggtgcttctcctgaaaaagctagtattgctgcattgacacatgattatgcaaaagaacgaccagatgaggagttcaaaatggtaatcgtaagagacggttttgatccggagttattgaattataataatgcaatctggcatggtcttgttggcgcttcgtttgtagagcgggaattaggaatcaccgatgcagagattcttcatgcaatccgggtgcatacgactggggctgctaagatgagtctccttgacaaaatcatttatgtagcagactatattgaaccaggtcgagattttcctggggtacaagatgcacgagccattgcatgggctgatctagacgaagctgtagcatttgaaacaaaacatacattggcccatttgcttgcgcaagaacaacagatttatccaaaaacaatcgaaacatataattactgggtagcaaaaaaataagctgctcatattaggaggaaatcatcatagatagtaaagaacaattaaaaattgcgattgaagcagcagattcaaaacgggcagaagacattatcgctttagacgttcgaaatgtttccttgttggcagattatttcatgatctgttcagcaaatagcgaacgtcaaatcaacgcaattacagaagaaatcattgataaagaagaagaaaacaaatatgaagtaaaacgtattgaaggaaaagaaggcggaaaatgggtattgatcgatcttggagatgtgatcgtacatgttttccatgcgccagaacgaaatttctataatctggaaaaactatggtcagatgctccgctagtcgatcttagtgaatggttggattaacatatggcttatgaaacatttgctttcatttacgatgaagtgatggacgaaacactttatcagcaatggttagctttttcgaaacgtcatttacaagaagacacaaaaaatattttggaactggcatgcggtactggagcattagcggttgcctttgcaaaagatggatataaagtgacagggttagacctttcagaagagatgttgatgattgccagccagcgagcatatgaagaagacgcatcgatccaatttgtggaaggcaatatgctcgatttatcagaaatcggacaatatcaggcaattacctgtttttctgattcgctgtgctatatgaaaaatagacaagaggtacagcaagtgtttgatgaagtctatcaagcgttagaagaaaatggccgatttttatttgacgtacactccacctatcaagtagatgaggtttttccagaatatagctatcattatcaaggggataattttgcttttttgtgggatagttatccaggaagcgagaaacacagcatcgaacattttcttacctttttcgttgaagaacaagaagggtctggtcgatttattcgtgaagatgaactacatcaagagcgtacctatccattggaaagttatttaagaatgctggaaaacagcggcttttcgaaagtcgaagcattttctgattttacagacgaagcagcatcagagaaatcaaagcgctggttctttgtagcatacaaagactagcggttttgcctgctcgagttaacaagaaaagaataaatcttcaacataaattatatatccgaacgatataggcattgctcttgcagtgcagcttttcgtcgcagaagtattgtgtttgcgagaatagtttatatagttcgggtattttttccgatttttgcctttttttacttgtctctatttcttttttatcgataactatgaaggaggatgcgcatgaaaagctgcgggattatcgtagagtacaatccttttcacaatggacatcgctatcatgtggaaatggcacgaaaaataacaggagcagaggtcgtcattgctgtaatgagcgggaattttttgcaaagaggcgaaccggctatcatcgataaatggcatcgcgcgaatgaagctttacaaaatggtgtggatttagtagtggagcttcccgtcgaatgggcggttcagtcagctgactattttgctaaaggtgcagtaaaaatcttgcaaacactggactgtgacagtttgtgttttggaacagaagaagagacttcgtttgattacagcagtttcggacgctttgtccaagagaatcaagataggatagaagaggcatttcaagaactgtctgatcaaacgtatagttatccgcaaaaaatgactgaggtttttcgcagtctgtatcccgatattacgcttgatttttcttcgccaaatcatatcttgggattaagttatgcaaaggaaaatgccaagtatgtccaccctatggaattacatccgatccgacgtaaaagtgcaggctatcatgaaaaaatcatcacagatcagaggatagccagtgcaacagccattcgccatgcgttagaagaaggaaaaagaatagctggacttgtgccgcctcagacagaagaagatctttcaacttgttcgctgcagacttgggaatcttattggccgtatttgcgttatcggttgttatcttctactttgctggaactgacagatatctatcagatgaccgaaggaatagaatcgcgcatgaaaacagcagctgcaactgctgatagttttgaggattttgtgtcaaaggtaaaaacaaaaagatatacatggacacggatccaacgattatcttgttatgtcttgctgaatatcaaaaagcaagagattcctgtccaacaaaataaaaattatcttcgactacttggatttaccgatgctggaagaagattcttaaaagaaaaaaaagagatttctatttattcccgaatcggaaaaaaagaggcacaagaagcggaactgttagttagaagtgatcaaatctatcaattgggaggcaatattccggaacagaatttcgggcaaatcccaatccgagtatagataattgactaaaaatgagaagaatgaaggaagaaagaaaaaaagcttcacagaatcgtgattcacaagtataatggaacaggacgtttttgcgttatgaaactatcaaatcagaaagcgaagtgaaaatatgggacgtaaatgggcaaatatcgtagcaaagaaaactgctaaagatgctaataatagccggatttatgcaaaatttgggattgaaatctacgcggcagcaaaatcaggtgatcctgatccgcatgcaaaccaaaaactacgtttcgtcattgatcgcgctaaaacttataatgtaccaaaacatattattgaccgagcaatcgaaaaagcaaaaggtgcaggagatgaaacatactctgaattgcgctatgaaggatttggaccaagcggctcaatggtgattgttgatacattgacgaacaatgtgaatcgaacagcagcagacgtacgggcagcatttgggaaaaatggcgggaacatgggtgtttccggagcggtttcttacatgtttgacaatacagcaatctttgcttttgcaggagaagacgctgacgagatccttgaatacctaatggaaaaagacatcgatgttcgcgatgtaatggaagaagaaggacaaatcatcgtttacggtgaagtagcggatttccatagtatacaagaagcattaaaagaaaaaggaatcactgatttttcaatcgctgagatccaaatgatccctcaaaacgaggtaacactatctccagaagatcaagaaacatttgaaaaaatgattgatgcactggaagatctagaagatgtacagcatgtgttccataatgtggcattagaagactaagcaaccagttttaacgaaaagtattcagtctttttcgaaaagcaagacaatctcactaacagattgtcttgcttttttgtgtgatttattttcttttctaattcaacctgtggtatgatgagagcataagtatcatgtgaaatgatatgaagtatgtggaagatggacggggaagaatatggaagcaaaaatcactttagaaccttttgaacgtatcttaagcggttaccgcaaagtagaagagttagctgtgaacgtaactgattgttcaaaattagcgcaaaaatacgcaagattcggcgttgaaggctatcgattaggaaactatgtcggtacagggtatctgaaccgttatttagagtgtatggtggaccgcgcaccaatgctgatttatagacaaaattatctgattccgctgctttttcgtcgttctgattcagcctttcggttatttgaagaagagtatcggatggaggctttctttctactattagagtggagcttgaaacatcgtcctgaaaaaattcttatcgaaagaaatgagaagatagacacgaaaaaaaataaagtgatcgatagtgcatacctagcatttcgtgtatcagagattttggattgtggcggctatccaatcagcaatttccaatcaattgaccaattcattgaatggaatcgaatttaccgattgatcgacaatggcgggattggccgtcatagcaaggtatttgacccagaatatccagaaaacatggaagaactgaaaatgattatttcgcttgtcaaattaaaatatcctgaaacagatttggatttatatatagaataaatgaccttaaatgattgaattactttttctgcaattattattgtaaataaaaagacaactgctaacattaatgatagcagttgtctttttacttacagtacttttttctcataagatgaaatatccatattgtttaacaaaggactttcattattggaggtaaaaagggtcaattcatgcatcgcacgtgtacacatggtgtaaaggatcaatttgtcttgctgagaagaaaaatgttctgcatctacatcccacaagaaaactcggtcaaactccagaccttttgctaaaaaggctggaagtaaaataatggaacgcttcataaagtcactctcatttaaaatcagctggacttgttgtttcaactcgtctggcagttgagcataaagagcttcgcattcttcttgtgttttagctatgattgctgtacgccaataccgggcttttccctgagtcgttcgaatggtatctgctaaccaattcaatttgatatcatctgttgttccttggatgagcaaaggaaggtctccttttcttgctgttgtttctacttgatgttctttcacaataaaatgattagcaaaatcagtgatttcttttgtggagcgatagcttgtcgttaattggaaacgagtgacttcacggtccacgaaaaggtcttccaatgatccaacgatcgtttcatttccaaagacattttgatttagatctccacagaaagtcaaatttgcttttgggaacaaggcttgcagcaatgccacttgtgatggtgcgaaatcctgcatttcatcaataaagatatagcgagctttgtgtgtaaccgtcactggatatgttcggcgcatcagtaaaaagaatagtacagcatcctcttgacgcaattctctttgacgcaagtgtgtacgaacagttgtcaaatgttcctgccacctggtctcgctgattttatgtcgtgttagaagagaaagtggcacagtttgtagaaagtggagatattgtttcgttatattgacaaattgataattcatgatccctcgatggattcgacggaatcttttacgtacgatttggttggccagttttttacgtaatgaacgctccttttgttctgtatattcaagatttggatctgttgcgtatagttcttggagctgttcttccgccagatctttgacccattgctgacgtgtttcgtctttttgcagaccgcctaattttttcaggagcttcgtttgtaatagagaaagtctatgatgtaaaggtaattgttcatttgtttctttataccattggcgaatcgattcctttgataggatcgtacggccatttattttcatatcacggaacaagggaccgtagtttgtgatgccttggatatagcgatcaatctgatcgactaaggtcaatccgcttttcatcacttgtatcggatctttttcccctagcaaaaaaccactttcttgttgctgttcatctagtaaagaaaactctggcagcagctgcaccaaataatttttgaatgtctgtgtaggcacgccgctttcacctaatgaaggcaatacagtcgagatgtaatcagaaaacaaatggttgggtgaaaatagaagaacgttttcagcctcgagccacttgcgattatgatacaacagaaaagcaatacgttgaagcaaagcggatgtctttccacttccggcgattccttcaatcagcattactttacttgttgtgtcccgaatgattgcattttgtgctttttgtatcgtagagacgatgtttttcatatggttgcttgatgattcatccaatatctctagcaaaaagtcatcattgattacttccgacgtatctaccatagataaaatacgtccttcttggattttaaattgtcgtttcaactgcagatcgacatctattctatctgtttcagtttcataaaatgcgggaccaatctcaccttcataataaagattggcaattggtgcgcgccagtcaataacgattgtttcttctgccagatctcttaaagaagcgatacctagatataatgtttctgtttcacggtcttctttaaagtcgatacgggcaaaataaggactatctttcatgacagacaacgtttgcaggcgtttttgctgtgcttcaagagtatggtatttcaaaagcaattcctgctcatgttggcgatattcaacagcagattcataaaaagcttcattggaaccagctcgaatcttgtgattagctgtgtcttttgtcgaatgattcatttcctgagtcaattcttgttgttttgtatccagcatattttgttcgatctggattagttcgatcgtttcatccacgtgcgtttgttctagttgtttctcattcatcgcatgtttgctccttccgccgtaaataacgaattaaaagtatagcatagtttttcgaaaaaaggtactttttaactgatgaatcgaaaaagtaatccttgctgaatatttttgtttgtagaactgatgaattttggaaacgctgatagtgatagttgttttcaattaaggcctattgttttaaaaagtgctagtcaaggactatgcttaagatgaaagaggcagctggaaatttattactaacctctctaagtcacataaaagaggagaaaaaacaatgacacatttcaaaaaatttttacttactttgcttattggtgggatagctttattaagtgaatttgtttttcaccagccggcccttgcatttgcgattgtcgcatttactggagggattctcgccttcttgatgtttttggaaatgatcaagacgttacgttcaggaagatatggcgtagatgtattagcgattaccgcaatccttgcaacattagccgtcaaagaatactgggctagtttgatgatattgatcatgcttacgggcggagatagtctagaggattacgcgaataaacgagcgggtaaagaactgcagtctttgttagataacaccccaagaattgcccatcgattcaaagaaggaaaattgcaggatatagtaatcgatgaaataaatattgatgaccagttactagtcaagcctggcgaacttgtacccgcagatggtcgagtgaccaaaggagaatcttcggtcgatgaatcttctttgacaggtgagtcccgcccggaaaccaagaaacctggagatcagattatgtcagggtctttaaatggagacggatcgatccaaatgatcgctgaaaaacgtgccgcagacagccagtatcaaatgattattaaactagtcgaagaatcaaaagaaaagcctgcccgatttgtccgtttagctgatcgttatgcagtccctttcacgttgattgcttatttgatcggtggtatttcttggtggttctcaaaagaccctttacgatttgctgaggtactggtagtggcatcaccttgtccactgattctagctgcgcccattgctttagttgcaggaatgagccgttcaagtaaaaacgggatcgttgtaaaaactggaacaacgattgaaaagctcgcacgtacaaaaacgattgcttttgataaaacaggaacgcttaccaaagggatattggaagtagaggcgattcagccagtcaatggaataaaaaaagaagagctacttctgtatgcagctagtgcagaacaggaatctagccatatcttagctcgttcgttagtgaacaacgtgaaaaacagccaactgtatcctgttagtcaactgaaagaagtgaccggtcaaggaatccaagcagtagtcaataatcatgaagtaaagattggacgtgcctcttttgtttcagctgaagaaatagaaacgtccaatacagcaatctatgtaacaattgatcgatcttttgcaggaacgatcctattttcggatcagattcgcccagaagcagcaaagacaatcaaggagctaagaaaacttgatgtgaaaaatttgatgatgatcaccggggatggatctgccattgctcaaacgattgcagaaaaagtccaattagattctgtacatgcccgtagcttgcctcaagataaactgaccattttagaaagtatccctaaagatcaaagacctgttgcgatggtaggagacggcgtgaatgacgcaccagcacttgctgctgcagatatcggtattgcaatgggggctcatggttctacagctgctagtgaaagtgcagatgcggtcatcttgaaagatgatctcttgcgtgtagcaaaagcagtagtgatttcaagagatacgatgagaatagcgaaacagtctgtactgattggcatctttatttgtatttttttgatgttaattgcaagtacgggactaatccccgcattattcggagctgttttgcaagaagtcgtggatacggtctctattttgagtgccttgagagcaaaaaaagatccagccatttttcctgattcagtacccaagacaaacatagtatgatagaatcgagttgaaaaaagaacgatcagaaagaggagagagcattatgccattcgtacatgtcgaattagtagaaggtcgcagtccggaacaattagaaaatatgatgaaagatatcacggaagctgttcataaaaacacgcaggcaccaaaagaacacatccatgtcatcatcaatgagatgaaaaaaggaacatacggtgtaaatggggaatggaaaaaataagtttagtttcccacttgatttttctatttattagtggttaaataaacacataattgattgatgagaaagccaactgaatttgagagtcttcgataagagaggaaaagctaggctgaaacttttccaggagaaaaccaaaggatgaccactttcgaaacccttgttgaagcaagggcggtcggaccgttacaacgcttgaggaacgcatttgcgtttgaacattaggtggaaccacgaacttttcgtcctagtatctcttttcaagagatgctaggatttttttgtttttcagcttgatgatctgatcaatcaaaacatttcaaggaggaaactattatgataaaaattacttttccagatggtgcagtcaaagaatttgagtctggaacaacaacattggcaattgctgaaagcatttcaaaaagcttagcaaaaaaagctttagctggtaaagtgaacggaaaactcgttgatttgactcgtccaatcgaggaagatgcaagtattgagatcatcacaccagaccatgaagatgcacttggcttagtccgtcattcagcagctcatttgatggcccaagccatgcgtcgcctctatccaaatatccactttggcgttggaccagctatcgattcagggttttactacgatacagataatggacaaaaccaagtaactgcagaagatttgccggcaatcgaagcagaaatgatgaaaatcgtcaaagaaaatctgccgatcgaacgccgtgttctttcaaaacaggaagcattagaaatttttgcaagtgatccgtacaaagtagaactgattagtgaattgccagaagaagaagtgattactgcttatcaacaaggcgaattcatcgatttgtgtcgtggaccacatgttccatccactggccgtatacaagtatttaaattattatcagtggcaggtgcttattggcgtggaaactcaaacaatcaaatgatgcaacgtgtatacgggacagccttttttgacaagaaagctttgaaagaatatatccgtctccgtgaagaagcaaaagaaagagaccatcgtaaactaggaaaagaacttgacttgttcatggtttccccagaagtaggttctggtttgccattctggcttccaaaaggggcaacaatccgacgcacgatcgaacgttatatcgtagacaaagaagttagtctaggttaccaacatgtatatacaccaataatgggagatgttgagttgtacaaaacatctggacactgggatcattatcaagaagacatgttcccgccaatggatatgggagatggcgaaatgcttgttcttcgcccaatgaactgccctcatcacatgatggtctacaaaaacacgatccattcttatcgtgaattaccaattcgtatcgctgaattaggaatgatgcatcgctatgaaaaatcaggtgctttgtcaggtttacaacgtgtacgagaaatgacgttgaatgatggtcatacatttgttcgtcctgatcaaatcaaagatgaatttaaacgtacgcttgaattgatggtggcagtatatgctgacttcaatattacagattatcgtttccgcttgagctatcgcgatccaaacaatacagataaatattttgatgatgacgcaatgtgggaaaaagcccaagcaatgctgaaagccgctatggatgaattagaactagattactttgaagcagaaggcgaggcagccttttacggaccaaaactagatgttcaagtcaaaacagctcttggtacagaagaaacattatcaactatacaattagacttcttattgccagagcgctttgatttgacatatgttggagaagacggggaaaatacgcatcgtccagtagttatccaccgcggaattgtttctacaatggaacgttttgtcgcttatttaacagaagtatacaaaggcgcttttccaacatggttggcacctatacaagcaacaatcatccctgtttctgttgatgcacatggcgattatgcttatgaaatcaaagaacgtttgcaaatgaaggggttgcgtgtagaagttgatgatcgtaatgaaaaaatgggctataagatacgtgcctctcaaacacaaaagatcccttaccaattagttgttggagacaaggaattggaagatgcaacagtgaacgtacgtcgttatggaagtaaagaaacagctgtagaagatttgaatatctttattgatgctatggaagcagaagtcaaaaattacagcagagaaaactaataggtaaatttcctgtaaaaaagtagtagatagaaagcaatccgaacaatagataacaggtattcctcaaagacacagatgctcaatagaatctgtgggattgatgggataagatattctgttgggcggattgtttttttgttttttatccagtatacgaccgtgaataagggtctgatatggtatacttacatagactatcattaaaagggtggaggaacttatgagcgtaattagtcgtattgaaagtatgatggaagattattcttcagcagaaaaaaagttggccaactacattatcggtaatattgagaaggtccctacaatgacagctaatgaattagcagaagcttccgggttgagtgcgccgacagttgtacgtttttccaaaaaaatcggttttcaaagtctgacggacttcaaaatcacgatttcaacagaactacagactggaatcgatgaaggttttagtgatatagaagcaaatgagtccttttactctatcaaaaacaaacttggtaacaatgcacaagtagcgataaaagaaacagtagatattctagaagaagaaacgatccaaaaagtcgtagagtgtttggaatcggcagagactgtttttttatatggggttggcgcctcttctttagtagtagaagatattctgcaaaaatggtctcgtgtcggtaagccaatcatttttgaaaaagatatccacgtcttgctcccgcaacttgtcagcaatgagaaaaagaaagtgctttggcttgtttcaaactcaggtagaagtgcagatgtagtcgcattagccgagctggcgaaaagcatgaatatcgaaatcattgcgttgacgcaatttggaaataacccgcttagcaagatagccgatgtactcgtacaaacatctagaccaaaagaaatcacgaatcgaagtgcggcaactaattcacttttggcccaatttgctacgatcgatatcattttttatttctatatggctaaaaacgaaaagcttagcgaaaaagtgaaaaaaacacgagaagcaatccaagaatattttatggattcgaaataaaaaccttactattttttatataagttttttagaataacaaaacgtagttttccacaaataaatgatccatcaaagtgtttcacgacttaagaaaacataattttcaaaaataagtttattttttaatgaaaaaaatagttggatatgtaactttaagtgattgctgtgaaacaaaaagttgattttatcttgaaattaggtaaagaatttcttgctccgcccattttttcttttttattaagaagtttttgggtacaatgaagcatgaatgtaaataggcggaaggataggaaatgatgaaagattttatgaaaaaaatattaaatacttcttggttagaaaaaataagaaaaggtgcacaagaacctaagaacaaaacgtttcgccggtcccatgttccttttcgcttaaattttctttttttcattatatttacgttatttgttgcgttgattgctagattgggttatttgcagatcgtgaacggcgaagagatggaggcgcgagtgaagtctacttctacgattacggtccaagaaagtactcctcgcggaatgatctacgactccacaggaaaagctttagttacgaataaagcgaatcaggccatcacatatacgagaggaacacaagttacggctaaagatttgcttgaaatcgcaacgaagctgaactcgctgatcgatgttccggtagatgaaaatctgacagatagagataaaaaagatttttggctggctgatcccaaacatttgaaagaagccacaaaaagactttcggcaaaagaaaagcaattagggaacagcgaacaatatagtgcgatggtcaataaagtcacagctgatgagattaatttaaacgaggagcaattaaaaattgctaccatctttaaacggatgaatagtgcatatgaattaaacactgtctatatcaaaaactctggtgttactgatcaagagttagctgttgtggcagaacgcgcttctgaacttccaggagtttcgactggcacagactggacacgagaatataatgcagcaagttcactgaaaagtattcttggcagtgtgacgactgaaaagcaaggacttccagcagatgaagcagagaaatacctagcaaaaggttattctcggaatgaccgtgtaggacaaagttatttggaaaaacaatatgaagatgtcctgcaaggaaccaaaacccaatatgaagtttcccttgataatgaaggaaatgtttcgaatcaaaaagaaatcttctctggggaaaaaggttctaatttaatgttatctatgaatgcagaattccaatcaaaagtagaagaaattttgaaaaggaattatcaaacattgatcaacaacggcaaagcacagtattcgcctggtgcttatgcagtggctatgaatcctcagacaggagaagtgctagcaatgactggtttcagtcatgaacaaggttccaaagaaatcaccgagaatgctttaggcacgattactagcgcctttgctccagggtctgtagtcaaggctggtactttgacagcaggctgggcaagtaacgcgatcagcggaaatcaagttttgattgatgagccgattcgtctgcaaggtgcttcagaaaaaagctctgtctttaatcgaagcggacaagttgctcttgatgcagtcaaagcattggaattgtcttctaatacgtatatgatcaaagtggcgttaaagatgttaggactagactatacacctggaatgggactacctagtttagatgaagaagctaaagcttatcagcaattgagagactctttcaaagagtttggtcttggtacaacgactgggatcgatttgccgaatgaatctcctgggatctcacgttctgttgattatatgaagaagttcaatgcggataatggcaaagaatggtatactccaggtaactttaccgatttggcatttggacagtttgacacatatacaccaatccaattagctcaatatgcttcaacagtcgctaatggcgggaaacgagtacagccgcacctagtcaaagcgatctatggcaatgacgaaaatggaaacttgggtgaagtgaagaaagaaattggcacaacagtagaaaatacggtcaatatttctgcagaaaatatggcgatcctccgtgaaggattccaccaagttgtccatggtaccgatccttacacaacagccaaaccattagccagtgcgaaaatggacctttccgcaaaaacagggactgcagaaacggttgcggaaggtcatccagatattacgacagtcaatagtaatatcgtggcatacggaccaacagacaatccggaaattgccatcagtgttgtcttgccgaacttattagacgaacaagaccacatgaacttgacgattgctaaagaaataatggacgcgtattatgatatgttcatggcaaaataaaaaagaggtcgtgaaaaagccgcttagtttcgagtatgaagaaaaattttgtgaaaatagcttctcacatttttgcttaaatttgacttcataccgagaaactggcttttgaacaccgtttactcggcaaaaaaggggctctttgtcaaatgatgttggtaaagagaaatcttagaataatttggacagaacagaaagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcaaatagtgactgatctcttttctttaccgcataaagaatgtcttggtataactgatagccttggcgtaagttgggacaagcagctaacagtcgatcggcaatctcactttcagtcaaataatctttaaaactggcacgccaaacccgtttttcatagtttaactttgcttcttctttttgtaggagtttccaatagcgcttcaattttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaatgaaaaccgagaaaaatagcgttctaaataaggcaagcgtcgattttcgacaatatccaataatgcatggctttgtccgtccatcatgataaaactcattgcactggcaacacttcgaaccgatttgaattcatcaaagcataagacctttggcaaagtctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatatttttttatacaaaaaagatgttggtgaagttcaccaacatcaaaaagtatagagccaaaaaaggttgtgacaaaaattgtcacaacctcttttttgtggaatctaattctctattatagtttaagtagtttttccagataaacagctaaaccgtcttcctgattgctcaaaggagtgacatcatttgcaatgcctttgagttggtcagtaccgttagccatagctactccccaacctgcataatccaacaattccaaatcattatgctcgtcaccaaaggcaatgacgtctttttgatcgatagacaggtagttagcaatctcttgcacgccttttgctttttggattccttttgaaacaatctctaagatggcagtaggtccaccccatgtccgaacatcgacataactgccaaattgacgtgttaattcagcagatacagctcctgcaaaacgtttgtctgttcggacaagcaaagatgtaggatttgtcgtcaaatttttaggagaaagcaaattcttctctcctggacgagaagaagcaaaaattttttcatcaaagaaatcaaaactgtcaataaaaaaagtatcacgattttcagcagcgataaaatctaaatttagctgctttttttgcgataagatttcaaaagcgatttcacgattgatcaacgtttctctttcaccatcccagtgctgattagggatgtgtactaatgcgccgttaaaattaaccatcggtgttgttaattctaattgttggtaaaactgatggctcattcggaatgggcgtcctgtagcaatactgacatgatgaccggcattgattgcttttttcagagtctcttttgttttagatgtaatcatcgaatcttgattgagggtagttccgtccagatcgatggcaattaattttttattcaataagggtccttccttcctcaactagcatttgttttagtctagcatattttaggtaattaacaagagcaatcagctattcctaacaaaaactacagttatggctatataaatagctaaacataagctaaacacgaacgttaagtattattttcgctttttttgttaaaaaaacgttgaaaagcgaatgaaacgtctatataatttgaaattgttcgatggatttgccctattttacttattttttattattatagttttccatcagaaaaaaattcagggagtggaactttttatggaaaagtttttcggtttaaagaaaaacaatacaaatgtatcaactgaaataatggcgggagtaacgacattctttgccatgagttatatcttattcgtaaatccgacgattttgtcagcatcaggtatgcccttccaagcagtatttctagcgacaatcattgcatcgattattggtacgctggtaatgggattgttcgcaaatgtaccatatgctcaggcacctggtatgggattgaacgcatttttcacttttacggtcgtttttgggcttggttattcttggcaacaagccttggcaatggtgtttatttgcggattaatcaatatttttattactgtcacaaatattcgaaaaatgattattcgggcgattcccgaaagtcttcaacatgcgattggtggcgggatcggtattttcgttgcgtatgtcggaatcaaaaatgcaggattcttatctttttcagcagaccagtcagctatttcgagctctgtcgttgaaggcggaaaagcgacaaatgttacgataaatggtggaatcgtccctgcgttagccaactttgacaacgctcctatcttattggctgtgattggtttggtactgacagccattttagttgtaaaaaatgtccgtggggctattcttatcggtatcgtagcgaccacagtccttggtatttttatgggtgttgttgatttaagttccattgattggcaaacgaattcgttaggtaattcatttaaagaattaggaacaactttcggtgcagcatttggttctgaaggcatgcaatctttattcagtgattcttccaagattcctcaagtattgatgacgatcatcgcattcagtttatctgatactttcgatacgatcggaacatttatcggtacaggacgccgcacaggtattttctcaaaagaagacgagatcgcgttggaagatggtcgtgggttcaaaacaaaaatggataaagcactatttgccgatgcgatcgctacttctgtgggggctatctttggtacatcgaatacaacaacttatgtcgaatctgcagctgggatcggggccggtggacgtactggtttgacttcagtagtagtggcagtgctattcgcattaagtagtttattctctccactgatcgccattgtaccaaatcaagcaactgcgccagcattgattttagttggagtaatgatgatggcttcttttgcagacatcaaatggctagatatggaagaagctttaccggccttctttgcatcgatctttatgggattgtgctatagcatttcctatgggattgcagcaggatttattttctatacaattgtgaaagtaatcaaaggaaaatacaatcaagtttctgttgctttgtggatcgttgatattttattcattatcaacttcatcattctagcaacaatttaactaaagagaagggattggaacagtatttgttctgatctctttttgttttacataaaaagaacgttacatataaaatgacctttgcgggatttttctctttttactggcgagatcgttgcttgtttattcgaaaataggtatgataaaagagacgaaagagggatgatagatggagattcattggagaaaaaatttagtgattgcgtggattggctgttttttcactggtgcaagtattagtttagttatgccattcataccagtttatgttgagcaactaggaacaccaaaagatcaaatcgaattgttttcgggactagcaatctctgtgactgcttttgcatctgccgtggttgcaccaatctggggaaatctagctgatcgaaaaggccgaaaactcatgatgatccgtgcagcagcagggatgacattaacaatgggatctttggcttttgtaccaaacgcgtattggcttttgatcatgcggttttggaatgggattttgtctggatatattccaaatgccacagcgatgattgcttcacaggcacctagagaaaagagcggatgggcgttaggaacattgtctaccggagcgattgctggaaatctgatcggaccttcaatgggcggtgcactggctcagtggtttggtatggaaaatgtattcttgatcacaggggctttgttgatgatcacaacggtattgaccattttcttagtcaaagaagatttccatccaatcgagaaaaaagatctgataagcaccaaagaaattttttcaaaaatggatcatctctctattttgatcggtctcttcattacgaccttgattttacagataggaatcactacgatcagccctattttgaccttatatattcgtgaattgagcggaagtacagaaaatatcctttttgtcagcggcttgattgtttcgatagctggtgtttccgctgtcttttcttcaccgaaactaggaaaactaggggataagattgggaatcaaaaagttctaattggaggactcattttatcattttgctgttatttacctatggcattcgtcactacaccgctccaattaggtatacttcgctttattttaggcttttcaactggcgctttgatgccttctgtcaatacactgatcagtaagattacgcctcaagaaggagtcagccgaatctatagctacaatcagatgtttagcaactttggacaagttttaggtcccatgctaggatcgacagtcgcgcatgcttataattacagtgctgtttttattgtgacaagtttgtttgttctgtcaaatattcttctttctttattcaactttcgtaaagttcttcgcagcagattataatggtggtgaggagtagaaaataaaaaagagcttgagaaatctcaagctcttggctgtttttttacgaatgggcagaggtttcttttcttggcgcaactgcaccaatcaaaaggataatgacacccgcaatgaatgaaatgattgttgtcaaagtaaaatcatatgttccgcttgttaatgcagcaccaatataaccgactacttgacctagaacgacagcccagaataatgtaacgatatatcgcataaagaacacctcttttctatcttaattttaccagattttctttgaatgtaaagaaacgagaccaaatctcaataaaatttgagttcttgcgaaagaactcattcctacagattacaagcaagcaaatgaagtggaataatcaacttcagcgcctgctatcttaatgaaagtaaaaggatcaaaccttttaacgctagtgaattttaacgaaaaaaaaggcggaatgcaagatgtttttcccacaactttatacaattacttcttattctcttttacaaagtacgatacgtattcgagaatatgtacaagaagcaaaaaaacaaggctacacttcattagccataacggataaagatgtcttatacggtgcacctgaattctatcgtatttgtgtagaagaaggagtacagccaatcattggattacatcttagttatacttatgaagaaaaaaattatggcttgcttgcgtacgcaaaagatgaaataggttatcagcagctgatgaaactttccagccgaaaaatgatccaagaaaaattggaacttgcagaaatgacagaaaccgaccatctagcgtttgttgttccggcaaatcattctgtttctgaggctttcaataaagaggataactttttcggtcattggcagtttttacttgaaaatgtttttactagaaatttttatatcggcttgacagaaaacacgcctgatcaattgcctgaatggtatcagtatgtgataaaagaaaattattcgctttgtgcattacatcccatcgctagtttacaacaagaagaactttttgcacttgaagtgatgaaacatatcaaagagggaagccaaatacctttagaaaatttatctgcatctttaccactaacagcaaatgtctatcttctttcagaacaagaaatgatcaaacgattcgaaaaagcgggtctttcccaagctgtaataggcgcccagcgtttagctgaatcgatttcatttgaattccagttccatcagaaattacttccgcattatccagttcctaatggaaaacaagctggagaatatttaagagagttatgctattcgcaagtggaacgccgaatcactgactatacaaaggaataccaagaacgtttggactacgagttatctgtcatccatcaaatgggattcgatgattatttcttgatcgtatgggatgtaatggcttttgctcatagaaacaaaatcgttaccggtgcaggtcgtggttctgctgcgggttcattagtagcctatgtgttagaaatcacagatgtggatccattagaatatgatttgctgttcgaacgctttttaaaccccgaacgctttacgatgccagatatcgatttggatattcctgacaatcgacgtgaagaagtattgaattatgttcgagaaaagtatggacaatatcatatggcacaaatcgcaacatttggcacaatggcagcaaaaatggttcttagagatgcagctagagtgtttggtttatcgcaaagtgaagcaaaccgctggtcaaaagcaatacccaatcaattgaaaatcacattgacccaagcttataaaacttcgcatcaattagtagaattagttcaggcaagcgaaaaaaaccaacttttattcaaaactgcagtgattttagaaggattgccaagacatgtttcgactcacgcagcaggtgtagttatcagcgataagaatctacttgaactagttccgctccaacgcggttctgatgaagcttttctgacccagtatacgatgaatgaggtagaagcaatcggtcttttgaaaatggactttttaggactacgcaacttatcgattattgattttactttgaaagctgttaagcgagtagaagggtatgagatccgattaaaagagatcccgctaaatgatgcaaaaacgctgctcttgtttcaacgaggcgaaacctcaggagtatttcaatttgaatctgctggtatccggaacgttttacgaagattagatccagaaaacatcgaagatattgccgcagtcaatgcattgtatcgaccaggccctatgcaaaatatagataccttcattgccaggaagaaaggaaaagaagccattcgctacccagatgattcactgatcccgattttgaaaaacacatatggagtgatcgtctatcaggaacaaatcatgcagatcgcctcgactatggctggatttacattagggcagtcagatattctgcgacgggcagtgagtaaaaagaaaaaagacgtattagatgaagaaaagtcgcattttgtatcaggagcattacaacagggatattcggaaaaaacagcagcgaccgtatatgaatatatcgaaaaatttgcaaactatggattcaatcggtcacatgcatttgcttattcattcgtgggattccaaatggcgtatctaaaagcccatcatccaggtgctttctttaccagcctgatgaattctgttcggcataacacatcaaaattgaaagaatatattgcagaagcacgtaaaaataaactcaaactttcctcgccgtccattaatcaaagtaattccagttttgagttggtcaataaggaagaaatcagattcggactgacagcgataaaaggtattcggcgtgattttgtagaagatatattaaacgaaagaaaacaaaatggcccgttccagtcagtggatcaattcctcatacggatcgataagcgttggctgaaattagagttactgcaatcactgacagcagtaggagtttttgatgaattatctcctaacaggaaacaattgatgcttgatctcgaaggaaaaatccaaaatatcgtttacagtggtggaagtcttgacttgctgggaatcatggcattaaaagaagaagaagtcgctgactatacactagaagaacgcttgaagctggaagaggagtacttaggtatttatttgtcaggtcatcctgcagaagggtttgatcgtcttcgtttagctaaacaagttcagctgattacagatatcgtccctaatcaaccagtcaatttattagtgatgatcaaggaagttagagaaattcggacaaaaaaaggagaactgatggcctttgttgaaggaaccgacagtagtggagaaatttctgtcacagtttttccaactctttatcgtaaatatcgtaatttgtttgccgttgatcgagtgatctttgttcaagggcggagcgaaatcagcaaatataatcaggaactgcaactaattggagaaagctttgctgatcctaaccagttagaagcccagtatccttcacaaacttgctatttgcgtattacagaagaacgggaagatcccgagataatgaaacaattacaagtgatttttcagaaacacccaggatatataccagtagttatgtatcacgaaaaaacgcaacgaaaagtagttctgtcagatgcttattgggtggatgacagcaagagtataaagcggcaacttatttatctgcttggcgaagataatgtggttttcaaataacttacggtaaaaaatactacttgctttcattttttttcatttttttatccgtaaatcaagacaagtgagaaaaataatgttagaatgttagtcgtggttaacgcaaaaatggttgtaaacctaagtcatacttaggataaagtattttaatgaggtgaatgtttattatgaaacgcatcggaattttgaccagtggcggagacgcacctggaatgaatgcagctgttcgtgccgttgttcgtaaaggtatttacgaaggactggaagtatacgggatcaattatggttttgccggtttagttgctggagatattcgtcgtcttgatgtggcagatgtaggtgacaagatccaacgtggtggtacattcttgtattctgcacgttatccagaatttgcaactgaagaaggtcaattaaaaggaatcgaacaattgaaaaaattcggaatcgaaggtctagtggttatcggaggagacggctcttatcatggcgcaatggctttgacaaaacgcggtttcccagcagtaggtattcctggaacaatcgataatgatattcctgggactgatttcacaatcggttttgatacagcaatcaatacagtactagaatcaattgaccgtattcgtgacacagcgacttctcatgttcgtacattcgttatcgaagtaatgggacgcaatgcaggagacatcgctttatggtcaggtgtggctggcggagcggatgaaatcatcatcccagaacatgattttgatatggcttcagttgctaaaaaaatccaagaaggccgcgatcgcgggaagaaacattgcttgatcatcttggctgaaggtgtaatgggcggaaatgaattcgctgagaaactttcagaatttggtgactatcatacacgtgtatctatcttgggacacgttgtccgtggtggagcaccaagcgcacgcgaccgcgtgttggcaagtaaattcggtgcttacgctgtcgaattgcttcaagaaggaaaaggtggattatgtgtcggtatccatgacaacgaaatcgttgcgtctgacatcattgatacacttgaaaacaacaaacataaaccagacttatcactatatgatctaaataattcactttcattttaagagtgaaagaaaccaagctatttaagctgtgtacagctttaaataaacaaaattgaatgggagagttttttaaatgaaaaaaaccaaaatcgttagtacattaggaccagcaagtaactcagtagaaattatttctcaattgattgaatctggggcaaatgtcttccgctttaatttttctcatggtgaccatgaagaacaattatcacgtatgactatggtccgtgaagcagttaaaaagacaggaaaagatgtcggtattcttttagatacaaaaggagctgaaatccgtacaactgttcaaggcacaacagaagctgattttggtcgtgcaggatacatcaaatttgaagtaggagatcaaacacgcatctctatggatcctgaacatgtaggttcaaaagaaaaaatcgcggttacttacccaggattatttgacgatgttcacgttggcggacacattttatttgatgatggtttgatcgatatgcaaatcattgaaaaagacgaagcaaaccgtgaattagtcgtagaagttaaaaatgcaggtatgctaggatcacgtaaaggggtaaatgcaccaggcgtttctattagtttgccaggtattactccaaaagatgctgacgatattcgttttggtttagacaacgatatcgactttatcgctgcaagttttgtacgtaaagcacaagacgttctagatatccgcgaaatcttagaagaaaaagacatgactcatgttcaaatcttccctaaaatcgaatctcaagaaggtatcgacaacattgacgaaatcatcaaagtttctgacggtgttatgattgcccgcggagatatgggtgttgaaatcccagctgaactagtaccaatggttcaaaaacgcattatcaaaaaatgtaatgctgctggtatcccagttatcactgctacacaaatgttagaatcaatgcaagaaaacccacgtccaacacgtgcggaagcttctgacgttgctaacgctgtatttgatggcacagatgcaacaatgctatctggtgaatctgcaaacggggactacccagttgaagctgtttcaacaatggcacgtatcgaccaagaagctgaaaatgcattatcagaattaggtacattccaattgaacgaattcgataaaacagatgtaactgaaacaatcggtttatctgtagctcgtgctgcaaaaaatctaggcgtgaaaacaatcgttgctgcaactgaatcaggatacactgcaaaaatgatttcaaaatatcgtccagatgcagatatcttggctgttacttttgacgaacgcacaaaacgtggtttgatgttaaactggggcgtttacccaacagttgctgaaaaaccatcaacaactgatgaaatgtttgaactagcagctaaaaaagctgttgaattaggtttcgcatcagaaggcgatttaatcttgatcactgctggtgtaccagttggtgaacgcggaacaactaacgtgatgaaaattcaaatgattggttctaaattattagaagctcaaggcgttggacaaaaatctgtcgttgcaaatgcagttattgcttcatctgctgaagaagctgtaaaaaaagcaaaagacggaatggttctagttgtaccatcaactgacaaagaatatatgcctgcaatcgaaaaagcagctgctgttatcgttgaagaaggcggattgacttctcacgctgcagttgtaggaattgcacaagatattcctgtaatcgttggtgctaaaggcgcaacaacaacaattacagaaggtgaattgattaccgttgattcacgtcgcggcatcgtttaccgtggcgaaacaacagctatctaatttagcttaataaaaaataaaaacagctcttcttttacgaagagctgtttttttgtgctgtaacgaattcatggataacttggactacttgttcttgaagaggcgtgacgatctgctgtgttcgttttgccaatgaaatcaagaagcgaggctgaacttcatctgaaagagggaggcaaactaaatgatcttcaggatggacagcaatctctgccaaaaaaccgatacccacattttctcggaccatactctttaaaatcgtcaagtcattgctttgataaacaacttttggatgagtatgtgtttgtttagaaagcttagtgaatgctgcggggtggacataatgttcgttcaatagtacaaactgttcatctgctatatctttgaaagagacagtatcctgcttggaaagaggatgtgtaggtggcacgacgatcatgaaacgtttgtccaaaagtaactctgtttctaaatattgatccacgattggctgtgttgagcctaatacagctaaatcgatcctcccttgtcggatcatcccgtataagtcccgagagcctccatcggtaatctcaatttgattcatcaattcatgcttgataaagtaacttgacagtttaggaaagtattcattgccgataataggaggcatgccaaaacgaagctttttcttttgcaactgagtgatttcagctcttgcagtagaaatctcttggagaatggtttgtgcatggagaaacagctgctttccagaaggcgtgacgatcaattcgtgaatgcgatcgatctcttgtaataagtacggtgtcaaactctttttcaagacgttgtaatgcatatgtaatagtaggttggctcacacggaaataattagccactttcgtaaaattttttgtttgacgatttggacatagtattcgatatctttcgtgttcatgaagatcatccgctcctttaatggaataatgattattgtaaatgattctgaggatgatagcaaacagaggctttctaataaagatttttctgtttttttatgaactgcaaggtgtcaagaaaatttcattgacaacatgctttttgccctgtataattgcttttgttgcttaggagtgatgaaaaatgaaatggtctttattggaattgagaaaataccaggagacaccgttaacttttcatgagacgctcgacttgaaagccgctctcatgaagcgagacaatttaatacttgatgttgcgccagtggaagtcgaaggtttggtctcagttgataagaaaggctatatcgttcattacactgtgcagacgactttgacagttccttcaacacgttcactagaacctgttgaactgcccatggatttttctgtagacgaagtattcatgacagaagaacaattccaaagtagagatgaacaaatgtctgcagatgagattttgctaattgaaggtccattattgaatttagcagagtcgattgaagacaacatcttattggcgattccaatgcgggtattgacaaaagaagaggaagcagcaacagaacttccaaaaggcaatgattgggaagttgtttccgaagaagaataccagcgcagaaaaatggaagaagccgagaataaaattgatcctcgtcttgcaaaactatctgaactttttgattctaaatcaaaagacgacgataacaagtaagattggaatatattgtgtctaatttagatacaagactttacaaggaggtgtagcaaaatggcagtaccagctagaagaacatcaaaagctaaaaaagcaaaacgtcgtacacactacaaattgacaatcaaagggttaaacgaatgtccaaactgtggtgaaatgaaaaaaagccatcacgtatgtgcaaattgtggttactatgatggtaaggacgtaatgtcaaaagaagcttaatacattttaattagaaaatgtaaaacctcaaggctaaccatggagccttgaggtttattttttgtagtcggtaaataaaaaatatgttgttctttagtttgcaatgtagccgtgttaagctataatgtaagagattagggagaaatcccgtatgtaggaggagttcatatgtcaaaacaacaaatcggcgttgtcggtatggccgttatgggtaaaaatctagccttgaacatagaaagccgcggctattcagtggctttattcaatcgtacaggggctaaaacaaccgctgtagtagaagaacacccagataaaaatttcaaagcaacatatacaatcgaagaatttgtagaatctatcgagaaaccacgtcggatcttgctaatggtcaaagcaggaccggcaacagatgcaacaatccaagagttacttcctcaccttgataaaggcgatattttgattgacggaggaaatacattctttaaagatacgatgcgtcgtaatgaagagttagccaactctggcatcaactttatcggtacaggcgtttccggtggtgaagaaggagctttaaaaggaccttcaatcatgcctggtggacaaaaagaagcctatgcgctagttgcaccaatcttagagcaaatttctgcaaaagcagaagacggagcaccatgtgtcacatatattggcccaaatggagccggacattatgtgaaaatggtacacaacggtattgagtatggagatatgcaactgattgctgaatcttatgacttaatgaagaatattttaaacctttcagtagaagaaatggctgatatctttaaagaatggaatcaaggcgaattagacagctatttgatagaaatcactgctgacattctgacacgtaaagacgatgaaggaacaggtaaaccagtagtagatgtgatccttgatgcagctgggaataaaggaacaggtaaatggacaagccaaagcgcgcttgacttaggtgtgccacttccattgatcactgaatctgtatttgcccgctatatttctgcttataaagaagaacgcgtacaagcaagcaagattttgtctcgtacgaacgattttgagttcacgggagacaaaaaagaattggtcgaaaaaatccgagaagcgttgtatttcagtaaaatcatgagttatgcccaaggatttgctcaattacgtgtcgcttcaaaagaatttgattgggacttgccatttggtgaaatcgcaaaaatctggcgcgctggatgtatcatccgagctcgattcttgcaaaaaattacggatgcctatgacaaaaatcctgagatcgaaaatttattgctagatgattacttcgttgaaatcacgaaaaaatatcagcaatcagtcagagacgtcgttgccttggctgtccaagctggcgtacctgtaccgactttctcatcagccatcgcttacttcgattcatacagagcagaacgtctgcctgcaaatataatccaagcccaacgcgattactttggcgcacatacctatgagcgtgtcgacaaagaaggaatcttccattactcatggtaccatgaagaataatagtctttcggctgttaggaaatgagaaaataaaaagaggacgaaagagctgaagtcgattgttatgagtagacttcagctcttttttaaaattgctatccatgataaaatgactatagatttttaagcatattatcggtataatgatagagtttttaaaaagccagtagaatagaaaggataaaataataaatgagcaatattctaatcattgaagatgaaaagaacttggcacgatttgtcgagctagagttgaagcatgaagggtataacgcagaagtccactacaacggccgaactggtttagatgcggcattaaataatgagtgggatgccatattgttggatctgatgctcccagaattgaacggtttagaagtctgcagacgtgtacgccaagtcaaaaatacaccaatcattatgatgactgcaagagattctgtgatcgatcgtgtatctggacttgaccacggagcagatgactacatcgtcaaaccatttgctatcgaagaattattagcacgtcttcgtgcattgttgcgtcgaatcgatattgaaggcgataaaaatgtggctaaacaaactactattacttatcgcgatttgactatcgaaaaagaaaaccgtgtcgtacgtcgcggaaatgaagtaattgaactaacaaaaagagaatacgagttgctgcttactttaatggaaaacgtgaacgtggtattagcacgtgacgttttactaaataaagtgtggggatacgaaacagaagttgaaacaaacgtagtggacgtatatattcgttatcttcgcaacaaaattgacgttcccggggaggaaagctatatccaaactgtacgcggaacaggttatgtgatgcgctcgtgataaagccgaaaaaatcggaaaaaagagaactgaaagggccctccttgacaatcaagtgggcctttgcgagttctttcttcatattcgttgtgtttacaattttcgctgtcattacctataaatcatctatcaatctgattgtggcaaaagaaagaaacaatgtagagcgtacgatttcagaagtagcttctcgtttggctaactcggatgaagaactgacattagtaaatacgtatcgtaatctgacgaaagcgacaaatgacggagatgaggtcgtagatcatacttcactggtcgaaggaaacttaatgaagatcgattcctttatagctgagctagggcagccatcaatggatctttatgtttatgatttggacgagaacttgatttttaaaacccatgaaaacagtcgaaacctgattcagactacacgtaaagttccaacgatcgttacactagaaggaaaaactggctttttatctatccagcctatatattctaaaggtacaagagaaaagatcggctatgcgcaaagcttctatgaattatcttctttctatgatattcgaaataagctattattgactcttattgttttagaagttgtttctttgatcttaagtagtattttaggtttctttttatcttcttatttcttaaaaccactcaaggtactcagagatacaatggatactatacgtaaagatccgcaatcagatatccacatgcctgaaatcgacacaaatgatgaattggcagatttagctgaaatattcaatgagatgcttgaccgtatgcgtttgtatattgaacaacaagagcaattcgtggaagacgtatctcatgagttaaggacacctgttgcaattattgaagggcatcttagtctgctaaatcgttgggggaaagatgatcctgagatattagaagaatcattaagcgccagcatgcaagaaatcagccgtatgaaaagcttagttcaagagatgctagacttatcaagagcagaacaagtagatgttcattatgcgaatgaaacaactaaaggaaaagaagtcacctatcaagtttataataatttcaagatattatatccagactatgtgatcactttagatgatgatttgacaaaagaagtgaccctgcaaatttatcgtaatcactttgaacaattaatcattatcatattggataacgcagtaaagtattcaactacacgaaaagaagtccatatctctatttcttccactctgaatgaatttgagatcgcgattcaggactttggcgaaggaatacccaaagaagaccttaataagatcttcaatcgtttttatcgagtggataaagcaagagctagaacgaagggtggaaatggtctggggttgtctatcgctaaacaactggttgaaaactataaaggacgtatcttagcagaaagtgtagtagggcaagggacaatttttagaatctttattcctatcgcaaaggcagaagacaagtaaagcatgtgctttacttgtttttttatatatccaacaaagaataaggtacaaaatacaagcaagtgagaaattcagggatgtcattataaaaaaactagcgaacaattaaatagaataacatccgttaattaaatgtaagtatcttttagatgaacgaaaaaacaataaaatgctgtaatattcgtgtttaaaaataataaataaaaatagggaattttctattgcaattttataaagagattgctatattattatttgttctaaatgattcctttaaggtgtcactaaaaattataaaaaatagtgttgacgcacttttgatgtcatgttataataacgaagtcgtttggatgagatagctaataaagcttgattttatcgaaaaaaacttcgaaaaagttattgacaaataacaataaagatggtatgataatcaagtcgctgctaatgagtggcaaagacgtttagaaaaaataaacaaagaagttgttgacattctcttctgaatctgataagattaaagagttgttaaaacaaaaagattagacctttgaaaactgaacaaagtaagacaaaccaaatgtgtagggcgtcttgattcaattcaagacaacaaacatttttaacaagcaagcaatatgctagcaaacaaattgagcttaacaatcgcaagattgttcgaactttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaatattacggagactacacaatttgtttttactttgttcagttttgagaggtttactctcaatttaaaacggggccttagctcagctgggagagcgcctgctttgcacgcaggaggtcagcggttcgatcccgctaggctccattaacaacattagttgttaaatttgttcattgaaaactggatatttgaagtaaatgtaagtaatacaaaccgagaacaccgcgttgaatttgaaagctgaacaaattgtttagcctgaagcaaaataggcggacggccataaaatctttgattttatgagacgatcgatctttttgccgcacaggctgatttgtgagctggatagagttttttaataagttcaattgcttattttcttgatctaacttctatcgctagaagaaggatcaaaacccaaccgcaaggttgataaggttaagtgaataagggcgcacggtggatgccttggcactaggagccgatgaaggacgggactaacaccgatatgctttggggagctgtacgtaagctatgatccagagatttccgaatgggggaacccagcatctttaataggatgttacgattgtgtgaatacatagcacattcgaggtagacgcagagaactgaaacatctaagtacctgcaggaagagaaagaaaattcgattccctgagtagcggcgagcgaaacgggaaaagcccaaaccagcaagcttgcttgttggggttgtaggactccaatatggtagttctttcagatagtcgaatgacttggaaaagtcagtcaaagagggtaaaaaccccgtagacgaaatgtggaagacacctaggaggatcctgagtacggcggaacacgagaaattccgtcggaatccgggaggaccatctcccaaggctaaatactccctagtgaccgatagtgaaccagtaccgtgagggaaaggtgaaaagcaccccggaaggggagtgaaatagaacctgaaaccgtgtgcctacaacaagtcaaagcccgttaatgggtgatggcgtgccttttgtagaatgaaccggcgagttacgattgcatgcgaggttaagttgaagagacggagccgcagcgaaagcgagtctgaatagggcgtttgagtatgtagtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtcccaaaatatatgttaagtggaaaaggatgtggggttgcacagacaactaggatgttggcttagaagcagccatcatttaaagagtgcgtaatagctcactagtcgagtgaccctgcgccgaaaatgtaccggggctaaacatattaccgaagctgtggagtacacctttaggtgtattggtaggagagcgttctaagggcgtcgaaggcagatcgtgaggactgctggagcgcttagaagtgagaatgccggtatgagtagcgaaagacaggtgagaatcctgtccaccgaatgactaaggtttcctggggaaggctcgtccgcccagggttagtcgggacctaagccgaggccgacaggcgtaggcgatggataacaggttgatattcctgtacccgttgtttttgtttgagcaatggagggacgcaggaggctaaggaatgcagacgatcggaaatgtctgtccaagcagtaagtctgaagaggagttaaatgcttcttttcttaaggacaagctgtgatggggagggaaataatagtaccgaagttcctgatgtcacactgccgagaaaagcttctagtgagaaaacagcggcccgtaccgcaaaccgacacaggtagtcgaggagagaatcctaaggtgagcgagagaactctcgttaaggaactcggcaaaatgaccccgtaacttcgggagaaggggtgctgatcatacgatcagccgcagtgaataggcccaagcgactgtttatcaaaaacacaggtctctgcaaaatcgtaagatgaagtataggggctgacgcctgcccggtgctggaaggttaagaggagtgcttagcgcaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagaaatcggaacgctagtttcgatggaggcgctggtgggatactacccctgcgttatggccactctaacccgcaccactaatcgtggtgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagaccaacaagtcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgttctgccaagggcattgctgggtagctatgtagggaagggataaacgctgaaagcatctaagtgtgaagcccacctcaagatgagatttcccatttctttaagaaagtaagatccctgagagatgatcaggtagataggtcaggagtggaagtacagtgatgtatggagcggactgatactaatcgatcgaggacttaaccaataggttaaaagaaaagtactcggaaaaaaacttatgtgacttcaaatccagttttgagtgaacaaaatttactcaataaaagataacaccacagtgtggtggcgatagcgagaaggatacacctgtaaccatgccgaacacagaagttaagcttcttagcgccgattgtagtgaggggttgccccttgtgagagtaggacgtcgccacgctgatgttattccggcatagctcagttggtagtagcgcatgactgttaatcatgatgtcgtaggttcgagtcctactgccggagttctcattttgagaaagagtattgagcttctttcactctggagagttgtccgagaggccgaaggagcatgattggaaatcatgtagatggtgccaaactgtctcaagggttcgaatcccttactctccgtagcaaatttacctggcccgttggtcaagcggttaagacaccgccctttcacggcggtaacacgggttcgaatcccgtacgggtcattttaattgaatgttggaggtttagctcagctgggagagcatctgccttacaagcagagggtcagcggttcgatcccgttaacctccataatgaactggttccgtggtgtaggggttaacatgcctgcctgtcacgcaggagatcgcgggttcgattcccgtcggaaccgtcgttcttgttattcaattaataattttaaaatatggcgcggtagctcagttggtagagcaacggattgaagctccgtgtgtcggcagttcgattctgtcccgcgccaccatggaggagtagcgaagtggctaaacgcgacggactgtaaatccgttccttagggttcagtggttcgaatccactctcctccattttataggggcatagtttaaaggtagaacagcggtctccaaaaccgttagtgtgggttcaattcctgctgcccctgccatggcgaatgtggcgaagtggttaacgcaccggattgtggctccggcattcgtgggttcgattcccatcattcgccctttttattcttggggtatagccaagcggtaaggcaagggactttgactccctcatgcgttggttcgaatccagctaccccagtttctataatttattctttattttatagattgataatagtataatggcggtatagccaagtggtaaggcagaggtctgcaaaaccttcatcaccggttcaaatccggttaccgccttagtactaataaatcaacttgccggcgtggcggaattggcagacgcgctggactcaaaatccagtgcccgttgagggcgtgccggttcgaccccggccgccggtattgactaagatgtcttcatcttagttttttattgagaaattaaataacatcttttatgatggcgaatgtggcgaagtggttaacgcaccggattgtggctccggcattcgtgggttcgattcccatcattcgccctttattcttggggtatagccaagcggtaaggcaagggactttgactccctcatgcgttggttcgaatccagctaccccagttattatttttaaatttgccggcgtggcggaattggcagacgcgctggactcaaaatccagtgtccgttgaggacgtgccggttcgaccccggccgccggtataattatcaatatagcaactttcttatagagagttgctatatttttttgtttttatgtaattacctccaaatcaattcgatacaagtattatcataaaacgagtaaaaaagatattgataacgcttttattatgtgttaaactatttttgtaaattatgtagggtgctactattcaattaggcacgacctaagaaagggttctttcttaggtcgttttttgtctttaaaaattgtttggagacaaaaatatgtatgaaggagtctgcaagttgttttgttttatcatatagaggaggtgaattaacggtgtatgtgatgaaaaagctgaatcataatgctgtattgatcgatgacgatggaatagaaaaaattgcgatggggaaagggattggcttttctgctaaagtgagtaagccatttgatgttgaggatgctgacaaattatttgtattagattctaaagaaaagatcaaacgattcagtgagatagtctcgcagattccaatcgaatttatggattttgcggaagaagtgattgaactgataacagctaggatctcctctccattagattcaaatatctatattacattgacagatcatatttattttgctattcaacgaaaaagagaagatagagatgtcacagcaattatgttgccagaaatgagattcctttatccaaatgaatatgatatagcagtagaagtggtcgagcgaatcaatcatcgatatcaaaccgagttagggtcaaatgaagtaggattcatcactatgcatatcattaatgctgagctaggagagcctaatagtttaaagagcttaaaaatagtagaaatgacgaccacgattttgtcccatctagaaaaatcctattcaaacgtttatgataaagaatcactgacttatcatcgcttaatggttcatatcaaattcctggttaaacgcttgatttatcaggaagaaacgccagtagaaaatattggtttttttactgaaacatttaaacatagcaaagcgtattgtacagcactaaagattaaagatatcatcgaacagcaatttcaacttgccattcaagaaaatgaaatcatctatttggcaattcatctagcaagaatctattaaaataagggcgtaactatctataggcgcaaccaaatgacacatagtaaatggactatgattatttggttgcgcctattttagtagaaaaaagaaggagaatgaaatgggaaaagtgatttttaattcggatgattttggctatagccatggtgtgaattatgggattatggatgcttatcagcgaggaattttgacatcaactacattgatggcaaatatgccgggtttcgagcatgctgtgaaactaagaaaggaaatgcctaggctaggtgtaggagtccatttaacattgacgtgtggcaaaccactcctcaaaactgtcgatactcttatcgaaagcggagagttcagatccttatcttattatcagcatccatttaacattgacaaagatcaactgtatcaggaatggaatgctcagattcaaaaaatttatcatgcggggatcataccaactcatttagacagtcatcatcatactcatactttggatgaaaatcaggaggtagttgttacattagcaaaaaaatatgatttgccggttcggagcaactttgaacgaaaagatgaagttcgtcatgtcgattattttgagccttgtttcgatgtcgtaggagaaactgatgaaaaaaaacgacaaatcaatacgagtgtggaagaatatttggcaagtttactcatgatattgagagaagataaaacgatcgaagtcatgtgtcacgcagcgtatttggatcaggaattgttaaatggttcaagttttgtgtatcctcgtacccaccaagtcgaatttttaattcattcagcatttgctcaaaaagtgaaaaatgatcctttgattgagttagtaacatatgaggatatttaatagaggaggaataaaaatgaatgttaaatcaaatgtgcagaagcttggaagagcgatgctacttccagttgcagcgatgccattagcgggattgatcatgcgtttatcagctgacgatatgctgaacatcccagtaattggtgcagctggaaatgccgtttttggaaacttggatatcttatttgctataggagttgcaatcggttttgtcaaaaataaggacaaaggaatacctgcacttactggttttttagcgattgctaccttgaaaaaaggcttagaaattatggacccagaagtgaatatggggatttttggtggaattatttccggtttagtagcggcatggacgtataatcgctttaaagaacaaaaattaccagtagttttttcttattttgcgggcgaaaaattcccattgactatggtgatgattctacaaacaatcgcagctgtttttttgggctttatctggccgctcatccaaattgggattgataattttgcaaaactgctcgttgatatgggagcattaggtgtggggatatttatgtttttgaatcgtttgctgatcccctttggactgcaccatgtgttgaatacgtatatttattacgatttaggaagctatacatctcctagcaaggaagttttcagaggagagatgacacgctttatcaacggagatcctcaggctggactgtttttatcaggtttttttgtagtaatgatgtttggtataccagctatatgtctagctatctataaagcagcttataaagaaaataaagagatggtcaaaggaatcatgggaagcggtgcaggaacttcatttattgcaaatatcactgagcctgttgaatttagtttcatgtttctttctcctatgttgtacgtgatccatgcactttttgccggtttagcagggattgtctgttacttattcaatatacgaattggttttacattcggagcatgtattgttgattatctcatcaattttcgaatcgctaccaatgctattttgattcttccaatcggaattttcttttttgccttgtattacgttactttttattatttgatcaataagagaaacattcagacattaggacgtgaagctaaggcagagtttggcaatgaagtaaccttagaagaaacagagttagggttagcaagtaaaaattatgaatatatggcaacaaaaatgctacaagcgtttggaggaaaagccaatatcctggatgtctatagttgtaatacacgcctacgggtagaggtagtggatcccaccatggtcgaggaacagcgaatcaagcaattagggataagcgggatcattaaaccaactgaaaaaaattatcaaattatcatcggcttagaagtgacttatgttatggcagaattcaataaattattagaagaatagaaaggaaaagatgatgatgaaaaaacagattatcactatagctggaggcgggagtacgtatacaccaggaatcgttcaagccattttgaacaatgaaaaacggttgccattatctgaaatacgtttatatgatattgatgaagaaagaaatatggatatgtacttgattgttaaatttatgctgaaaagaaaaggtttttcaaatattcgcattcgtgcaacggatgatccaaagcttgcttttacaggatgcgattttgttttctcacaaattcgtgttggaggattggagatgcgagaaaaggacgaaaagattccacttaaacatggattagtaggacaagaaacgtgtggactcggaggatttgcttatgggatgcgctcaatcaaaggtttattggaaattgtcgatcatatacaagactatgcccccaaagcatggattttgaattatacaaatccagagtcgatcgtttctgaagctgttcgtcgtaaatatccgaatgtaaaaatgattaatgcctgtgatatgactatttcaattgaagaaacgattgcagtgaattacggttatgatcgtaagaattggatcgttacgtattatggtttaaaccactttggctggtatacatcgatttatgataaagaattgcaacgagaaattatgccagagattattgaaaaactaataacaaaagaaatgcaagtcgccgattttaatataggagataaaacttggcaaaaaacctttcaaatgatgtcagtcatcacgaaaaattttccaagtaatatcccgaataattacttagagtattacttatatcctgatatggtcgttgagcatactgacaaagagtatacacgtgctaatatggtcatggatggacgagagaaaaataccaaagaaatggctgataaaatacgccgcggtattgtggaagaagtattgaactttaattttggggagcatggacaatatatcgtcgatatagctatttccttgttgaatgatgatcgtcgtcgctttatgctaatcgttcctaatcaaggggcgattccgaatctacggtcagatgcagttgttgaaataccggcatatgttggtgcaactggtgtggagccaattacactaagaaaaccaatcagtgattttcataaaggattgatggaggcacaagttgcagtagagaagttactagtagatgcttactttgaaggttcttatcaaaaagctttacaagcatttacattgaatcaaaccgtaccaaatgccagagtcgcaaaaaaaatactagatgaaatgatcaaagtaaacaaaaaatattggccagcattaaagtagaggtgataaaaagtgcatttctttaaaacaagaaacattctaaaagctgtagctagtggtcaaattattccattaacagcagtaaaagacgaggtcttttcttcaaaaatgataggagttggatacgctataacgaatcatgatggatatatccatgcgccagttaaaggaataatcgataatatatttcctacccgacatgccataacgatcgaaagtgaatctggcagaaaaatactgatccatatgggtttagatacagttgaactcgaaggaagtccgtttcagatacgggttgaaagtaaccaggaggtaaaagaagggacactgttagctattatagatttgaagaagttggagcaagcacaaaaagatacggtgatcattgtagtttctccaggcatttttgaaggaaatttattaaaacaaaaccaagaagtaaagattaaagatagttgttttgaattttagtgtacgatgaaaaaagttaaatagggtgatatttatgggtgaatttacaaaatttttttgaaatgatatgtttcaatcactagatttaatcattttgatttttgttaattatcgaatttttttgttgctcctatgatttagaaaacttattttcaggattcttaaaaataaatttgattatttaagagaatatattgaaataaaatttcttaattatataattagttatgaacattctttgcgttgtcatgcaatgaatggttcatattttattgaaaaggagtggttttagtggaaaagctgatgaaatgggtcgaagagaaacttgtcccaccaatggcaaaaattggtacacagcgtcatttattagcaattcgtaatggggttgtttcaacattgtcattgattttgattgggacattttttatggtctttatcaatttaccgtttcctggatggaatgaatttattgccccttattcggcaacgattgttttaccctttaggatgacgatgggattgatggctatttatgcaacttttgttatgggttcggatctagctaaatcatatggattagatagtgtgacaggtggtatattatctttaggaacgttctttatgttacaagttcctgtaaacgttttaactcctgaagaggcacctcttggctgggtcttacctatgagttctttgggagcatctgggatgtttgcggggatcttatctatgatttttgcagtggaagtatatcgtttctttaaaaatcgaaatattactatcaaaatgccagaacaagtgccacctgctgttgcccgtagttttgaggcattgattccaggtgcagtcattttaacaattacttggctgattcgaagcgtcgcgggctttgatgtaaacgctgccttattatcgttattcgagcctttaaccaatattttagggaataatttgcttggtgttttactaccaatgtttttgatccatttgttgtggtcatttggtatccatggcatgagtattgtaggggctgttgttcgtccaatgtggctgatcatgttggatgagaatgcaaaggcattggcagatggtacagctgccacccaattaccctatatcgctcctgaacagttttatcaatggacggtaacaattggtggtgcaggagcaacgatcgtggtatctgttttgtttatattcttctgtaaatcaaaattcttgaaagaggttggtcgtttttctattattcctggtatcttcaatatcaatgagcccataatttttggagctcctatgatgttgaatccttacatgttcatcccgttcaacttagttcctttagttttgactattatcagttattttgcagtcaaattagaaatggtcaatagatttactgttttgccaacatggacattaccagctccaatcggcggttatctttcagcaggaaatgactggcgtgttgttatcttgatcatgatcaacacattgatagcatttattatctattatccatttgtaaaagcttatgataaaaagatgctgtcagatgaacaaagtcgtggagaaaacgaagtccagactgtctaagtttggtttttagaaggtgggaaacaatgtattggctgattttattttttgtttttatctttttattaacggctagtcaccttatattgaatatgctagctacatatcatattcaaatcaatcgatggatttgggcactggcatcatttttgatcgtgattcttccaaagatcattgtaccgcatatgaatgttttgttttcatgggggacatatgtactttgtggaatttttgctatcaattttatgatcgagcagcatagatggtttgtcacatcgaagctttaaatgttctaaaagtggttgtaacagaagtggttagcttcaagaaataagaagaaatttacgaaaattgcttcttaaatttttgtgaaatgttggcttatttttcgtttggttgaacttattaccgcagatgcaagcttttgaccaccgtttattcggaatatgggactgtgacaaggcttttgtcacagcccttttttacataaagattattattgttttaactgttttggcagaaagaaggaggaaaaaatggaaattttatcagcaatggatttagaattagtagatctactaccaaagtgatcaagtcaaatatagatttgggagcttacaaccatatagtaggggctgcagtatggtgtatgaatggtaatatgtatgatgtgagtgtttattcaaatcatgaaacgtgtatagaaataattgtgctgggaatagcaatcagtcatggtgaacgtgacttttagtgtatcgttgctgacgacatagaacattctgacatgatctactcaatatgtggggattgctggcagtttatataggagtatgcatcggattgcgagatcattgtctcaacagaagagggaggttgattatcaaagataaagtggtaaatcctacatttgatttagtaattgttgaggggactagcggcacaaatctctacaaagcgatgcttctagatctatatgacacattttaagaaaatgtatttgcctaattattatggtctttcttttgaagaaacgttgagatgatccaaccagagaaaggtgtcaaagaatttgactaagaataaatggcagacgctacctatgctcatttggatagcgtcagatcttttattttaaggatgattttgtgttttttagacaccgtaatttaagtaactctaacttttcaatccactatttactttttttgtattttcactgtctgggtctcgaatagcgaaattactgatgagtctctattaaaaaagctttttctacttgaaactatattgggtggttgctcaggaaggtttcgatttcttgaattgcttgttgtggaccatttattggaaaaacggcttgcagcgtgcgtgcctgctgacgaatcttgggtgaagaaacttcgcgcagagcaatctgcagttttctttcagtcactggttttgtgagggcgattgcgtttccgtattttacacaatagtcaatattacagctttgctcaaattgcatccccacaccgataaacggtttgccggattcacaggcagtttggacggtcccttccccgccgtggataaaagaaaaatcaatgaattcatgcaaaagatgactagacagatattctgttattaaaagatcttctgagtcagattgaatgtcatcaagcagatagtcaataggtgcaataaccgctagatccggttgtttttgtaagaagaacaaaattttgcgtaacatacgcggattgcctgaactacccattgcgaaatagataatacgttttctttcttgttgctttcgctgtataaaagttagcacttcttcaggcaaggaagtactgagcttagcaaaaattggaccaacgattcgataattttccggcagctgttcttcttccaaaaatagtttaggcgttgtgatgagatttagatcagcatccatcatttgtaaacttgtttttggtaaaggaagcatttctttttgtgcagcgtgtttgaaggcattggggatccatcgggtatttactatacgcttttttgtccagtgccaaaggggattgcttaaagggccgaagaaacgtaactcgtggggcatcagcgcatgctctgattgaaaaaaaggttcactcaaagcatagggtttaacatatactaaaggaatctttttattgcgggccgataaaaaaattgtcacattcgaacctgtcacaatcagtcgaggctcaaacttagcaatcagactctgttcactagtgatacgagaggcaaccatttctttggtaaaagggtttttaagtgtacgcaactggtcaaattttatgatttgttcttcttgttttttcgtaaggatcggcgctagtaaatgatactcaaagccactttctgtgatcaaaggagcaaaagttttagaaaagccaaagaatacacagtaataacggtctttcatagctttggcaacctcaatcattcgtgttgtctcagctaaattgaatactgcaggagcaaaaagaattgtcttcatgaaatcctccttattggaatgagtctatcccttcgtttcttactagtatactaaaaaacacagcgttcgagtagcctatgtatattttgaatattaaactgtctctcgctgttttcacaacttctaaatttaaattttgtaatcaagttgaaactccaattttcaaaaaaacacgcaacaattttttgatcgatttatatgttgtgccagataaatacgagaagttgtgtcattaaaaataaacatgagaacataaaaaaataaaataattatattaattgataggtgtgctgtcgtcattatacacacgtaagaaagaaatagttatgtttaaaaatattcttagactttctcgccatgacaattttcactatgtgttataactgtaaacgataattattcagataacacaaaaagaaatcaaggagcagatacgccagttgtttaatttgaatattattttaaaattaaaatttttattctgttctaaacatttttggttgtttagaacttttttttgtgtatgatataaaggagaaataattttttaaagggaaggaaattgttttgattaaagtagatggagcattactaaaagaataccgaaagaaaaaggggttaacacaagtacaattagcagaaggcatttgtgaacaagcaactgtcagcaatatcgaaaacaagaatatgtcgccaggcatcaatatcttaagtgcgctttgcaaaaagctgaatgtcgagatctccgatatattagtagaaacagaagaagacaaaatcaggaaaaaaataaatgagattcaatcattgaattctgtatcaaaataccaagaatcttataaaattttacaaacgatcgatcaggaaaaagtaagtaattctgatcttttaaatcaaattttattttatcaaggactgcttgatcatctttatgcgaaaaaaccagatgcagcattattttattttaatcaagtgttggaacaaacgaccgaaacagatatccatcacttacaagcagctgcaaacgtggcaatgatctacttgtcaaaaggagaattagattttgcgaaagtttatgtggagcgtacacttaaaatattgagtgagactgattttgataatctgatggtctgcattgtatattatgatatcgccacctattaccgtaaaatcgaggattatgataaagcaatccaattatgtgagaagggtattgagtataataagaaacataaatcgacttatgcattggaatacttgctttatgaaattgcttcttgccataagcaattaggagaagatgattatttagaaagatatatggacgcaaaaaaaatagcgcgtttcaacggaaatgattacgcggtaaaggtgattgaaaacgacctgaaataaagtggttgtgaaatcagtgttctgatttgaataccgtttattcgaaaaaaggaggtgtgacttttgtcatacctccttttttcgatattgtttgattcctatttaggcaacatataacggttataaaagaagcaatagattatgatggtatcgattggatggatacatcttgggattcctttatcaatttgagcgtagcgtgtttttcatttatcgataaatttgttattcatttttttgataatcctatttacatatttacgtcctggttcttaaaatgaatctacttgaatggtttttatccccgtatttctgatctcctctaatactttttcagaacaaaatttatcagtgatcaaataatcaaagactgaaatatcagcaatcttgaactttgatgtcagtccgatttttcgatgatcagcgactaaaatcttacatttgattgtcttgttgaccatcatttcgttgatcgttgattcatttaatatctttgttgtgaccccatgtactacatcgactccgctacagccaatgatacaaatgtctgcattgactgaagaaatcgtatttaatgcgatgtcgcccactagtgcttcttttggaaagcgcatctctccaccagttaaaatataactacaattatctttgtgcggagagtaattgattttcacgttgtttgtaatgactgtcaaatggttagattgaagaaaatccagtgttttcaacgcagtcgagctagaattgataaacagcgtatcataatcgttaatgtatttactagcttctctggcaatcgcttgtttaatcctttcaggaccagattgatcaaaatcagtctggtttttgtaattataagaacaataaccgtaattgcgtatgatctcgtttttttcttctaataaatttaaatctcttcgtatcgtactaatagatacatcaagggattcagctaattcgaaagttgatagttgttcagtctgctgaagcagttccaaaatttctttttgacgtttttcaatattgacaagtgagtttttcatgacttttgcctcctgagggacatcttgatccatggatttatttgactagttgttcatttaaacattcatatctgtctttattatactgaaacaatcattgattactgaaagaaaatcatataaaaaacaaacggtcatataaaagggttttcatggatgctgatacacattaatatttacttgtaagttggaacaacgatatggggggagcaagcaaatgagtaaaactgtcaatgaagtaacaaaagaaaagtggttagtagaaacatttcctgagtggggcacatacttgaatgaagaaatcgaaacagaagtagtggatcctggaacttttgctatgtggtggctgggctgtacgggaatttggctgaaaagtcatgaaggaacgaatattttatgtgatctatggtgtgggacgggaaaacgtagtcatgggaatggcatgatgaaaaaaggccatcagatgatgcgtatgagtggcgttcaaaatatgcagcctaatttacgtactcagcctttcgtaatcgatccttttgcgataaaaaatgtagacgctttaatcgttacacatatccattccgatcatctagatatccatacagccgcagcagttcatcaaaattgtcctgaagcaacattcattgggccaaaagaagtggttcgcacgtggcaaaaatggggaattcctgaagaaaaaacgattacagtaaagccaggtgatgcagtcaaaatcaaagacatcaatgtagtagctttagaagcgtttgatcggacagcgttggtcacttgtgaagatccagaagaggtattaaaaggaaaaatgcctcaggagatggatcaaattgcagtaaactatttattcgaaacatcaggagggaatctttatcatgcaggagattcacattactccaatttatttgccaaacatggtaatgaacacaaaatcgatgtctgtttaggggcctatggtgaaaacccacgagggataacagacaaagttacttctgttgatatgctgcgcatggcggagtcattgaatgcaaaagtagtgattcctgtccactacgatatttggtctaattttatggctgatccaaaagagatcactgaaatttggaaattcaaaaaggatcgcctgaagtatggatttaaaccttatatctggcaagtaggcgggaaattcatctatccgacaaacaaagatgatcttgagtttaatttttatcgaggatttgaagatgtcttctcgattgaaaatgatacaccgtttccgtcgtttttataagaaagaaggggagtttcttgctgaaatacttttttgaccatcaattgattcattacccagataaagaaatcacggattggcgtgaagctatcgccgaaagctgtcttgtattgatcgataaggaaattattgatgaaacgtatgtggaggagatcatccattgggtagaaaaatacggtccttatattgtgatcgcacctcaagtagcaatgccgcattcttcagaaaaaagtgatggtgtttttggaacagctatttcatttaccaagttgaaacagccaatccgttttgaaagtgaaggggagaatgaggagaaaacggctagtttgttttttacactcgcagcaaaagatccagaagaacatctagaaaatatccaaaaattatccgaattattaatgacagatggattggttgagcgtctcatctctacgaactccatcgatgattaccaagttgtgatggcagaatataattaattgatagaggagaaaaaagatgggggaatttttgttaagcatttggacgtattttgcaacaaatatcttgacgcagccagcatacctgattggttttatcgtgttattaggctatattttgctgaaacgcccgcttcatgaatgcatcgctggattcttaaaggcaacggtcggttactttattttgactgttggctctggtggtttggtcaataattttcggccaatcttggttggactaaaggaacggttcaatttggatgccatggttacagatccttattttggacaaaatgctgtggatgctggattaatggagacatttggccgtacctttggagatgtgatgattttattactgattgcatttgttttaaatatcttattagtccgttttcagaaatatacgaaactgcgttccgttttcactaccggaaacgttcaggttcaacaagcagctaccgctttttggattttactgttttgctttcctgatctaggtaggatacaagtattgatttttatgggactgattttaggttgttattgggcagtagcttctaacttaacagtaggaatcacgcaggaattgacagaaggtgccggatttgcagtggcacatcagcaaatgttcggaatctttatatttgcaaaattagctgagtggatgaaaaagcgggatgaaaagaaaaatagatcaatcaagcaagacaaaaaaattgaagatatcaaattaccaggattcttgtcgattttcaatgagaatatggttgctacttcgttactcatgctatttttctttgggatcattctgattgtactaggcaaagattatttgattcaagcgcaattcatgcaagaagggcagagtttcttattctacattatgacgacttctttaaattttgcggtatatctggcgatcttgcaattaggtgttcggacattcgtcgatgaactaactcaatctttccaaggaatctcaaacacgattttaccaggagctgttccaggaattgacgtagctgctacttttggctttggttcgccaaatgcggtaacgattgggttcttgtttggtgctttgggacagtttttgatgattggtttactgattttattgaaatcaccaacgatcgtcatagccggtttcattccgttgttctttgataatgccgttatagcagtttatgccaataaccgaggtggattcaaagccgcttgcctgttcccgtttctttcaggaatcatacaagtaggcggttcagcattattcgctacatggattgggatgtcaacatacggtggttatatcgggatgttcgactgggcaacagcttggccattgtttacagtaatcatgaaagtcctaggttatgctggaattgccgtagttgtcattggtttattggctattccgcagttacaatatcggaaaaatcctgatggttattttttgattgtagaagactatgacacatatgcagaaaagcagagagtataaaagaaaatctgattagacaacactcataatggagggattaagatgagaattttagtatcgtgtgcaaatggatcaggaacaagcttgatgatgatgagaagtgtggaaaaagcaatgaaagaactaaacgtaccaattaccaaaatccatcattgtgccatttcagagggaaaaagttcagctggccaatacgatgtagtttttacgccagtcaattttttgaatatgtttactcaggcagagaaaaaaggagttacagttatcggtatcaaaaatgtgatgtcagtcaaagaaatcagtgaaaaatttgctgaaacaaagtggtaccaaaaaaacaagtaaaggaaggaactaagatgagcaggccgaatttgcaaattgcgttagatcacaatgacttagaacatgcattaggagatgttatgaaagttggtgatgtagtagatattattgaagtgggcacaattctttgcttacaggaaggacaaaaagcgattcgctgtattcgcagtatgttcccagataaaaaactagtcgctgatacgaaatgtgcagacgctggaggaacagtggcgagtaatgttgcaaaagcaggagcagactggatgacagtcatttgttgtgcaacgattccaactatggaggcagcacaaaaagaaataggtgaattgcaagtagaactctacggcaattggacttttgaacaagccatggattggcataacatcggtatccggcaggtaatctaccatcaaagccgtgatgcgctgttatctggtgaaacttggggtgaaaaagatttatcgaagatcaaaaaactgattgaactaggctttaatgtttctgtaactggtggattaaatccacacacattacacttatttgaagggatcgatgtgtatacctttatcactggtcgtggtattacagcagcaaatgatccgatgaaggccgcacaaaacttcaaagatgagatcattcgtatctgggggtaaggaaatggctcaaattgggatttatgaaaaagcgttacccaaagatatttcatggaaagaacgtttttcccttgtaaaagaaatggacttcgattttatcgagatgtcgattgatgagacggatgagcggttagcacgattagattggtctgaagaaaagatagctgagctgagagaagagatgttcagctccggtgtacgtatccattcgatttgtttaagtgcgcatcggcgatttccgtttggttctgctgatccagaaaagaaaaaagcagcgaaacaactaatgaaaaaagcaatccatttggcgcataatctaagcgtcaaagtaatccaaatagctggatacgatgtttattatgaagagaaatcaatgaattccagagaagactttatcgaaggaataaaagaaagcgtaaaggaagcttctaaatatggcatcattctttccgtggaaatcatggatgatccatttatgaactccatttcaaaatttttagaaatcaaagaacagattcattcaccttttctacaagtatatccagacctaggcaatttgtccgcatggccggaaaataatccggctcgagaacttgagaaagggatcgattatatcactgctatccacttaaaagatacttaccctgtaacaaaagaatattcaggccagtttcgtgatgttccttttggtagcggttgtgttgattttcttggattattaagacatttgaaacgtctagattatgatggaacatttctgattgaaatgtggagtgaaaaaagccaagactttcgaagagaaatccagcaggcaaaagactacttaagttctaaattgaaggaggctggctatgatgtcttgtgaagaaaaaattgcagcaatgaagcaacgtgtccttgaagcaaatctggcattgccgcgatacggattagtcaaattgacttggggcaatgtgagtgaagtggaccgtgagctaggagtcatcgtcattaagccaagcggtgtcagatatgaatgcatgcaagcagatcaaatggtggtaacagatttgtcgggaaatataatagaagaagatagcttaaaaccatcttcagatctccccacacatgttgttttgtatcaaacttttgaagatataactgctattactcatactcattccacgcactccgtcatgtgggcgcaagcaggacgcgatttgccagcttatggcacgactcatgctgatgctttttatggtaaggttccttgtacacgccaattaacgaaagaagaagtaagagaagcttacgaagttcatacagggaatgtgattgtcgagacgtttaaggaaagaaaattagatccaaacgaagtccctggagtacttgtctatggacatggaccgttcacatggggggattcacctatgaaagcagtagaaaacagtttgatcttagatgaaatttgtctgatggccaaagaaaacgagctgatcaaccccaatatatgtgaaatcccgcaatatttactagataaacattattttcgcaaacatggaaagtatgcatactacgggcaatagagatgctagggtaagggtagaaaattaaaagataacacttgatagagagaaacagaggttgtgaagaaaatttatcacaacctttttatttatcaaaaagtatgcattctaaaaggaaagaggaattttaaggaatcgagagaatctttacaggagagttatatgtgatagattaaatagtcaaagaactgtattattagagggagaattgtataagaaaggaagaaaaaaatgaatattgattcccttatgatcgatgagatttctgaattatataagagcgttggttggacgaattacacaaaagacactgcaaggttagctagagcatttgaacaatctgaatctctgataaagcgtaatggggaagggaagattatcggaatcgttcgttggatcactgattttgcgacgatcgcatttattcaagatatcctcattcatccgaggtatcagcgccaaggaataggcaaagtgcttttgaatgaagctttggagaagatcactagttatggaccagtccaaatcgaattattgacagatgatactgagaaaacaaaaaaattttatgaatcagtaggatttgttcaagtaaaggaaatgggtggtatttcttatgtcatagatactagaagaaaaaaggtgctttttggtaatgacaaataacatataataacgtacaaaagaaaaaattctagcttagttctttagaaaaacaagaggatagacttagtatcactcaatctatcctccaatgctcagctattttatttttttactcacctctttatcaaatacaattttttgcaaattcgaactaatataaaaaatgaacacatgatttttttttaaagcaaatgctatgcgataattttttttattaattttgactttcatctcgtatattccttttgccgaacgagtacgcactggctttatacgaaaaaaattatgctccaaatactctgtcactttgtgggaaattgcttctttatacatgaaatgttcttcttgtggaaattgcttaagtagttcactgtcaaattcaacagtataatccatgttttatttcctttctatactgatacattataaaaataaacaattttataagtctctatatttcatgatgaatgacaagtatatttgattcatcttgatatagctctacgagatctccaattccaggatacatattgaaataatcatatggtatacaaacatttattttttttcaattgtcaacactgcgtcttcttcttctaattctataatcttagcaatttgtacgtcgcttttcatgtgtgatcttcctttctatacattggatttacttttcgatgatatctacaacagctttaccacaagtcagttctttttctagctcgttctttatttttatggcacatggtttggaaaaaggagcagcttctttccatgaaccaagtaaaggatattcgttactgatacctttcacatattgtttgtttttgacgccttttgtttttacttctacataatacatttgatcctcttctttcttgctgtttttagttaatattcaaatatatgtaagtgaaaatgattatgtatctatatctttatgataaataaaaagaatcaatttgaaagtttttttcactcgatataactaatttgaataatatatataataaaaggctattgttcttaaaacgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatatttaaaaaatttgaaaaagcgtttgattatttatattacgacttagtgcaataaaaaacgctttttaacagtacatgtagtcgtctttataatagataaactctgtaatattagttaaaaagctataagttgcacttagttaagtgcaaacatttcatattgtcgttagtttagaaaacgcttatattagcaatgtaaggagagatgataatgcagcagctaacaaaaagagaaaggcagcttttgatttacttggtggaaatgtctgaaccggtaacaatcaaaaagttggctgaaaaagaaaatgttagtgttcggacgataaaatacgatctagatgatataagagagtggctgaatgagcggaagcaagtcctatatagcaaacgtagtcagggaatttggatgaatattagtagctctgatcgaatcaaattaaaaagcgaattgatggatgttaatcgttttgaaatatttgcagatcaaagtctccgaatcaaacgtttactaattatgcttttagtaacaaaagaagctattactggaatgaaaatggccaacgcattagatgtcagcaaagatacgatcatgaatgatttagatgtgctggaaaataattttcttaaggaaggattgaccttgaatcgtcaggcgcgaaagggtttttggatcataggagaagaacgtctagttcgattaacgattgaagagattcttcaaaaagagttcacggattatgacatttataaattaatgtcattgttattgaatggcggtgagactgaatactttgaaatgtattctgctactgctacacctatccaagaggtatttaatcaagtaatcattcgaatgcgacacttactggaatttgaaaatctagagaaactgaattacgcggaattactaaatattctgattcgagtgacaattgctaccgttcgcttacgcaaagaggctacgattggtcgttatcaattggttgctgaacaagaattagacaaaaacgatctttcttatcgcgtcatgcagcaggtctttgattattatcagttgccactgttcgaggatgaatatcattatatctatagtgatacattcgacacgattcaccagcaagacgtcatgaaactagttgagaatgtgatttataaagtaagtaaagcaatcaaccattctttttatcaagatccacaattgttgacgaatctgtatgctcatttatccatgcgattatcgagaaagaaaaaatttgtcaatgaatataatccttttaaagaagatatcaagcagaaatacccggaattatttgatgcgatcaagcaagcagttcgacaagaaataagtgaacaaaatattctgatcaatgattctttcgtggcatatattgccttacactttttggtttcctacgaaagagaagaagatctacgaagcgttagagccgtctacatttgttcaacagggttgggtgtgactagtctgatcaagcaaaagatcaatgaagaattaaataatatcactatcgtggcatttgcttcagtattgaatgcgcaagaaatgattgctaccaaagatcctgatttggtgattagtatttttccaattaatggcatcgatcgtcctttcatcaaagtccatccattacccactgaacaggacttgaaaaaaattcaacaaataataaaaaaaatacttgcttcttccaatcagcaggaaaggcataacttgaatcttagagaaacgtccatcaataaagatactttagaagactttagcaaggaattgattttgaaagcttatacgatttatgaacgtttacttgtcattttggaagcagaattgatccaagaatatcgagaagcttttttgcttcatgtattcttaatggttcatcgtatcacatttgatcaacaatatatggcagaaggtcgtcaagtagaccagattattttagacaaaggaacactggtaggaaaaatcgaagcagtttttgcagaaaataatttaggaatcaatcagtcagaaatcagtgcattattctcatatataaaagaaggagcgtcaagttagtgaaaatgtcagacgaggctttaaaaattatcgaggaaagtcaaaatcgggaaaagttaaaacaagtgattgatctaattgaagagcgattagtagaacatgctattgtaccaaccgagttgcagtggaccattctaattaatcacttgaatgagatgctgaaacgttctcaaagaaaggaaacgattcccgtagtcgatcgggatttgttcaaagaagtatccaaagaagccataactatttctgatgaaatagttagaagtatcggtaatttaaccgatgatgaaatatatgttttgtcgattcattttgaaacagcaaaaaataattaatatttagtctaatggtgataagtcaagatgaaatttaagattttctttattgagtaatatgttttgaagcgcacgaaactagacccgatcaaaatcaaatttttttcgggttgattcaaggatttgcgtcaataacggattgttatttctctatcacactccttggtggcgtatagagttggtgtttacgtagtagcgtatccaccagacgcgtaaattttcttgcggttaggacgagtgcacgtttgtgttgatgctttggaacctccttatatttactttgataaaaagctttgtattcaggaagataattttttacagagttggcagcttcaactaagtagtatctaaaatatcgatttccttgttttgtcagaggtgtattttgcgactgatagtttccagattggttcactttccaacttaatccagcgtattttgccaattttgtctgatcttcaaatctttcgatttgaccaatttcagcgattaaaccggcagcatagactttaccaacgcctggaatactggttaagcattgatattctggaatgacaacaattacttgttcgatggctttatctaattctttgatatttttttcaagtgctcgtatttctcgtacgagaacacttaaaacaacattaattgattcttgtgcaagagcacctaggcggtaactcatggtaattgcacgttgaattgctttagcgattttttctggttgcttgaaacggccttttcctttttcttgaagtaaatcacagaaagcttctaaaggaagctcagcaagttcatccaatgtgaaatcttccgtcatgagtgaaatgagggttgcactaaaaagactcgtcgattcgtctcgcatttctcgagcaagcgtattacatttgtacgttagattttcaagaaaatgttgctttgtacgaatcaattgcttaataagttgatagcgagtacgtgttaaacgctgtaaggccatgtatttctcttctttgataggggaagttgtgaatcgttgaatacgcaagaaatcagcgattcttaatgcatcgtttcgatcagttttattctcatcaaacatgcgactaaattgtttcacccgaaaaggattttcaatcgttacaagtgtgttgagcttctttagtttctcatcttcatgaaaaaacatggaaggatggaagctgtacatggacgttgactccatgccaatcacaatttgatcaaagtggtagctgttattgaattcaagaattgtttctcgtatgaatgaagcaccttcgatgtcattggcaacagagatttcagataagatagacaattgattgtcgtctgttaaaaaacaaacatctagtttttcagagctaacgtcaataccgacaaataatttcatggaagaaggacctcctttcgatataaattttggaaaatgcttcgatactgtgggatttcccagaaactcactgtatagccacaacctcgcctaatagaatacggtgataaaagagctagaagctgccttccaaactactatttgaaagtctagtccattatcgaaacagctaatgagttggtagtgataacagtggttcgggtaacagactaaacagggtagacaaacgctacaggaggaaatagcaaattcccgttggatcctttccatacatccattgtactctgagaaatcacacaatatcgaaacaaattccgttaggaatgtgttattcaataaattttataatctagaaacattttgaataaaaactattagacaaatgatattttacgaggaggaaacaatcatgattaaagtagttattgcagaccgtatgggtaaaggacaaaatgtggccaaaggggtagaagcagctggtggaaaagcagttgtcgtaccaggaatgggggcagatatgcgtttgggcgatgtgatgcaacaagagcatgcagatatgggtatctctttttgtggtagtggtggtgcaggtgcattaacagcagcaacaaaatatggctatccagaacgacatggtatgcgttcgattgaagaagggatcacagctatcaaggatggcaaaactgttctaggtttcggctttatggatcaagaggaattagggaaacgtctgacagaagaatttatcaaaaagcatggaaaatagaaagagggacatgaaatgagcgttcaaaagacaattcagcaaaaagttatcgtctccggtaaaggggaaacaaagcaacatgcttttgcatcagcgttagcagaaattcaaaacaaaataatggaacaatcaaacgtattattgcgaatcgaaccagtcaatgtggatattttaaaggcggtcgaaaacaaatacacagaacgctttctatttttcttcttcccacggcaacgtattagctatgaagtcgaactctctgttactgtggctgtaacagaaataaaattggcagacatatcgttcagccagcaaatgactgaagatccaaatgggattgccattccatttgtaactaaaaaaatctaattttgaatcataagggggaaagaataacgtggatttcgtaatcattctagtcaaatcggtcattatcgggggattacttggttttgcagcatctgtcggggcagctcgaatgtttcatgcacctaatacacaaggtttaggagcttttagaacattaggcgaaatgaatgcctgcatgggtgatccagcttctcatttttcatttggtttaggctttttctttaatgcatgggcttcttcagttggtgctggtgcattcacacaagatgtgacgcatcgaatcattcccaattgggcagcggcagcacttctagcaaaaaacaaagatgtcacccagaccatgcatgatccgaaaaaaatggggatcattggagcggttatcggggcagtggtggtagccttcttaaacacaacagctgcagcaattccagaggcgttacaagtgacggcggtttccgttttggtaccagcagcgacgattctgatcaatacagtaatgccagttattttttggttggcagctttagacgcagggaaacgaactggtttttggggcactctttttggtggtatcgcgcaattgattatgggaaatgcggtacctggtgttgttctaggaatcttgattggtaaaggcgtcgatgagagcggttggaatcgcgtcacgaagagcatgatgatcgctattgttttattatttattttcagtggatttttccgtggatttgatatggaaatgatcaagagcttccagcttcaagtgcctaattggcttgataacttgcacaacatctttagtgtgaaataggaggagaatcatggagacaacagaagaacaagcaaaagtattagaaccaaagcggcaaaagagcttttggtttgcagactggtcttttccgctaatcgtaggaattatgtccgctgctgtatttgcaggaacacacatgtatgtgatgtatggtgtgggtgcattcaatgaagtttcgatcgtggcgatgttaaaagccgggctggatggcggatcctatggcgcagcggcagcgtttggtgctagtttcttatttgccagaattttagaaggctctttagttgggatcttggacttaggcggttcgatcctaactgggatcggaattggggtaccagcaattctcttaagtatgaaaatagcggcaccaatcgataattttgcactctctttattgactggtttggttctaggtttgattgttggtggcatcattgtcttgattcgtaaatttacgatcaatcaatcaaattccacttttggtgctgacgtcatgatgggggcaggaaattcatctggacgttttttgggtccattaattatattaagcgcgtgtgcagcatctattccaatcggcattggcgctacattaggagcactaggattctatgcttggaaaaaaccaattgctggaggtgctattttaggagcaatgattttaggagcaatcttcccggcagtaaattaatagaaagagggtcattaaatgtttgatactttgattaaaaatggaaggttagttgatggatctaaaatagaggtcgctatagaaaaaggcatgattaaagcagttgcagcagaaataaatcagccggcgcaagaagtagttgacttggagggaaagtattatttatccgctgggtggatcgatgatcatgtccactgctatgaaaagatgaatctttattatgactatcctgatcagataggggtcgaaaaaggtgtgacgacggtcattgatgctggaactacgggagcagaaaacatccgtgaattttatcaattgacgaaatcggtcaagacaaatgtgtatgcgctaatgaatatctctaaatggggcattgtcaaacaagatgaacttgctgatctaacaaagattcaagaagatctagtaagtactgcgttagcagaactgccggaatttattgtcgggattaaagcgagaatgagtaagacagttgttggtgaaaatggcattaagccattagaattagctaaaaaaatccagacagaaaacaatgatctgccattgatggttcatatcggttctgcacctcctgagttagaagaagtattgtcaagaatggaaagaggcgatgtattgacccattgttttaatggaaaaccaaacggtattttagatccaaagacagatcaaattaaaaactttgtctgggatgcttacaataatggtgtcgtctttgatattggacatgggacggatagctttaatttccatgtggcagaaaccgcactaaaagcaggaatgaaagctacctctattagtacggatatctacatccgcaatcgtacaaatggcccagtttttgatctagcaactactttagaaaaattgagggtagtcggctattcttgggaagaaatcattgaaaaagttacagcagttcctgcacggaattttcatttgaagaataagggccagttagctgtcaattatgatgcagatttgacgatatttgagattgttgaaaatgaaaaggaattgaaagattccaacggatttacacgtatagctaaagaacaaattttaccgattaaaacaattattggaggcgtcatatatgacaattagctatggaaagtttgatttaaaagaagtcattaatgcatcgggaaaaatgacgatcctaggggtttctaaggtatctgaaagtgtcctagcagcacaacgatttggaggcgagcatttttttgagatgagtgatcttgccatcaaaaccggcgcttatctttctcaattactgaaagtggaagatgcgcaaatcgtttcttctgcttcagcagggattgctcaatctgttgctgctttaatcggacagggcgacatgtaccatgtctatcatccctatacagaaaaaatcgctagacgggaaatcatcatacctaagggacataatgtagattatgggacaccggttgaagtaatggttgctcaaggtggaggaaaagtcatagaagctggctatgcaaatatgtgtacaccggaacatgtttccatgatgattacggaaaaaactgctgcgcttctatatattaaaagtcatcatgcagttcagaaaagtatgctgacggtggcagaaatggtagaagttgccaaagctcatcgtttgccattgatcgttgatgcagctgcggaagaagatttattcaaatatagcgaaatgggcgttgacttagtgatttactctggggcaaaagcaatcgaaggtccgagtgccggactggtcataggaaaaaagaagtatattcaatggattcggctacagtctaaaggtattggccgagcaatgaaaatcggtaaagataatattttaggctttacccaggcactagaagattatttaaaaaatgggagcgaatccggtgactccatgaagcaacgattagcgccttttgttaacgcaatcaatcaacttcctgacctttcagcgaaaatagttcaagatggtgccggcagagatatttatcgagcaagtgtaacgattaatggcgataaaagtgcgaaagaagtcattcaggaattaaaagcacgaaatccagcagtctacacccgagaatatcaagcaaataacggaatcattgagttcgacattcgttccgtcagccaaaacgaaatggaaaaaattataaaaagattgagagaaatcatgtaggaggcttttaaattgtcagttatcccaaattattataaaaatcgtgtatgtttaaatgtattagctcattcagttgaaaatgcaaaagcatgctatgaagcagcggaagggcatgtcgtactaggtgtgctatcgaaaaattatgctagcgatgaagcagcaatcgaagatatgaaaaggtaccaagacgcaaccaataatgcgttgtcagttggattaggcgctggagatccaaaccaaagtcagatggtttcgcgtttatctggggttttacaaccacaacatgtcaatcaagtatttactggcgtggggacttctcgtgctttattgggccaaaatgatacagtcatcaatggattggtttcaccaacaggtaagatcggctatgtcaatattgctacaggtccgttaagttcacaagcgccagcagctgaagtgcctattgaaactgccattcaaatgctgcaagacatgggaggtacttcaatcaagtatttcccgatgaaaggcttagcacatagggaagaatttaaagcagttgcggaagcttgcgcaaaatatgaattctatttagagccaacaggaggaattgatctttcaaactttgaagaaattctgaaaattgcaatcgatgcaggtgtaaaaaaagtgattcctcatgtttatagttcaattatagataaagaaacaggagatacgcgtataggagacgtaaagatactattaagcatggtaaaaaaaattattcactaactcattagaaaataagaagcttattccagaatgaaattaaatggaataagctttttataattaattacggaaattgttaatgtagataataatttagatgtacgtaagcagaagtacagaaatgtaagattttccaatattattttattcaacataataaatcgtatatcaatttttttagcgaaatttctatttattccaagaatttcagttattacggaatcattttgtgcttaataaaaagaaaccgtttttatatactataaatgtagaaaggcggtaggaaaatgaaaaaaattattgcaatcacatcctgtccagttggtattgcccatacatacatggcagcagaaaacttagagaaagcggggaaagcagttggcgccgaggtaaaagtcgaaacacatggttccatcggtattgaaaatgaattgactgcaagagatatcgaagaagcagctggtgtaatcatcgcagcagatactaaaatagataaatcacgattcggcggtaaacctttgataaccgtaggtgtgcaagaaggaatccaccatgcagatgagttggtgagagatattttagcaggaaaagcgccagtctataaaagtacggaggcaattatttcttccgaaaataaaagtgaatcagaaaatttaggtaaaaaaatctataagagtttgatgaatggcgtttcgtacatggtacctttcgtagttacaggagggttattgatcgcgatttctttaacattaggaggaacagctacacctgaagggatcaagataccagaaggaacgatttgggcaacgatgaatagtatcggaagtatcgctatggggttgatggttccaattctatctgcatttattgcgcaaagtattgcagatcgtccaggacttgttcctggatttgttggtgggatgttagcggcaaacggagcattatatggtagtgatgcgaatgcgggattcttaggcgggatcatcactggatttttagcaggattcattgctttaggaatcaagaaagtgcgagtaccgaaagctttacaatcgatcatgccaattattgttatcccaattttaggatcattggcagttggttttgtgtttatctatgttattggagaaccagtagctcttctatttagttcattgactcactttttagcagggatgcaaggaggaagtgaaattgttctagctatgatcttaggagcgatgattgcttttgatatgggggggccgttcaataaagtagcctttttgttcggatctggcttgattgcagaaggcaattattccattatggggccaattgctgtagctatctgtatccctccattagcattggggctggcatcattgattttaaaaaccaaatttacgaaaacagaacgagaagctggtaaggcgtccttagcaatgggactgtttgggattacagaaggcgctattccgtttgcttcaacagatccactacgggtgattccaagcattgtaatcggggcaatgacaggaagtgtgatcgcgatgctttcaggagtgacagatcatgtagctcatggcggtccgatcgtagcggttttaggagcagtggatcacgtagccatgttttttgtagcagtgattgctggtattgctgtaaccgtgctaatgttaagaatccttaaaccgacattacaacaaactgcggttgctgcagcaaatggtgtgacagtagcagatctatcagagactgaaacaagtgatgtttatacgaaaactgaaacttttgattctatcacggatattatgtcagatgaagcaatcgttttaggtgaaacagcaacaacaaaagacggagtaatcgaagatttagtccaacgtttagaaaaaacagcggcgatcacagataaaaccagatttaaagaagtcatctatgatagagaacatgaaagtacaacgggaatcggtatggggattgctattccacatggaaaatcagcttatgttcttaaaccaacagtggcatttgccagaagtcaatctggggtagattggcattctttagatggaaaacctgcacatatgatctttatgattgctgtacctgaaaacagccaaggtgatatgcacttgaaaatactgcaacgtctatcacgtaaattgatggatgatgacttccgtcaagcactgatggaagcgccagataaaacaacagttcaccaattattaagcgaaatgtaacataagatgaaaaatcgaccgtgatgagacataatagatgtgttatcatgatcgattttttatttagaagggagtttctgcacattatgaatcagcgtcagcaatctttgatctatcaattaagtgagaacaataattatataacaacaaaaaagctagcagagcatttccatgtgtcagaaagaacgattcatagcgatttgaataccattgaaacttggttgagagacaaacatctgcctttaatgtttgaaagaaaaaaaggtacaggtatcttgttgaatggtctgcctcacgaaagggaacaactgaaacgagcgcttaatgaagagactcaaacagaaatggataaaaaacagcttcgtcagttattgattttccatctgctagtagcaaaagacggatttagtcttgaagaactttcagaaaaactatatgttggaaaacgtacgattcgtaaagaattgacagagttgcaaagcttttttgagtatcaccatttacagctagtatccaaaacaaaactaggaacttttcttaaaggcgatgaacaagaaaaaagacagttgcttgttaagacattacgaaatatgcagaaagaagatccacaaagtccgtcgttgaaagaattcttcgctaaagatacattaaaagttatccaacatacattacaagatgttttttatgaaaaccatttagaacagccgaatggactggctagtgtggagattcacatctactttatgctcgagcgaatgaaacagtaccagaaagtgaaattaagtaaagacgaaaacgaagtcgtggaacacacccaagcacaaaagttaagtagtcaaatattagcaaaactagccaccatctatccaattgaattttctcctgatgaaatcaattatctggctttgcgtatcgccaatctttttacaaattcacaagcagccacacgttttcaaaaggaatctagcgcacttgctgatcatttgatcgaacaagtggaacagtttctaggctattcattaaaagaagatcagctactaaaacaaaatttaaggtctcatttatcttcaacttattttcgactccattatggtttgcagatttctaatccattgacgaaaaatgtgtttagtacgtacacacaacttttcttagttttacagttaattttagaagattattttgaaaaggaaaatttttatgttccacaagaggagacagcttatttaacgatccatttccaagcagcgatcgagcgacacaaacatcagaaaagtagaagatatcaaacggttttagttagtgaatattcaaaagctatggctacttttctcgaagcacggctgaacagagaacttccagaattaacgattatggatctagttgaatataagccagaattaaagagacaagattttccctctgttgattttatcttggctacgttaccatttaaacatataagcattccagtaatcgagatctcaccaatgatcacagaaactgatctagcctatttgacaaaatatatgctggagcatgtgcctatcaagaagaaaaaaacatttgatctagcaagctttactcatccatttctgatctttcctcaacttgaacggacagacccagccgatattttaaactttatgggaaacgtcttagtggaacatcattatgtggagccggaattcatcgattctgtcttggaaagagacagtcactccagtactagagtagcaccatttgtaacaatccctcacggtaatccgctgtatgtgaagcattcgatgatttctattgctacaatgaaagaaccagtcctatggcacggggaacagatacgtatcgtactgctattagcaataaagaaaaatgatttgaaacatgcagagttcaaaaaaatattttctgttattcactatctagaaaagcagccagaacaaatggctcagttgatgcaatccaatcatccgctagaaatcttaacgttgttatctagttatgaataagtagcgattaaaaaactgcctttatatttataataattctatctatttatttggaagtagaaaactaaatacaaaaaaagaggatgtggccaaagttgtggcacatccttttattttgagtttcttataattttttatagttgcttacgatgtcttgactactggtaaacggtgttcaagagacaatttgtcggcaataaggcacaattttgtaaaatatggaaagctatttttttaacattgtttcttagtgcttgaaaaatcattttgaatacttctttatacgatcgatgtacgttgatttaagtctaaaacttttcttttgattccttctctgacttttctgaattccgttaatatttcttcttcgctcccgacagcttgtgcaggatcttttaggtcccagtgaaggtgttcgtgattgtttggaacggcagggcacttgtctttggcatcaccacaaagtgtaatgatcaagtctgcctgagtaaagtaatctctatcaatcaaatcagacgtctgtttggaaatatcgatgccgtcttctgccatgatttttatagctcttggattcaagccatgtgtctcgatccccgcacttcttatctcaaacattgaaggagacaagtatttacgcgcgtagccttctgctatttgactgcggcatgaattgcccgtacataagaaatagatttttttcatttgatttcctccgttatggattagtaaatgtcactgtttatctaaagtaaactctatgtgatggagcgaaaaaacaatgggtttcttagtttatatatttctttttgttcagcgtataaatcgatgtgtacaaagaactaatcttgtcttttttaccataaatacatgttagaaacaatcattttgagtcaaaaatcaacgatgtaacagactgttaaaagagattaagacacggcagatgatgaagaaagtaggggtgtagtaagccgatacatttcttgattgtgaggcgagaacaattattcgtcttttaagaaaaaaagtagtagaatcagttcatattaaaaataaaaaaccttccatttttgtaggtttaaaggaggtcattaccttgaaaaaaatcggctttttaagctttggacattggatggagcaaggatcgcttgtgaaatcagctcaagatgcttatttgcaatcgattgatttagcggtggaagcagaaaaaatcggagtggacggagcgtttttccgcgtacatcattttgcccctcagattgggtcgccgtttcctttgctagcggcaatcggcgcaaagacaagtaagattgaaatcggtacaggacttattgatatgcgatatgaaaacccttattatatggcagaaaatgccggattgacagatatcatcacgcaaggaagagtgcaactaggagtggggcgtggttcacctgaacaagttctagatggctggaaatactttggttatgattacagtgaagaagaaatcaaagaggtaacacgggaacgcacccttgaattcttggaattacttgaaggaaaaccatttgaagaaccaaatcctcaaccaatgttcccacaaggatcaggaaaattacggatagaaccttattcagaaggattacgacaaagaatctggtggggagctggttcgcagcaaacggcaatctgggcagcacaacatggaatgaatctgcaatcatctacattagtcaattacgaatcccacgagccattccatatccaacaagcaaaccaattacgtgcgtataaagaagcgtggaagcaagcaggtcatgattttgaaccaagaacattagttactcgctcgattcagccaatcaccactgatttggatcgacgcttatttggacaagacggtagtccgcaacaagatgctgtcggctatcttgcttatcaccgaaacccaacgatttttggaaaaacttttgctggtgaacctgatcaattaatcaaggagctagctgaagatgaagcaatcaaagaagcagacacagtacttgtcacgattcctaatactttgggggtagaatataacatgcacttgcttgaaacaatcgtaaaagatatcgctccagaattaggatggcggtaaaaaggatatttttgtaagtgcaggatacttgagtgaaaaaataaacacttctaacaatcagttagaggtgtttattcatgttttcatgaagttcatagagaaggagagtgagttatccgtttgttcaatgagaatgtacataagcttcttttacatgttggggtaaatcatcaggaatcattgtcaatacggcttcttcattgccggcttttattgcttcttcatagtaccagcttttgtagtttagcatagcgagtactctttctaattttgctatttctttttctactacttctttttgtttttcaaatagttctttacgaacctcaaatgtcttactgccttctttgctccattccatgaattgcttaatgtcttttatttctaaaccagattttttcaaacagtcaatgactcttaaagcctctaactcattctctgaaaattttctaataccagaaacacgctggatatcaggaaataatccctctttgtcgtaataacgtaaagtagaaacaggcaatccaaacatttcagacacttgtccaatggaatacataaaaaaatcctcctaaaataaaatttttaccttgacctaaagtcaagtttaagttttatcataataatacattcaaaaacaaatgtcaattttgatcaaaggagagtctagaatatgaataaagaattaaacatcacacaagaatgggacaaagtatttccaaaaagcaatcaagtcaatcatcgaaaggtgagcttcccgaatcgttttggtatcacattagtcgctgatttatatgaaccaaaagaagtaagtgaaaagaaattgccggcaatcgctgtgagcgggccatttggtgcagtgaaggaacaatcgtctggtctatatgcgcagacgatggctgaaagaggctttttaacgattgcgtttgatccatcgtttacaggagaaagcggaggagtacctcgatatgttgcttcgcctgatatcaatacggaagatttccaagcggcagtagactttttatctgtacaaaaaaatgtaaaccctgagagaatcggaatcattggtatttgtggatggggaggtatggcattgaatgcagcagctatcgatacgcgggtcaaagcaacagttgtttccacaatgtatgacatgactcgagtaacagcaaatggctacttcgatgttatggatgaaaatgcccgatatgaaatgcgtgaagaattaaatgcacaacgcatcattgatttcaaacaaggggactacgcacgtgctggaggtgtggttgatccgttgcctgaagatgctcctcaatttgtcaaagactatcatgcgtattataaaacagaccgcggatatcatgtccgttctttaaactccaatgatggttggaataggacatcagggttgtcacttatgaatgcaaaactattgcattatattccagaaatccgtcatgcagtcttagtcattcacggggaaaaagctcattcacgttactttggggaggacgctttcaaagaactaaaaggtgacaacaaggaactcatgatcattccaggagcatcccatacagatctatacgaccagacagacatcattccatttgaaaaaatggcaacattctttgaagagaaccttgtgtaaccaaaaggatttaatctaaaagagattatgaaaaaactgccctgcatcaagtaataaggacagccaaaaaagctcctcatttttgacttggttggactcattagcgtagatgcaagcttttgaacaccgtttataccaagaggtcgtgagcctgccgtttaactctgagtcacaaggagcaatttcaaaaaatagcttctcatgtttgttgaatattgtgacttgtgaccgaggagttggcaggagaacaccgtttattcgaaaaaaggactgtgacaatgtatcgactcccaaaagttagaccaaaaaatctaacttttgggggtcggtacacacgttttttgtcacagtctctttgtgtctcatttcatataaacaattatttactttgtactatttatttcatttctgtgattttaatgctttttgctaaattttttacatcagctggaataactttcccgacttctgattgctgtgcattcgacatgccgcaagccattgcgtaccttacacattcttttaaaggataattctgttctaatgaatgagcaaaacctccaacagtggcatccccagagcctgttgtattaatgataggaatcttagggatctcaacattccaaaattcttcttttactttgactactgcaccatacgagccgcaagaaatcatgataacatcgatatctttaaatagtggatttgtttttagatggtgttttatgtcgcttttttgagtaattttttgatggatgatatctgaaaactcatggatattaggtttgatgaacatcggtttatacttacttgctaagacttcacggagatgttgtccagatatatccattaatatataggtggaaggatctatttgttctttgatatattgtaataatttagcatacaaaaagggatctggattgttaacagaaccatttattgtaatgactgaaaggtaattatttttactgattagtttgatatcattcattaattttttgatagtagtatctgctatttcaggaccagcttccactagctctgtctgcgtttcatcatcatgcatgatcgtgacggcacctcttgattcttctgcaataggtaaaaaatgcaaatcaaacaaattttcatttttcagcatatcttgaatcatactgccaaaataaccgcccaaaaaccctgttaaaataactgatgaacctagtagagcagaagctcgtccgcaattgattcccttgccgcctacatagcgtaccggagaatcaaagcgtgtcatcgtacctaattcaaagtgttttgtaaaataaatggaatcaatggatgggttcatcgtgattgtcagtatcatttttgggctcctttaatattgttaagtattttgaataatgattgaaatcctgttctgataaatgattatcggttattagataatcaaaatcggttaattttctaaaagtatagacgtctgatttatttaattttgaataatctgcaacaatgcatttgatttttgctgcattgagcgctgcgttctgaatatttccctcaataaattgagcggttgtcacattgttatcaaatatgccgtttgttgcagcgaaagagatatcgacattcaaactttcaaaagatctttctgcaacttccccaatgaactcttctgtaataggagaaaattcgccaccagtaagtaaaatccgataacttgtatgattctttaaatagttgaaagcaatcaaactgtttgtaattacaaatagatttttcttttgaatgaaaggaagtgcatataggatcgttgttccagcaccgacataaatagtagaattatcgggaatcatactgttcatgacttgaccaatatattttttttcggctacattcgtatcaatcttttcttgagtcgatagttctcgattataaggttcctttcgttcaacgccaccatatagcttttttactttatttttttttgctaattcagtgacatctcggcgtatggtcatttctgatacgcctaatttgttagcgatttctgaattagttaaataaaaatctttctctaataatgtaatgatttgttcttgtctttcttttttcagcatatgaattactcctttaacataaaagtcaatttttgttcgactttgttcttcttaattatatagataaacgattttattttcaagtagatcaaatttaacaaaataaatttcttttgaaagcgttgacaaaacaaactaacagaaatataatgttcttgtaaaacaaagatgaacttagtagaacaataaattaacaaacttaatcaaaaaggaggaggttggaatgaaatataaagagatgttcgttcctagtttgattcaattagcggtagaagtaaaaaataaagaagaagcttttttaatcgctgcacaacaattagaaaaaatggggtacgtcaatgagaattatttgaatggactgattgcaagagaaagagaatttcctactggattgattactaagtatttaaatatcgcgctgccacattcggaatgtgaatatgtcgaaaagccatttgtttttgttatgcagctgaagaacccaatttatttttatcaaatgggggataatcaggaaatgactgtagaaaatctattttttttaggaatcaaagaaccaaaagaacaagtaggattacttcaagcgtttatgaatttattcatggatgaaacattcgtggaaaattacaagaaacaagaaacaccgcaaaacatatacgaacttattacaaattatatttaggaggaagaaaaaatgaaaaatcggttaattgtcgcatgtggaagtggagtagcaacgagtcagacaatcgctagtaagatccaaagtatgttagaagatgacggcatcgcatttcctgtagaagcagttgattacaaatcgattcaaaatgagcttctaactgctggaatctatgtgtatgtcgcacaacctgatgaggaagtacttgaacaagcaaaagatttgggtattgaagtatttccaggaattccatttttaactggaatgggtgtagaacctatttatgacagtatcaaagagttagtacagtaaaggaggattgttggataaaaaagttggttcatagttttatttactatatttagaaagaaagaaggtttatttatggaagttttccaaaccattatcaattatgttttgaacttaggatcagccatttttgttcccctgattattttgatacttggattgttggcagggatgaaattaaaaaaagcattcatgtctgctttgactttagggattgcttttagcggaatgtctatggtcattggctatatgtctaacgcagtaagtccagcatcagaagcattggctaaaaatacgggaatcagtttgcctgcacttgatcttgggtggacaggtgcagcaagcatcacatggtcgtggagttatgcttttatattttttgcagtaacgattggggtcaattttgtactgttactttttaattggacgaagacgttaaatgttgatatgtggaatgtttgggggaaagctttaactgcttatttagtttattatgtttccggtagtttggctgcaggctttcttactgcaatggtccaagttatattggaattaaagcttggtgatatgtttcaaaaacatatacaagatctcacagggattccattagtaacagtgactcattttatgacatctgccgctgtcttgttgctgcctttcaatatgatcatggataaaattcctgctttaaataaacgagcggatacgaatgcattgaagaagaaaattgggatcttctctgaaaactctgtaatgggattcattattggattggggcttggctttgctgctgcgtatggcgtttcaggttctcttaatctagcgatccaaacagctacagcattaagtttgtttcctatgatctctaaaatgttcatgcaatctttgtctcctctagcagacgctatgtcagaatttatgaaaaagcggtttaaggatcgtgaagtatatatcggattggactggccgatattagctggtcgttcagaaatttgggttactgctattttacttgttcctgtgtttattggttatgccattattttgccaggaaaccaagtattgccattagcagggattatcaactattcgattgcggtcggcggattacttttaacaggaggaaacttggctcgtatgctgatcttgggaatcatcactatgcctatttatttgtacggggccacttaccttgcgccaatactcagtgatttagcagaaaaaagcggagcagtcgagggaatcaagaaaggacagttgatcacatggtcatccatagaagggccggagttcagggttttatttgcggaggcatttaataggaatattctcgctattgtaggatgcgtgatttttctaggactgtttgttctactttataaatatatgataaaagcgaaagtaccgagtgaacgttatgctgaactacaaaaatagcattgaaatggtgggaaagtaatgaaaagagaagagacagataaaataaaatggacagtcgctctttgtggtacacttctgctatttctatatggactctttactcagaatatcatcatcaatctattggtcatttttttcgcactagtgatctataaatatggaaatcacgttttattcagagagtacgatgaaaaaagaaaacggaaaatagaagaatcaatgaaaataaaagaagctaccaaagaaatattgagagaaaaaagttttataaaaagataatggaggggtcattatgtcagatggacgtatgttatttgagagagaacgacaggacatggcacgtatcgtaagagtgattttcgaaaggaaaaacacaaatgtcgcaggagggaatttttcctttaaaaccactgatgatcaagggaaagactacatcatcatgacgccgaccatgatgtcagaagcctatctaggagagatttctcctgcacaggttctagtagtagaaccaagaacgcgtagaatcgttgacggagtcggtcatttaactcgtgaaatcaatatgcatgaagcgatgtatgagactaatccagctatcaaagctgtcctacatgctcatgcgcctaatgcaatgttctgggcgactactgggttgcctatgcctaatttgacagaagccacagctaaagtaaaagagattcctgtcatggactttgagcctaattgctctgaagaacttgctgaattgacaagcgactatgtaaaaaaacagcatctcgaattaccgcatatgttgctgctcaactctcatggcgtattgatcaacacaggtggagaatcaggaatcgaagctatccataaagcactgcaaatccttgatacagttgaatggaatgcagaaattgcctacaagcagacgatttttcaagcattagggattactgacggtttttattcaaaaggtgagaaaatcgggggattggaagagttgaaacataaaacggctatttataataaatctgttattgcagctggtggagactaacctatctgacacaaaaaactacgactttcacaaaatctgatccagatcgatatctgcttcaggttgtattatgtaagtcgtagttcttttcttttatttagttaagaggtggtctgtccattccctcgcttgcttgatttcgtccatcgtcaactgatgacctgttacagttagctgaatagtcacatttgcttggcgtgtttcgaattgatcggccaattctttaaaggaagcaggggaaacgattggatcgttatcaccataagaaatccagacggttttatcctctaatgtggaacggctttgatgaacacctagagacatcggatggaaaaacaaccctttatttagctcggtctcacgctccaataataaatgagcagcgatgtttgcgccatttgaatagccgacaagcagccagtcacttaacggtatcagttctttttcgctgatttctttgattttttcatggagtttatctgtttctttttccaaactgtccaggtcgaattgattcaatccattacgcttgaaaaaacgattcatcccatcttcttggaccgtgccacgaaaagaaagcaatgtactgtttggtgcaagaaagtgagcgatatccagtaaagaatgttcatcgccacctgtgccatgaagtaagatcaaatgcttgccacttgttcctttttcaaaaatgtaggtcattttgttccctcttttctgtttctatagatgcaaatgaagtagcatgaagagattattcacgttttttatttgcatcacttgtatcgaaaggacggacataagcttcaatggcttcacgacgttcttctaagaatggaggaagagatagtttttctcctgctgattctgctggttcatcttcaaggaatccaggaccatcagttgctaattcaaacagtacgtgatgagcggctaggaagtactcagattggaaatagaaacgatcgacgaaaccagaatttggcaattcaatcttattgattacttgaatccagtattccaatgcttctttgtctgctacacgcaatgctaagtgatggatatttccaaatccttcgattgcttttggcaagtctgtccgatgttcaataatgatgcttgcaccatttcccccttcaccgatttcaaataagtagaaatctcctgaatggtctgtttctttgaatcctaagattttttcaagaatcaagcggatatgctctaattgactgacacggacaaagacaggtccaagtcctgtgatcgcaaactctgtcggtacattgctgtttttccaaggaatgccagctgctacaccttgattgttttcgtcagagatcaattgataatactgattatcgaaatcttcaaattcgatatattttttgccgaaacgttcattgattgctgaatgagtaacgtcatatttttcaaaacgttccaaccaaaagtctaatgctgcgtcacttggcacacggaaagaagcacgagagatcgtatctgttcctttttttccttttggctgatttggaaaatcaaagaaagtcatatctgttcctggcgcaccagtatcgtctgtaaagtaaagatggtaagtttcgatgtcatcttggttaactgtttttttgattaagcgcattcctaaaatatctgtaaaaaagcggtagatttttgtagcgctagatgtcattgctgtgacgtggtgaattcctctgatttgtgtatccatgataaatttcctcctgttaacttacaaaaagtaagtagttgatttagacatagtatagagggtgcatctctattttgcaattaatttgtcttctaaagtatcaggaaggaatcaagaatggaaaagaggagggacggatcaataaaataaaaagacttacgactagctgtatcgatttcaaaaaaactagctttaaaaagctaactttagaatcattacgggtggtcataagtctttttatgctgagttattttttcatttttgagctaatgcttaggatagaatagaatgttgatttcacgatctcttcttgttacttgaaactgcttaccactgtcacgatctcttggtaaacggctttttcacaacctctttggttaagttgaacgcacatccagcacagaatagttccgaacatcaaatcggtttcggctggaagaatattcaatcggctgtccatctttgagatagacgacttgctgaacttccagtacaggatcgttttctgcacagttcaaatattgctgatcatattcatcacttttatctgcagaaatagcacgataagcccctgcaaaatggacattcaattcttgatgaagatgatcatagatagaggctaacaaatgttctttttttaaacccggcacaagatggactggcataaaggtatgctctaaaacatatggctcgccatctaagatccttaaccggtgaatattgtagacaggttgctcggcatcgatcatcaatcgttcttggatatattgattagggaattcaacatcaaaatgaatgatttgactcttcaaagaacgatgtctgcgtttcatttggagactcaaaccttcatactcgttagcgggcgatgtgtctttttgcataaatggatgattcaagattttcgttcctgatcctcgctgcgaatagacaagtccttccattgctaagatattgatggcttttttgattgtcatccggctcgcaccaaattcttttaccaagtcgacttgattaggcaaaaaactatcgagaggatactcttttgaacggatacgttctcttaaaatatttgcgatttcttcgtattttggcacgttattcacctcttctagagtataacgaaagattatgcttccgacaactcgaagtagcatctggaacattgtttattcgaaaaaagaggtcatgacaagtttttgtcacaaccccttaatgatctattaagcaatatctaaatctggttgtttatctagtactttcaggaatgggtaccagataaaggcaacgatgacaaagtcgatgacttgcagcataccaccaagccatgaatttgttgctaagacaccgcttgcaatgattggcacagtccatggaacagagacgccagttggtgcagggacaagtccagcagccattaccaaataattgaacgtcgttacgattagaggtgccacaacccaaggaataaggattgttgcattcaatacgatcggtagaccgaagatcgctggttcatttacattgaaaataccaggtgctaaagctaatcgtccaacatcacgatactgtttctttttaagaacaaaggccatcaataaaacgacagctaaagtcattccagagccaccaataccaacagtgaaggtttccatgaatggttttgtgatgatgtgtggtaattcttttccatgttgataagcttctaagttatcaagcatcagtgtattccaaatcgggtccattacagagttgacgatgatttgtccgtgaagtccgaagaaccataagaattggacaaagaacaaagcaatcaatgttgcaggtaaactacttcccaaaccagttaatggtttttggatcacttcataaacgacgtcatgtaagttagcattgaaaataccagtcatcacagcattgattactaagaaaatagttagtgtcactacagcagggatcaaagcggcaaatggttttgttactgcaggcggaactccatcaggcattttgatctgccagccgcgtttcgtgattctgcagtagatttctccagccaagaaagcagcgatcattccaatgaacattccttttgcgccaagacgatcaagtgaaagcacaccagtcacatcttcaccgccagcggttttcattgcaaaaggcgtaagaatcaagaagctggcaaaagacacggcaccaccgaaaataccttcaacgtcataagattttgataaataatagccgataccaaaagtaacaaaaaccgacatgatgctcattgttgcattttgcccattaccgaataaattcgataaagttccctttgttgcgtcactgaaaaaaggcaagttattgataacgacaacgatcgaaccgaacatcgttaaagggaaggaaagcatgaaagcatcccgcagcactgtaaggtaacgattttgccctaataaattagctaagggcatgattttctcagaaagcttgtccataaaaccgttcatttttattcacctcaaatttatttgcaatcgattacatacaaagtataacgccaaaaaatttaaatgtctagtcattttcataaaaagtattgatttattttttagggttcgttatgattacggtatcaagaaaaaagagaggaagtaaaaaaatgaaaacctacacattcccagaaaatttttggtggggttctgctgctagcggaccgcaaacagaaggaagagtaagtgatgatggtaaaggagaaaatatttgggatcattggtatgaattagagcctgaaaaattcttcgatcaagtaggacctgaaaaaacttcgcaagtttacacaaaatacaaagaagatgttcagttaatgaaagaaactggccataacacatttcgtacatctatccaatggagtcatttgattccagaagggacaggtgaaatcaatcaaaaagctgtttctttttatcgagattattttactgaattgctggataatggtattgaaccttttgtgaacctttaccatttcgatatgccactaccactgcaagaaaaaggcggatggttatcaagagaaacggtcgacgcttatgtttcttatgcagcagcgtgctttgaactgtttggagatctggtcaaaaaatggtttactcataatgaaccaatcgtacctgtagaaggaggctacttgtatcaattccactatccaaatcatatcaatatgaaagaagcggtccaagtaggctatcatgagaatctagcaagcgcaaaggtaatcaaagcctaccatgaaggcggacatgatggtgagatcggaatcatcttgaatctgacaccaagctatccgagagatgaaacgaacccagaagatgtaaaagcggcgaagatcgctgacgcattcttcaaccgatcattccttgaccctgcagtgaaaggagagtttccacaagagttgatcgaaattgtcaaagaattggctataatgccagagatccatgaaggagacctagaactcatccgtgaaaacacgattgacctgctaggaatcaattactatcagcctcgtcgaatcaaagcaaaagaaactccaatcaatcacgaacatagccccatgccagatgattattttgataattacgacatgcccaataaaaaaatgaatccatatcgtggatgggaaatttacgaaaaaggaatctatgatattttaacgaatacaagagaaaactatggtaatatcaaatgctatatttctgaaaatgggatgggggtcgaaggagaagaacgatttgttaacagcgaaggaattattgaagatgattaccggatcgagtttgttacggatcatttgaaatacgtccatcaagcaatccaagaaggaaccaattgtgtgggttaccacatgtggacatgtatggacaactggtcttggacaaatgcttataagaatcgctatggctttatcgctgttgatttggcacaagacggtaaacggacgatcaaaaaatcaggtcgctggtttaaaacggtctctgaaaaaaacggatttgatgcctgatattttttgataaaacgttcacaaaatgtttgttctaacactgtaatcgtgctacactaacagtgaaggaggcgtttacaatggtagatacttatcgtaatattttagtagcaattgatggttctgaaaaggcagaaaaagcatttcttgaggcaatcacgattgccaaacgaaatcaggcaacgttgcacatcctgtatgtcaatgaagtaacaggcaattactttggtgattttgcatttgttacaacaagccttcaggaagaattggatgaggttgcggaaaaccagatgaaagaacatcgaaacttggcaattgaaaaaggcctgacagatatcgagacatatgttctttacggttatccaaagacactgattgctaatttccatgaatcgaaagaaccaatcgatctgattgtcatgggggcgacaggtctgaatgcggtagaacgtgcactagtaggttccactacttcctatgtagtcaaccacgcatcatgtaacgtcatggttgtaaaataaataaattaagggaacagaaagcaaaaaagcataacgcttcttttgctttctgttccttttatttttttgtaaaaaattactttacctgatgaagtaatcatgctattctaattacaacgacagatggagtaatatggaggaaagaaaatgatttcaagtgatggaatacgcggatacaatgatgcgattattttatcgatccttaacaaaaacgattcttatggatatgaaatttctaaaacgattcgtgagaggacaaatgattcctatgtgatcaaagagacaacactttactccgtttttgcccgtttagaaaagaatcaactgattgtttcgtatcctggagaagtgactcatggaaaaaagcggacatattataaaatcactgaaatagggcgtaatcttttagaagaaaaaaagcaagagtggctgacgacgaaagacgtagtcgatcaatttttggagggaaattaaatggatacaatccgtaattatttagacagtctttttatcggagtacctcaaagtaccgagatagataagctgaaaactgatttgttggcaaatatggaagaccattatcatgaattgatgggagaaggaaaaaatgaacaggaggccatcggtacagtaatttcgacatttggttcaatcgatgaattattagaagaactagatgtcgaaaaaaaacatcaagctgacgagacggaaacaaacacagcttctatttatttaagcgaagcagaaaactactggaaagaatacagagcggcaagtctccaagtggcatcaggtgttctattcattagcttatcttttgcaagttttcttttcttttgttcagcaggatatgtgttcatgggtatttcttgtctgattttcggtatagcattagctgtcggtttttttattgcttctggtatgaaaatcacacgtttaaatcactttttgcaccatcggaaaatacctgaaaaagtattagcagaagcaaaagaaaaagaagaagagtatcagcgaagttttggcttctcactgattgcaggaattggattatgtattttttcacttttcccacttttggcttctttaatgtggtatatggatggtagtatcggtgcctctatattttttgttacggtaggaacgggtgtcttcttgatcatttatggcagtctagtccgtcattcttatcgtcaattcactcaaagcgcttattactggtgaatgtattcagatttgtaaaaatattctatttatccggcgtagaaaaaaagactgtgacacgcttttgtcacagtcttttttatatataataatttaaaaattcatcatctaaatccgtagaattttctagattgcttacccatgtaaaatcgttatagacagatttcagttgacttctgcgccattgtacagggataaaaagacgcatgctatcttcattgaatccgactaataatttctttccgtcagtaatgatgggacgttgtaacaaagtaaaatgcgagacgatcagatcgacaagctctgaggtcgtacattggtcgatttggtctttcaaatttttataatcaatcgagcgtttagctaatagatcgtcaaatccgttttctgttaatgacaataaataaaatatctctttccttgttaaaggctgtttaggtgtgaaaattcgttctctgtaaggcatttgatggtctttcagccagtttgccatcagatggtaactatgtgtgcgagaagaatagatcgtaagcataaaaaaactccttaaatagtccattaatttgttagatctgttgagataaataataggtaaggagctgtgcataagcattgatcaaaacaacccaaacatcattagaaataactttctaaagtcttaaacttgcgacgagaaacaactagactaatagaaaaaatgtcttagccatttggcttcctgtttgtttttttgcttatgctgcagctcctcgggaaagggttctaacaatttgaagaaggttgatgattgatctagtttaaattgtgtgaaatttgaaatctggtgtttttactagatgaatcacctaacaactatgattataacttatagaacttctgttttgcattcggttttgttatagttgttataaagttttattttattacagaacatttttaattaataaagaacagttagaagttaaaattgctgattcacatagagtttatgacttcttggaaattctttttcaatcagttttttcatctgtttatgaaattcttttttttcagtaaacataaaggtttgggtatcgtaaccttcttcatgtaggaaatagattattcctttttctgtgttttgcgtataagcttttatactcctgtcttttttgaaagaacagatcgtatagccatctatttggtctggtagtcgtttgattttcttcaaaatgacttttttatcctcaagtttcatttttttcacctgactttatttttttcatatggaaatcatagcgcctttggttatatgaaaacaagaaggatactgaaatatatataaatcaaatagtggttatttattattagaatagcgaatacaaataaacgaccactattttctgatttattgcaaatgttttttcaaataaatttgattaccaagaaaaggtagtggtatatttactgagggatactttgaaaaacatatgatagaaacagtaacagtattatgaaaaatctttttataaaaatggaggaatcgatttgatggaagatcagtatgtacaagcaatgacgatcgcaggatcagatagcgatggaagcgcagggatgcaagcagatatgcatacattctttacaagaaatgtttacggtgtttctgtcatgaccgcatgtgttgcaggtaattcttacggaatcggagcaagtgtgacattgccaacagattttatcgacaaagaatttgaactgattgcgaaggactttcaaatacgtgcagctaaaacaggtatgctagcagattcaaagttgattgagacagttgtaaaaaattaccaaaaatatgattttggaccattagtcgtggatcccgtaatcgtaacgaaacatggaaatcttttactagaagaatctgctttgcaaagcttgaaagaaaagcttgtccctttggccgaagtactgacacctaatttttatgaagcagaaaagctgactggacggacattagcagctgaagaagattttgtgcaagcagcaaaagaactgcaagatatgggtgcaaaaaacgttatgatcaaaggacatcatgctaaaaatgcgcagcaagaaacagtcaatgactacgtattgttcgaatcaggaaaatcattttggttaaatgcaccattttatcctaccgaccggatcaacggaactggcgattcgctatctgcatgtattgcagctgagttagcgaaaggaaaaacagttgaacaagcgatccgattggcaaaagactatgtaaaccgtgcaattcgtgaagaaataaatgtagggcacaaatatggccccatcaatcattgggcagctggtgaattagagtaaaagaaagaagttgtgaaaaagttgccctgcatcaagtaataagaacagccaagtaaaaacagcttcttatgtttttaacttggttggacttattaccgcagatgcaagcttttgaacaccgtttaagaaagaggtcgtgagcctgccgtccagctccgagtcacaaggaacaagttcaaaaaacagcttctcatgtttgttgaatattgtgacttgtgaccgaggagttggcaggagaacaccgtttgttcggaagaagggactgtgacaagatttttgtcacagtccctttaatcttagtatatttttctctacttgaataaaaaaattataggattggagaaaataatcgagaaatttgttgcttgaataatagccagttagacatttccttgactgtttcagttgtcatggatgaacaatgtgtctcatcttctttgaactgagtagcaagttcttctaaaaactcaggatcgtaaatgacagcacttgtttcaaaattcaatcggtagctacgaatatcttgatttgctgaacctaccatgcagatttcatcatccattatcaatgtttttgcatggaggaagccgttctcatagacaaggatttgtacattttccttgatcagctgccgagcataatattgtgttgctcgataaataaaaggatgatccggtttgttgggaatcatgattttcacatctacaccagaggcagttgcgatttttaaagcagcaatgacactttcatcaggaacaaggtaaggtgtctgtatccaaacacgttttttagcagaagtaatcaatttgataaatgaaagcttgatttgttccctttcgttattcggtccgcttgaaacaagctggatggatgtatcagcaagcttagattcatctcgatctgcttttttaaagaaataattcaaatgatagccgacctttttttcttcaggtaccgagacgttccagtctgttaagaagcgaagctggagcaaagaagaagcggcaccgaaaatccgtatatgcgtatcgcgccaatagccgaatttttttgttgtatttacatattgattggcaatattgaaaccaccggtataactaatctttccatcgatcacaacgatttttcggtgatcatggtaattcaatcggaaacgaagtaatgccctttgtgaggtaacaaatgtatggacatgtccaccatttttgattagacgattgaaatcttttgcttttgtgccatgagagccaaatgcatcatataatattcgaacttccacgccttctgcggctttttcttctaaaacatgtaagacttgctggccgatattatctgtcacaaatgcgtaatattcgatatggatcgaatgtttggctttttttagatcttgaagcagtgaatccaatttctcttgtccgtctgtgagaagagtgacagaattcattcttgtcagcggcatacgatttaatgaagagaagaagtcaacaaattgctgtttgtctttatcgcccatgtcaggatcgtaatgttcaatggtatctcctctaaaagactgaaagttttctaattctttcaagtcactttgtcggagatagaattttttcttatccgttaatccacgtccgaaaaataaatataatacaaagcccaccccaggaagggcaaacaatactaagagccatgcccaaatggctgctacatctcggggtttgatcaaaatagccaccaaagcaataagtgcatttaatagataaagggcggttataatactagataccacaaaaatgttcctccttacatacaataacattagtataccatgatagaagaaagaagcctaccaaggtgaatatacttttcactcctttcatgaaaatgtaggtaaatcgggctaaagtagttgctttttgtaggttaataaggtaggatattagtacagttgaatatctccttaggggagtaaccggcaacgtttgttgcgataatatcaacagtaagttaaccaaatggttttctggtattgtatgaaatggtgagacctaagacaaatgcgtatttgtcttaggtctcttttttttcagacaggactagggccaagatcaaaaaatgggggatgaaatttggaaaacaaggaacaagcacaacaagcggtctataaagaaacgatcgactcgttgatgcagcaaacgcagagctcaaccgatggattgagcaccacgcaagcgaaggaaaaattagaaagagatggcttgaaccagctaaaagaaaagccgaagaagccaacttggaaattgttcttagaaactttcaaagatgcaatggttatcgtattgctgattgtcgcactgattcagatggtcatgggtgactacatcgaattcttagttatttttgcagtattgatgttgaattctataatcagtgttgtccaaacaaaaaaagcagaaggttctttagaagcgttgaaaaacctttcagcgcccgatgctcgagtgattcgtgatggtaaggaaaaaacgattccggcaaacgaacttgtggtaggagatatcgtgttgttagacgcaggcgattatgtacctgctgatggacgtttactagatgcgggatcattaaaagtagatgaaggtatgctgacaggagagtcgacttctgcagaaaaagaagtaacggatatcacaagtacggtaccaatcggagatcgtacaaatatggtattcagtggaacgatcgtaacttacggacgcggtaaattcttagtgacttcaactgggaataatacggagatcggacaagttgctggccttttggaatcaacaactgagcaagtcactccgttacaacgaggtctggataaattcagtaaaaaactaagtttggctattttggcattgtctttattgattttaggtatccaactgtttcgtatttatcttggagaaggtacaggagatatgactgcagatatcgtcagcgcagtgatgtttgccgtagccgtagccgtagctgctattccagaagcattacagtctatcgtaacaatcgtgttatctttgggaacgaataaaatggcaaaacgtcatgccattattcggaagcttccagcagttgaaacacttggttcgacaagtatcatctgtacagataagactggtacattgacacaaaacaaaatgacagttgttgactactttttaggtaatggcgatactggggatttcacaaatgacccttcaaaatggacagctgacgaacgtcgcttgatcgaaatcagtgttttagcgaatgatgcatcgatcagtgaagacggtactaaattgggcgaccctacggaagtagcgtttatcgactttagtgaaaaattaaaccagccttatcaggaaatccgaaacaactacccaagacaagcagaacttccttttgactcagatcgaaaattaatgtctactggacacacaattgataacaaaaattacttgtttgttaaaggcggaccagatatcgtcttccaacgcagtaaaaaagtattgctaaatggtgaagtcgttccgatgacggatgaattgatgaaaaaattccaagagcaaaatgaagctttttcaacacgcgcattacgtgtactagcttttgcttaccgtccacttgataattttgatttatcatttgaagatgaagacgatttgatccttgttggtttgcttgctatgatcgatcctccacgtgctgaagtgactcaggcggtaacagaagcaagaagtgcaggaatcaaaacaatcatgattactggtgaccacaaaacaacagctgttgctatcgcaaaacaaatcgggatttttgaagaaggaaacctggctttgaccgggacggaactagatgaattgacagaagatcaactaaacgaagttttagaaaaagtcactgtttatgcacgtgtttcacctgagaataaaattcgtatcgttcgtgcttggcaaaataaaggtcatatctcagctatgacaggtgatggtgtaaatgacgcaccagcattgaaacaagcagacatcggaattgctatgggaacgggtacagatgtggcaaaagatgcagcagcgatggtattgacggatgataactttgcttctattgtcagcgcagtagaagtaggacgtaatgtgtttgataatatcaagaaagctatttcttatctatttgcaggaaatttaggtgcgatcattgcgatcatctttgccttagttgctgactggtccaatccatttacagcattacaactgttgttcatcaatttagtcaatgattcactgccagcaattgcattaggtacagaaaaagctgaacctgctacgatgaaccgcccgccaagagatccaaattcaggaatctttacggacaaaacattgatttctgtaacgtatcgtggtgtgctgattgggattgctgttatctttgctcaatggcttggcatgcagcattcacctgaattcggtgtagccatgtcattttcaacattgatttggtgtcggacattgcaaacattcccagcacgttcaaacacacaaacagctatccaagcagggttcttctctaacagaagtgtcttactagctgtagttgtatgtagcgcgctttactgcttaacaatgatcccaggactgaaagaagtcttctctatcccatcagcatttggattgacagaagtctttacatgtatgggaatcgcacttgtgacaattgttttgatggaaatcactaaattgatcattgtacgagtacaaggaaataaataaaacgaatcaacgaggttgtgagcctgccgtttaattctgagtcacaaggtgcaatttcaacaaacagcttctcatgtttgttgaatattgtgacttgtgaccgaagagttggcaggagaacaccgtttaaggaagaagttgtaaaatcagcattttgagctaatactgagggtcatctgattggacactgtttattcggaaagagggactttgacacgactttggtcacagtccctttttttatttatgatagacggaaagccaatcattttattattcatcaaaagagatagaatagataaaagaggagaatgatttattccgaaaagtgaaaacatataacaaaaaattagaggaaatcaaatgaatgaaaaagaatgggatgaatttgctgaagaatattatgaaatccagcaagaatcgcaagtaactattgctgaagatgtaaaaaattatctgaaaacggagaaagtcctgcctgctgaaacagcagcagacgttgctggaggatctggcagatttctttccttagcaaaagaaattaatcgctatgatttgatcgatttttcttcaggaatgctagaaaatgcaaaaaaagaagcagaaaaaaatgagttgccaaatgtttcctttatcaaacagtcgttagaagaatttatccaatcaaatgagacatatgaaatggtttttacagcagcaaatccagcattggtacatcttattcaattagaaaaattgatgaaaaagtcaagcaaatggtgcgtgataatcagagtagtggaatcaatcgatgatgttttttatcctatcgaaaagcaactaggaatgatagaagaagatcctaatacatcgccagttgtaatggatcaatttgaaacatacttaattgatgaaggattcaaagtgaagaaaaaagattttacttattttacacaggaatcaattactgaagaattgatgaagctatactatgacgcgtacgcaaaagatcctgttgtgaccaggtacattcgcaaactattcagtgaaaaacgagaaatccttagtacgactaagctgacctatagactgctcctttggtccgcagataaaaaaagaacctttcacgactcgtgaagggttctttttatgattttattatattttgtagtaacgaatatcattttcgatctttgtaatcgaaaaaggtacatctgaagtatattctgcacattctccgtgttcaggaagcgtctcactgaaaatcgtttcatattcgtcaacagtgatccgtgttcgagaatctagcatctcttgatgagattgtgcgaagagatattcttgatagttttcttccagataacctgtaaaaaattcacttactgcaccagaaccgtagctgaatagaccgatgcgatctcctggctgtagtgatttcgaattttccagtagagaagttagccccaggtataatgaaccagtgtaaagattaccgattcgtcggctgtaacggatgctttcttcatagcgagccataagacgttcctgattttcttcgtctgtttggtctaatacgctttgcaatgccttttttcccatcttagtatacggaatatggaaagcaatcgcctgataatcttcgagtcctcgacccgacaattctttatgtcgattccaaactttttggaatgattcgatatacgtagaattagataaaggaccatcaacaacaggaaattcgctataatctggacgccagaaatcatagatatcttctgtcagaaatacgctgtcgtcttcaatcgataaaatacgcgggttttgagtgatcatcatcgcaacagcaccgacaccttgcgtcacttcaccaccgcttgccaagccgtaacgagcaatatcacttgctatgactagtacttttcgttctggatgatttttgacatattctttcgccatgtgcaaagctgcggtgccaccgtagcaagcctcttttacttcaaaagaacgagcaaaagattggattttcagtaaatggtggataattaccgcactcgcttttgaatgatcaatcccggattctgttccgacgatgaccatgtcgattagctcacggtctttttctgttacgattttgctggcagcatttgctcctagtgtaatgatgtcttcatttgcacgattgactgccatttggtcttgaccaatccctatatggtattttgcaggatcatccccacggctttctgccaactctgtcatatctaaatataaattaggaataaaaaaggaaagacgatcaatccctattttcatttcaacacctctttacttatgataaaaaacttactttactaaggtatcataaaaagattaaaagaaatataaaaaagagaatatttaaggattgttaaaatttaatcttagaaaaaaataactggaacaagagctatttgtttttacagcaaagaatggtatatttttgtaggaggtggcttacttgaaagaagtcgttatgatagatgctgcaagaacgccgataggaaagtatcgcggaagtttaagtccatttactgcagttgaattaggcacacttgtgactaaaggattattagataaaacaaaactgaaaaaagataaaatcgatcaagtaatatttggaaatgtcctgcaagctggtaatggtcaaaatgttgccagacagattgctttgaacagcggtctccctgtagatgtcccagcaatgacgatcaatgaagtttgcggatctggtatgaaagcagtgatcttagcacgccagctgatccaattaggtgaagcagaacttgtgatagccggcggaacagagagtatgtctcaagcacctatgctgaaacagtatcagtcagaaacaaatgaatatggtgaaccaatttccagtatggtcaacgacggattgactgacgcattttcaaatgcacatatgggattaaccgcagagaatgttgcaacacaattttctgtgagcagagaagagcaggatcgctatgccttgtcgtcccagttgaaagcagcacatgctgtcgaagccggtgtattttctgaggagatcatcccagtcaagatttctgatgaagacgtgttatctgaggatgaagcagttcgtggaaatagtacattggaaaaactgggcacgttacgtacagtattctcagaagaaggaactgtaacagcaggaaatgcttccccgttgaatgacggtgcctctgtggtgatccttgcatccaaagaatacgcagaaaataataatctgccttatttagcaaccatcaaagaagtagcggaggtcggtattgacccaagtatcatgggaatcgctccaatcaaagccattcaaaaattgacagatagatcaggaatgaatttatcaacaatcgatctttttgagatcaatgaagcatttgcagcttcttctatcgtagttagccaagaactgcagttagatgaagaaaaggtcaatatatatggaggagcaatcgcattaggccatccaattggtgcaagcggtgcacgtatcttgactacattagcttacggattgcttcgtgaacagaagagatacggtattgcttcattatgtattggtggaggtttaggcttggcagtcttgttagaagcgaatatggagcaaacacataaggatgtgcaaaaaaaaaagttttatcagcttacgccatctgaacggcgcagtcaattaatagaaaaaaatgtattgacacaagaaactgcgttgatttttcaggaacaaacactttctgaagagctctccgatcacatgatcgaaaaccaagtgagtgaagtggaaatcccaatggggatcgcgcagaattttcaaatcaatggcaagaaaaaatggattccgatggcaacagaggaaccatctgtcattgcagctgcaagtaatggtgcaaaaatctgtggaaatatctgcgcagaaacacctcagcggctgatgcgagggcaaatcgttctatcaggaaaatcggagtatcaagcagtgatcaatgcagttaatcatcgaaaagaagagctgattctttgtgcaaatgaaagttatccttcaatcgtgaaacgcgggggcggtgttcaagatatctctactcgggaattcatggggagtttccatgcatacttatctattgattttttagtggatgtaaaagatgcaatgggcgctaacatgatcaactcgattcttgagagtgtggcaaacaagttacgggagtggttccctgaagaagagattctattcagtattttaagtaattttgctacagaatcattggcttctgcctgttgtgaaatcccattcgaacgcttagggagaaacaaagaaatcggtgaacaaattgccaaaaaaatccaacaggcaggggaatatgcgaagcttgacccttaccgtgcagcaacgcacaacaaagggatcatgaatggtatagaagctgtagtggcagctacaggaaatgatacacgtgcggttagcgcttcgatccacgcctacgcggcaagaaatggattataccaaggattaacagactggcagatcaaaggggataaactagttggaaaactaacggtgcctttggctgttgccacagtaggcggagcttccaatatcctgccaaaagcaaaagcatctttagctatgttagatattgattcagccaaggaactagcacaagtaattgctgcagtagggttagctcaaaacctggctgctttgcgtgcattagttacagaaggaatccaaaaaggccacatgggacttcaagctcgttcattagcgatctcaattggggctattggtgaggaaatcgagcaagttgcgaaaaaattacgtgaagcagaaaagatgaaccagcagacagctatacaaatattggaaaaaatccgggaaaaataaaaaagcaatatctttagaagaataaagcaagatttacagttattttatttactgcagatcttgcttttttctctatcagaaaatatgtttattattagaattttttatagttaaggttaggcatcttaagaaatcaggcaactccaagatatcttcaggtagaagagaagtcgcctaacattgtaggatcataggtgatttgttggacaggtcaagctgatatttgagcctgatgttagaaggaatttctttttacttgctgtagaaattattatatgactaaaaaggctgggattttaaatcccagccttttatgacaaatagaatttttatcgatcagtaatcgctgtcgctgcaaattgttcgatcaaaggaatcaaagtcaatttgactttgtatttccgttcgagtgctttttcgataacgaactcattttcagtagtcatagaaatagttgctaatttacgaggttcatcagcatttttttcattaataactacttcatgttcattttgttctgtgtaaaatttaggatactcagcaacggcttttgaaaaatcagcaaaacttaaagcggcattcgtatcagttgagcgtgtattttcagttgtgtccgcttttggtttttccgttttttcttctggcacactgactgtttcttctgtaactggtgtcgcaacagcttgcgcagttggttcatcgtttttcaatcgttgatcattccagtaagacacgatttcaataagaagattgtcacggaatcgttcgaaaatcccgttttctcctgaacgaattctctttaatacagtattgaagttgtcatcgattggcacgttgatccgtgtatcttcatttgttttcccagctaatccgatcgttaagatttgacggtttttgggatcaagcatgacttgtaacggcaaaccataacgtcgcaagctctcttcttctagagaacggaataattgtcctcttacaccatccaatgaaggacggaattgatttaataatttttgtttctgttttttcttcatatgttctctccttcgctcataccctttcgattataagaaaaaaacagccaaatgaaaaggagtaatgcaaaaaaacttgcgtatacgcaaattacaacagaaaaatttgcgtattttcccgttttttgaaagaaaaataaaaaatggaacggattatgtatatatacataatccgttccattctttctattttttcggtatcaaggcaaaaacaggtagttcaggtgaataaatgacttcatgttcgtgccagggtttgaccattagcgaatgatcgaaccgttttttcagttcttcgatgatttgatcatgtgtccagtttcttgcaggaaaatgttggattttctctgcatcgatcaaaaagacaaaatcggaatgaaaagtctgggtaacttcttccgagagagaattcaagcgttcgattggatccataaaatcacctttcgacttaaaattgggtagtatctgggtcttttgctttgccgactacaccatctaactgatcgatttgtttcatttcttcttctgttaattcaaaatcaaataattcagtattttctttgattctgcttggtgtcactgacttaggaagaggaaggaattcgtgttgcagcgaccaacgcaaagcaacttgtgcaatcgtcttgtcatgtgcttcagcgatttgtttcatttcaggcacatcgaagattttaccagtgcctaatggactatatgcttcgaggatcatatcatgtttttttgcatactcaactacagttgtctgtaattcgcctggtgcaaggaaaacttgattgaccatcggcataatttttgctgtttttgctagtgtatctagatggtggggtaagaaattgctcacaccgattgctttgattttacctgcttcatacagttcttcaaatgctcgccatgtatctgcatttgcttgttcccaattatcacgaaaagcaacagggtttggccagtggatcaaaaacagatctaaataatctgtttggagcttcttcaatgattcttcaaaagaagacatcacaagttcatagctgtggtttgcattccataattttgttgtcaagaatatctcttctctaggaattccactttccttaatcgcttggccgacgctttcttcattcttgtatccttgggcagtatcgatatggcgataacctgcagccagcgcttctttaacagaggaaacagcgacatccccatcaggtgtttgccatgtgccgaatcctactaccgggatttcgtaaccatttgatagacgataagtgcttgttaatgaattcatactttcagctccttttttattcgttcaactataagtgtagcgcatttttcgaaaaaaagaatccattttgtttctactcttgaaatttttgtttaaaagaaaatgattttgattctggtatttttgattttttttccgtaaactaagacagaagggaatgagaaaatggatatctatttaaaaaaagcaattctgcatattattgacagagaaactggttctccagtcttttcacaaaaagagctggatctgacaaaagaatatattcgtgattttcttcaaaagaagatccaaaaaatctcttctgctcaaacaaaaactggacaactagcagaagaaagcatgatcgttgaatcacttaaaatcgctcaagaaaattttgtggaagcaagtgaagcaatcgttcagcggtggttcgatatctaccaagaaagtgaagaagcacctagtgcagatgtatttgttgtcttgtatgaattagatacagtgatgtacttatctttattgaaagtcaattatcgtgaggcttacactcactttgttgaagcagacgaagcagggatcgacaaccgcttgattttgaatcgagcaattctaggggcgaaaacacaaaaagcagatgaagcattcgctgtgaatttgactgattggacctacgaattaattgaaaaaaatatgagttttctggcaaaaaagagctttattttctggaagaagtgatccaaaagtgttcctgcaccttctttagaaagaaatggtaaaagtgatcccaaaagtagcccagcatcttggaaaaaaatttgagacagaagaatttgatatcatggctgatttgaaagaagctgtctatgatacgatagaagaaaaaggtcggttggatcatgagatgattgcggaaaaagtcttcaaggaaaacatcacggcaaaaatggcttttaaagaagaagtacaagagcaaggatttgtcccagaagcacctcctgtaaaagaagtacaagaaatttctgagaaaaaatttggaaaacaaaaattcaagctatcaaacgggatcgaactgatcgtaccagtagatgtatatcgcaacccagatttgattgaatttgtgaataatccggatggtacgatatccgtgatgatcaaaaatgtggatgaagtattgaatcgtttataaaaatgactagaatattaggtgttcaagtaccagtgatcagttaaatgaattgtgtcaagagaaggatcggaaaagacgggctctatactttttgatgttggtgaacttcaccaacatcttttttgtataaaaaaatatagaaaagacaccctgaaatcctttagaattaatttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagcttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataaacagaacagaaagaggttttcttctttctgttctgtccaaattattctaagatttctctttaccaacatcatttgacaaagagccaaaagacgaatataacaaaaaaagagcgtgagacaaaagtaaagaacacttttgtctcacgctctaaacacgtataaacggcggaagcagaagcaactccttcttatttcttggagttaaacgcttctgtcccagcctctttttatctaataaaattttaagaccatttactaattatcgattttttctgccgcatttttaggcacttcagaagcctttatttcttcccagcttaatacacctttacgaggattgactttgagtttaagatacgcattcatctttaatggatgttctctttcttcgcgaagcgtcacctgttttttttcaccatctttattataagccgcttgcttgtaggtataagtcgtgaatttctctccgttatctgcttgggtagctgacatttcgccattcgtcgtgatttttgtataataagcttcgccgccgtaaaaataatgataagctgcaaaacttccgccgagaaatatgcctaaaacgacaagtacgccaattaattttttcatgtacttcacctctttccttattattaacgaaatagaagatttcgtctattgaaagttgttggcaacagctgaattttaaacttttcctcattttgttcttattgcttcaaaagaaagttaaggactatcttgaagtttttctcaaaaaacacatttttttatttataaaaggtacttttttcgcgtataagacagacgagtgctcttagttgactttgacccaatattgacgtataataagcttagttcgaatcttacaaaaagtaagtcggacgtattctttttgatttagtcaaaaaaagactataataaaaaggtgagagctgaaatttttcagtgatctatattatttaggaggtttgtaaattatggcaaaagaacattatgacagaagtaaaccacacgttaacattggtacgattggacacgttgaccatgggaaaactactttaactgctgcgatcactacagtattaggcaaaaaaggcctagcaaatcctcaagactatgctagtattgatgcagctccagaagaacgtgaacgtgggattacgatcaataccgcacacgtagaatatgaaacagaaaaacgccactacgcgcatattgatgcaccaggacacgcggactatgtgaaaaacatgattacaggggcagcacaaatggatggtgcaatcttagttgtttctgcaactgacggtccgatgcctcaaacacgtgaacacattttattgtcacgccaagttggtgtaaaatacctgattgttttcttgaacaaagttgatttagtcgatgatgaagaattgatcgatttggtagaaatggaagttcgcgagttattgagcgaatatggtttcccaggcgatgacactcctgtgatcaaaggttccgcattaaaagcattgcaaggcgatccagatgctgaagctgctattatggaattgatggatacagtagatgaatatatcccaacaccagaacgtgatacagataaaccattactattgccagtggaagacgtcttctcaattacaggtcgaggaactgttgcctcaggtcgtattgatcgtggtgctgttcgtgtcggtgatgaggtagagatcgtagggatcaaacctgaaacacaaaaagcagttgtaacaggtgtagaaatgttccgtaaaacgttagattacggggaagctggggataacgtaggcgtgttgttacgggggatccaacgtgacgatatcgaacgtggacaagtacttgctaaaccaggttccattactccacatacaaaattcaaagcagaagtgtacgtgttgacaaaagaagaaggtggacgtcatactccattcttcaacaactatcgtccacagttctacttccgcacaactgatgttacaggaacaatcacattgccagaagatacagaaatggtcatgcctggtgacaacgtgacgattgatgttgacttgatccatccaatcgctgttgaaaacggaacgacattctcaattcgtgaaggcggacggacagtaggttcaggtatcgttacagagatcgaagcataagaaacgcgactcgaatattttggtaatgaaaaatgtttaaaataaaagagcggtccaaacaggatttctgtttggaccgctctttgttcttcaattgtataagaagagattgtagaagcatgaactttcgttttacttcagtctcttttattcatcatgagagtgttcatctatcggtatgcagtttttaatactttcttcgtatccattttttcaaaccacttattctaccttgtgtctgctcaactggcgcattatcaataatcagcaaagcaatcataacatatgcaatccaactatctctagaatatagagtataacgtgagacccagtttgtagcgtacttgcttttatattctcttaatccatggaaagaataaaaatgagaaccaaactcgtaaaccaagtatgcaatcctttcctgtaaaaaactctttctggaagttccgacatttgaaagaggggccatccctaaattgaaccattggatatgttcttctttcatataggcaaacaaatgcaagaacaagaaatccatactgccagaaggtgcttttttagaatcatatcgcatcagatcaatcgttcctactttattgttcgtgtaagtaggcatgatcgttgcaaaagcgacaatttcttcttgggtatttttgacaactgcaataggcgctctttgtagataatcttcagagaaaaagcctaaagaaaaccctttttcctttcgtgaacccaaccaattatcagagatatttttgaaagtactcatttgctcagtagaaaatggtggttgtaagacatcaaatgtaaatccttctcgttcgatccgattcaagacagcacgagtgcccttcatttttttccctgaagttgtaaaactattcaggtctacataagcttcttcccccatcttaatgaaatcgtagccgaattcatgcaaaatcataacaatctcttcgcttgtttcgtagaaaactggtaaatagcatagtcgatctgtttcttcgataaaagcttcgattgcttctggaaaatcttctttcttaccagaaggatcacccattacaatacatttattattgaagcaagcgaattggagaagaacagttggttcaccgtctttttcataggcaaacatccgcttatcttttaagaagatcaattgactatcggagtttcctccataagttgtaaggatcttcagggccttttcttcattaaaggcttcgccaatctgtttcttttctccttgaaggaaatgaacaaatagaacgatcatgaaactaacagcgatgatggccaacaatcccgaaaaccaaatcttttcagaaggaaataagaaaaaggaaataaaatggtgacgccgatgagggaaatctggcagattgtataccccaataacgatgtaaagcaaggacagtgcaccaataatgattccatcgatcgtacgccactcccatgaatagatcaattgttcccgaaataattcgtttttagaagcaagaatgatcagaagcagaatagacaagaaaaccaccggtgtgaaactaaaatcacttaataaaacataaagtaaagctagaacaatcaagaagattgtaggcaaatatgctcgtttcacacgtgctgcgatccctctgcccataatgattaaaagaaatcccaatagtatactaggaaattggataataaaatgaaatttcaatgggttcaaactatgaagccagcgaaactctgtaaaagcttgcgggatagtggcagaaagtactagcatgattccagaaaagtataataagacaaccacgattttatgcgcaatttctgttgctaattgtttagggataccagaataacgctgatcaaaagtggaaccgatatttttgaagaaaaagacgattccaatcaaaaacggaatgatgtagtagaacaggcgatagagcaagatccacacaacgactatttctcttggcacaccaatagcggacaacccgataatcatcattacatcgaaactcccaatttctcctggaatcatagacacgattcctatcactgaagcagcaatgaataatggaattgtttgccacagatcaatccggatttccattaaataaccaacagaaaggaaactaaacaggacaccggtccattccaacaatgaaactagcaatagctgtccttgagttttaagtgaggtaccaccaaggaatcctttctttttgaaagtagtaaataaaaagacgacaggaaaatatagaccgccgccgatcaaccatatccaatattgcttcaaaaaaggagcaactggcgtgaagactacaagtaaaaaagaaagcagactgtaaatagaaagtccagccatcaaaaacaagaaaactttcgataatgcttggatcacgtttctgctctctttcttttgtccatatagttcagagcgaagccccacactaacaaacccgccgaaaccggcaatattgttgatcgtattgatcagccagcttgtctcaaacaggtaacgaggattctgcttttgttcaagcatccgattcaaaataatatcataaccaaccataggtaacacagagataagaccaatcaatagcattagtccgcttttccatacaggtatagtggcaaacgtttctcctaattgctggatagatagagttttaccgatggacatcaattcaccgacaataatgacaatgacagaaatcaaaaagattgttttgaacagtcctaggtggtttttcagccattgtatggtattttttaacaaataaatcaccttctattcctaatagttatgtttcagaaagaaattgaagaacttctcgattgaagcgttcaggatcttttctagctaattcatgtccttgttctttcacaagcacaaaggaagcttttggtatagttttagctatatacaaagaatgttttagcttgattacatctttttttcccacgatgatcaaagtgggggagttgattttttttaaatcattttctgtaagcccgatgtcatgcagcaaaagtttgataactaaaagatttttgcgaagacttgggcgaaataaagagagtaaccatacccatgcataatgaatattactgatgactctggcagaaaaacgaacgcctttaacaagcgtgtttccagaatttaaaatcaatcgatgaacttttttagggaagctgctggcaaataccagtgctagatttgctccatcactaaatccaagaaaatctgcctgatcgattttttccagcaacatgatcgtattcagatcctcggccattaactgaaaattcaacatagatgcttcgtttgtcgaacgaccatgtcctcggctatctactagatacacggtatagtagcgttcgagtacagggacctgttctgaaaaaaagcggccgctgccgtcattgccatgcagtaaaaagagagggaagccttgaccgctcttttcatagtaaatttcgctcccatctggcatttttgcatatttcttttcttttttcacataatcacctactgtgtaaagtataacgattatatcagtcattgggcaattgtttttactgaaaaacaacgatcattttcgtaagatgtcaaaaaatacaggaaaattcattttttcttaaggcgtacacagaaatcaaggaagaaatagccaagaagataaagaaatagtaagataaaaaaagatgtcaaaataactaggtgatgaaatgaagcgaaaacgattatctattatccgtattcttttttacatgatcattctgacggttattggtgcggtgttgtttttaggaggaagaacttatcgttcggtaaaacgagtggaaagctatcaaatagaaataacaacagctgcaaaaaattatcatatggaaaactacgagaatttgatcaaggcgataatattgaccgaatcaaaaggaaaagggacagatctcatgcagagctcggaaagtctgcatggagaagctgagatcattgataatccagctgacagtattgatcaaggtgtcaaatatttggcggaaatgatagtagaagcaaagaaacaaggatgcgatttatggacagctgtccaagcatataattttgggaaagattatattgcctatgtaaaaaatcatggcggagaaaacacagtagaattagcagaagcgtattctaaagatgtgctgagcccacttttaggaaatgaggaagggaaacaataccgatattggcggatccagtccttgctttacaatggcggctatctctatcataatggaggtaacatgttttatcctgatattgtcaaaatgaatgaaaaaataatagagacctatgaaaaagtctttaagtaaaatagcaggaaatgttcaatcatgaataaaattaaatgaaagaaggagtgcgcaaatagtggaaaaaaggcaaaaaatggaaaatcaagaagtggggtacacaaccaaagactggatgttacggtttgtgaagggaatgtttatcggttcaggatttatcttgccaggagtcagcggtggtgcattagcagctgtctttggcatgtatgagcggctgatttcttttttagcccaccttacaaaaaatttcaaagaaaatgttttgttttttctgcctgttggtctaggcggagtgacaggcatctttctactttcttttttagtcagttttttattaggtgcgtatgaaacaacgatattatggttttttgtcggatgtatcgctggaactgttcctgcgttatggaaagaagcagggaaaaaaggaagagatacttctgatgtgatcatcatggttgttacttttgttctggcttatttgtttttattatacggcgctcaattatttgacgggcaagtcgatcagaattttggaacatggctgattgccggcggattgattggtttgggtatgatcgtcccaggattgagcccttctaattttttggtgtatatgggattgtataaagcgatggctgacggatttaaagaagtacgacttgaagtgattgtgccgatcggaattggtgggattctttgtgttcttggattgtcaaaaatcatggattacattttctcaaaggcatatagcaagctattccatttcattttaggtgtagtttttgcttcaacgattatgatcattcctaccgattacgcgggattgggagttgctggggtactagcttgtcctgttctttttatagccggtacagcactaggttggtggatgagccgtttggaggaacaatataagtaaagatagattgataataaaaacagcacacgggtgattcaaacaaaaaggttggcatcttttttgtaaaatcattcgtgtgtttttctataaattttataaaaacaagttgtttttaatcttggaacacgctagacttaaacacgtgattatttttgaaagttggcggaaaatggagaaaaagaaaatgaatggacttacacagcaagaggtagttcagaaaatggcttctggccagcaaaatgactaccaggaagatgcatcaaaaagtacaaaacaaatattcagcgataatatattgacgttattcaattttctgaactttggtattgggatttgtctgttatttgtaggtgcgtattccaacatggcgtatttagcaattattgtcgtcaatatcgttattggaatttatcaagaaatacatgcaagaaatcttgtacggaaattatcgattgtttcccaatcagaagtactagtgatccgggacggtaaagaacaatcgatttctactaaagagctggtattaggagatttggtaaaaatcggagcaggagaacagataccagccgatttacaggttatatctggacgggcagaagcaaatgaagctcttttgacaggcgaatctgatttgattgtcaaagaaactggagctgaattgctttctggaagctttttgacaagcggttctgtcatggctgaagttatccgagtaggtgcagataattatgctgtccgcttgactagcgaggcaaagactcacaaagctattcgttctgaacttgtagattcgattcgcaaagtatccaaattcactagtttcgtgattattcctttggggatcatactatttttggaagcactgttcatccgcgatgcttctatcaaaatttctgttattgcatctgcagcagctttgttaggcatgcttccaaagggtttggtattgctaataagtattgcattaacgacaggggtaaccaaactggcaaaaaaacgaatccttgttcaagacatgtattcaattgaaacgctggcccatgtcgatacattatgcttggataaaacagggaccattactgaagggaaaatgagtatccagcgggtagaagcactacatccgctgtacgagaaagccatcccagaaattatggggacgtatctggcagaaagcagtgataacaacatcactatgcgggctatgagagattattttgagctttctaatcggtatgatgtgacaaacaaagtcgcattttcttctgatcgcaaatggggcgcgatggaatttccagaactgggagtcgtgtacgtaggagcgcctgaacgtttggtggaagaagatcggcttccggacagtctaaaaacagcccaagcgaatggctatcgcgtacttatgttggggatcgctccaaatcagcaattgaacgaagaaaaaccagcatttgttgagccggttgctctgtttgaaatcgatgatccaatccgaaaaaacgctcaagaaacactagcttatcttcatgaggaaggtgtggatctgaaagtgatttctggagacaatccttttactgtctccaatatcgctagacgtgcaggattaccgaattatgatgcgtatgtcgatctttctcaaattactgaagaaatggaagtgcgagaagctgctcatcgctatacggtttttggacgagtgagtccgcagcaaaagaaattgctggtaaatgaattgaaagaaagcggcagaacggttgcaatgacaggcgacggtgtgaatgatgttttggcgttaagagaagcagattgcagcattgctatggcagaaggtgatggagcaacacgtcagattgcgaatctggtattgttggactctgattttactacattgccagaagtcctgtttgaaggacgccgagtggtcaacaatgtgacgaaagtctcaggcatcttttttatcaaaacgatttattcatttattttatcgattatatgtgccgttacagcaattggatttccgtttatccctatccaaatcacgctgattgatttagcgattgaagggtatccttccttctttttatcttttgaacaagataaaagaaaaatcacttaccgttatttgcctacagcacttattaatgctttaccaaatgccttgcttgtagtagtgaatatcattgcggtgtatctacttggaaaaacattcgcatggggaaatgctgaaactactactttgatgtattacttgctgattgggatcagttgcatggcagttgtaaaagcttgttatcccttcaacccattgcgcatcttcctagcagtaacgacgatcgtagggatatatgtagctgcaatgctgttccatggaattttggaagtaaacttagggttgggagagagcgtaggatacttctttgtattcatgctcgtaaatattgttcttcgagtattgtactggaaggctgatattcaaaatcagttactgaaaagagtagcaaattgatgcttaatgagatagaaatgtgttatacttgaaaaagcaatgaaatatgatacaatcaaacatgtataattgtgtcctttaaaatcgcactgatttcagttagtgcgattttttaccggttattctcctgaaatatcttctgttaaacccaaaagatatcaatagagcagggggtgaaaaaatggctcaacggattcctcaagaggttatcgaaacagtacgcagtcaaacgaatatcgttgaggtgattggacaatatgtccagttgaaaaagtctggtaaaaattacttggggctgtgtccttttcatgaagaacgtacaccgtctttttctgttgcagaagacaagcagatttttcattgctttggttgtggtaaaggcggaaacgtgtttacttttcttcaagaactagaaggtctaagttttccagaagcagtggtaaaagtggcagacttcgaacagataccgttagaagatcaatggcgtcagcgtactatagctgtccaaaatcctgaatctgctacggggaaactgattgctgctcatgaaaaagcagcggaaatctatcatcacatgctattgcatacaaaagctggacagccagctttagaatatttgcaaagtcgtgggttgtctttagaattaattgaagaattcaacataggttttgcacctaatgagcgttcttttcttcagcaagtattcaagaatgaatcaatttcaaatgaattgttagaacgctctggattgtttgtcacgcatgatgatggccgtatgtctgatcgtttttatcaaagagtgatgtttccacttcgtaattctcaaggccagacgatcggtttttcaggacgctggcttgcacctgaaaaagggcaggaaaaagatcagcccaaatacttgaatagtccagaaacagaactgttcaataaaagacaagttttatttaatcttgataaagcaagaagcgatatccggaaaaacggagaaattttgttgttcgaagggtttatggatgtgattgctgcatggcaggctggtatcaaaactggattagcttctatggggacaagtctaacagctcaacagatccaacaaatggaaaagctgacgaaagaattggtcttttgctatgacggagacaacgcaggttttgaagcaaccaatcgagggattgaattgcttcggcaaaacagtcgattagcactttctgtcgtagtcgttccagaaaagcttgatcctgatgaatatctccgtaagtatggagaagcatctttccaagaattagtggctcatgggcgcgaaacagtctttacttttaaatcacgttatttaaaacaagggaaaaatttagataatgaaaaagacaagatcgaatacctcgaagaattactagttgaacttagccgagttgtttcaccaatcgaacaagatatgtatctatctcaactgtcaacagagtttcagatcggcagagagacgatacaaaaacaactgcgcgatcttcgaaggacaaatcagcaaaatcgtcaagaacctcaggaaagtcaacacactcaggttacgagacaagaaactgcacggaaaaagagacctttgacgcaagtagaaaaggcagagcagattctattatatcgtgcatttaaagaagtttctgtccgtaatattttaaaagaacgagaatttcagtttattcatgatgcatatgcagaagtttattttttattcgatgcatatgtctcacaacattatgaattcaaccttgcagagtttttagactttttgcaagatgaaaatttaaggcggttggtggtggaaatcgaatatttaccggtggcagaagaaagttcgccacgagaaatccaagacttgctagatgtgatcagcaaatctggcttagctgatgaaataacattaaaaaaacaaatgcagcaagaagccagacgaactggaaacaaacagcttgagcttgaattgacgattgaaatcatcaatttaacgaaacagttaaaacaagccaaatagctactcaaggggggccttcttttatggcaaatggaacagataaaaaaacgtatgaagcagcagtagcagctttcatcaaagaaaacaaacccaaacgacaagttgtatatgatgatttatccaatcagcttgctacaccattcactttgaatgcagatgaaatggacaaattgatccaaaagattgaagacgcaggtatcagtgtggtggatgaaaatggtgatccatcaattcacagcttgaagagtgctgagaaaaaagctgaacaagcaaaaacagaagatctttctgcgccaaccggtgtaaaaatcaatgacccggttcgtatgtatctgaaagaaattggccgtgtctcccttttaactgcggaagaagaagtagcgttagcattgaaaatcgaagaaggcgaccaagaagcgaaacagcgtctggcagaagcaaaccttcgtttagtagtaagtatcgctaaacgttatgtaggacgaggcatgcagttccttgacttgatccaagaaggaaacatgggactgatgaaggcagttgaaaaatttgactaccgcaaaggatttaagttttcaacctatgctacatggtggattcgtcaagccatcactcgagcaatcgctgaccaagcacgtacgatccgtattccagttcatatggttgaaacaattaataaattgatacgtatccaacgtcaattgctgcaagaccttggaagagaacctacgccagaagaaatcggtgcggaaatggatcttccaacagaaaaagtccgagaaatcttgaaaatcgcgcaagaacctgtttcccttgaaacgccaatcggtgaagaagatgactctcacttaggtgatttcatagaagaccaggaagcaacaagtccagcagaacacgcagcttatgagttactaaaagaacaattggaagatgtactagatacattgactgatcgggaagagaatgtccttcgcttacgttttggtttagatgatggccggacgagaacattggaagaagtagggaaagtatttggtgttactcgggaacgtattcgtcagatcgaggctaaagcattaagaaaattgcgccatccttctcgttcaaaacaattaaaagatttcttagaataagcgtggactattgaccagaagagaaatcagtaaaactgtttggtttattttaaaagaaaaaaagcttgagactacgcagtctcaagcttttttttctataggaaggaaattcattcattatttttaagtaaatcctaaaaataagctattggcgtgacgtatagaatatgatagattaaatggtagcgtaaacctagtaaaggagccgatcgctaagtgatgaaaaaatgtccaaattgcggatcgaaaaaaatggagcagaatactatctgtccagactgcggtcatcaaataactgcagaagatcagcaaataaaagaatcaattgaagaaacaaatacagatgcagctatgcaggataaatcaactgaagatgcagtctttcctgatacagaattaaacgatccaatcgaatggtcggaattgaaagatttacctctagaatctgtaatggaattattcgaaaaagcagaaccagaagacgaagaaccacctgctcacgatcaagtaactaatatagagaaaaatgaacagaagaaagcaactgttcatgagacttcggaagaatcaggaaagaatcaagaagaaacgcttgaatcaaaacaaaaaagaagagtagctgaactgaaagaaatcgtcgataatgaggaagaaaattcgatactatccgcttatatcaaagcacatcgtgaagatacaaaagaagagcacgcgaaagagctgctcaaaatgatcagtgaaaaaattgcacaggaaaacaaagtagagccagaaaaggaacaagaaactgaaaaagactctgatagagaaaacgccacaggtaaagaaacagtaaaaataaaagacgtaaaaacggatatcacagaaaaaactgaagtatttactgaaaaacaattagaaaaggaaaaaacgaataaactgccggaagcagagaaaaaagaaatactcgaaaacacagacaaaaagtcaacagagcccgatgaaataaatagtgaatccgatgctgaaaatcaatctgtaagcaaagagggtactgatcttgaagcaaaaatagaaaaagaagagaaccagcctaagctgtttgaagcagaagcgaaatcaataacaatcgtgccagatactgaaaaaacacatcaagaatcaaacttagaaaaaacagatccagataaagcgcaaaagaaaaaatcaaaaaaagtaccttatctcgttttagcagcagtacttctactcggtggaggaagctgggcttattatgaccatcatcaaaaagtagaagccgaagtagcagcagaagcaaaaagacagcaacaaatggaagaacttcatgagaaacttgctgccttttatacagatgatcaccatcaatttattcgtgcagatatgattcatcaagatttatcaaaactaaaaaatgatttatccagtcttaagaatgaaaaaggatattcagagttagaaacaacttaccaagatatccaatctaagatccgagatatccaaaaagtgaatgagtggttcatagcacctgccatcgtcgatgatcatctagcagatgacatcaagttgaaagcagataaagagatccaagcaatcgaaacggataacacagattttggaaaattgattcaacaagcacaaacagaagctaaaaatcaatatgctgaattgcaaacagctaaagaaaaaacagctatagtctttaaagacggaaaagtagtggattcagcaacacgcgaccaatacaagacggcaaaagaagcagtagaaaaagtgaaaaatacagatctatctgctcagttgaatgaacaattgaaacaagtagataagatgctcactgataaagagaaaaaagaagaagaggaaaagaaaaaagcagaagaagcgaaaaaagcagctgaagaacaagcaaaacaagccgctcaagcagcagctgcagctcaagccgctcaacaagctgcggtcgcacaagcagcacagcaagaagcggcatcctcgaccccttcctcttcaaactcagcgaatcagccaatcaaatctgccagagcaagtgatattgccgatgcatctaatccagcatggacgtgggcaccaggtgtccaaagcaaagtgattgctacatgtatccaacgtggatatatcgttgaaggaggttacagattagaaaaagccagaatcgaaaatggggaaggctattataatctatatgccacttcaacaaaatctgcattgatgaaaggcattggagaaagtgctttgccattttacatcgtaaccatcaactgtaaaactggatggttcggaggaaatgggagcaattaattttaggcaaatgaaagaggctgtgagcctgccgtttaacaccgtttattcgaaaaaggggagtatgacacaactgttgtcatactccttttttcacctttccaaaccaaggctcagctattcaagtagataacattatgttatgatagcaaagaaatgtattaagaaaacctttcactatagagggagaaaaaaatgaacgatttattagcaactatatttacaggtattattattgatgaaaatgaaaaaaactactttgtccaaaaaaacggacaaacctttggcttaagcaaatcagaaggtgaacacaaaatcggtgaagcagttgaaggattcggttaccaaaatcaaaaacatgaaaatcggatcactacacaaattcctaaaagccgtatcggtcattacgcttttggaatcgttactgctacacgaaaagatttaggtgcgtttgtcgatatcggtcttccagataaagactttgtcgtatctcttgatgaattgccgacaatgacagagctatggcctaaaaaaggggatcgcttgatgatttcccttagagttgatgcaaaagaccgtatttggggcagtttagcagatgaaaaaatattcaaatctttaagcaaatatggaacagaagaaatgaaaaacaaagatgtgataggaacagcataccgcttgaaattaacaggtacgtacgttttaacggaagatttctatcttgggtttatccatccttctgaacgatataatgaacctcgtctaggcgagcagataaaaggtcgagtgattggtgtccgaccagacggtgtactgaatctttcattgaagccaagagcatatgaagctatatcagatgatgcacaaatgattttaaccattttagaacgttctgcagatcagcaaatcaactttacagataaatcggatccagaagaaatcatgaaagcttttggtatcagcaaaggagcatttaagcgcgcattaggtaatcttttgaaacaaggattgattacacaagaaaacggtgtgacaaaactagtcaaaaaatctaattgagaatcccttgcatgtttttcttaactagcttataataattttaattaacatagtgttatatctttttttatttgtaattattataaattgttggggttgagtaaatggtcatgaatgctatttcggcgatgaaaaaaacaaaacagcagctacatgaagcggggtttaagctgacaccgcaaagagaagctactctgcttgtgcttttggaaaatgagaaagagcatttatctgcagaagaaatcttctttttagtgaaaaaaaagagtccggaaattggacttgctactgtttatcgaacccttgaaatcttgacagaattgaaaattgtcgataaagtaagttttaatgatggattagcccgttatgatttgagaaaagaaggcgccaaacatttccatcatcatttactatgcttgaactgcggcacgatcgaggaagtagaagaggatcttttacttgaagtggagcaagtagtagaagaacgttatcattttttagtaaaagatcatcggctaacgttccatggaatctgtcaggaatgctatgaaaaagaaaaaagaaaccagtccgtctgagtgtctagacggctttttctttgctcagattatggaaaaagactatcagaatgaagcggtatctgatatgatagagaggcatgagggggattattatgaaagagcaaatcaacgattatctccactacttgaatattgaacggggattgtccgccaatacacgacaaagctatgaacgtgatttggaacagtacttgcattttctacaggagcagaaaattgcttcatggcaggatgtcgatcgctttttagtcatccgttttctggagaagttgcatgaagaaaaaaaagcgacagcaactgttactcggatgatctcaagtctcagaagattccatcagtttttacggcaagagcgtatcactgatcatgatccgatgcaacatatcgatacgccgaagaaagcacagaaattaccaagtacattgactctgacagaagtagaaaagctgattgaagcacctgatacgacaaaaacgttagggataagagatcgtgcaatcttggaagtcatgtatgctactgggatgcgcgtcagtgaattgattggattgaaattgggagatcttcatctttctcttggactggtacagacagttggaaaaggagataaagagcggatcattcctttaggtgattatgcgatccaatggctggaacgctacttagacgaagcacgtccattacttgtaaaggacgcatctgaaatgcatgtatttgtcaataatcatgggaaaggtctttctcggcaaggaatctggaaaaatctgaagcagttagtacgagaggctgggatttacaaagaagtaacaccacatacgctgcggcatagctttgccacacatctgctagaaaatggagctgatttgcggacagtacaggaattgttaggtcacgcggatatctctacgactcagatttatacacatatcacgaagaaaagaatgacggatgtttataagcagcattttccaagggcttagtcataggaaggtgagaagatgttaacacattaccggaaagaaaaccgtaaaattgctatgggactattgagtttccataagaaactgacaggtaaaacttctttgttgaaggagattgatacgtacgaatctgaagacgattatgaactttttttctttacgccagaaggttcaaccaacattcaagggattattggtatttactgggcaacgaacgatcagctgatcatccatgacatttctttgaatccgtcttatcgcggtgagaatatgggctttcaaatgttagatgaattacaggaaaagtacccggatgtctccatccgtgcaactgaaatcacagagccttacattggaaaatggctagcaaagaaaaagaagaaagagtgaatgagttgacggagatcaatattaaattagatgtattcgagggtcctctcgatctgctgcttcatctgattcagcaaatggaaatcgatatatatgatataccgatcgctacgatcacggagcaatatatgaattatatccatacaatgaaaacactcgagctagctgttgcaggagaatacttagtgatggctgctacattgatggcaatcaaaagcaagacattgcttcctgtccaagaattcgtcacagacgatgaagaattatgggaagaagatcctcgagaagaattggtcactcagcttttagaataccgtaaatataaatatgcagctgaaagactgacagaaaaagcagaggaacgaagtctttattacacaaaagaacctatgaacatcgatgggttagcggatgctgaaaagccgttgaagcgaggacaagtcaaaaaaatcgatttgatccgtgccatgcagaaaatcttagaacgtaagaaattttctcaaaaagtggaaaaaacgatcacgcccgatgacacaacgatcgaagaacgaatggtatttatcgaagagcgtataaaaagaaatgcgcatggctgtactttcgattctttttttgagtcaccttctaaaagtgaagttgtcactacttttatggctttgctagaattgatgaaaaaagggcagatcattgcgcaacaaaaagaaaactatgaatcaattatgctttatccagcagtaggagataccgaacatgacgaaattaagtgaacttgaagcccttctttttattgttggcgaggaagggatcagtaatgaagaattaagcggactgttaaatctcagcgaagcagaagtcacaagtttagtgaaagaattaaaagaatcttacactcaaaactcgcactcagctttgcatatttttgaaacggaaagccattatgtattaacgactaaaaaagagctggctcccttacttaagcgatatgcgcaagggacatcaaacacattatctcaagccgccgtcgaaaccttagcaatcatcgcttataaacagccaatcacaagagctgaaatcgagcagattcgaggagttcaggtttcaggagcggtacagcgtctagctgcccataaactgattgaagaaaaaggtagagtagaaggaccaggtcggccgatattatatggaacaactggctacttcttagattattttggtttgaaatcattagaagaactgcctgatacacaagaaatggaaatttcacttgaagaagacgtgtcaccagatctattctttgatggaatgaataaaggagaataattgtaatggagagattgcagaaagtaattgcccacgctggcatcacttctcgtcgaaaagcagaagaattcatccttgcaggacgtgtaaaagtaaacggacaagttgtaagggaattagggataaaagttgggaaacatgacactgtggaagtggatgaagtcccaatttatcaagaagaatacggttactatttattgtacaaacctaaaggagttatttctgctgttgcagatgacaaaggaagaaaagttgttacggatcttttgccgatggtaaaagaacgtatctatcctgtaggtcgactggattacgatacttcggggatcttgctactgacaaatgatggagattttgctcagcgcctgacacatccaaaacatgaagtggataaagtttacgttgcaaaggtaaaagggatcgctacaaaatcgatgcttgcacctttgacaaaaggaataaagatcgaaggacgaaaaacatctccagctaaattccaaattttatcagtggatcctaagacaaaccacagtatcgtggaattgacgatccacgaaggacgtaatcatcaagtgaaaaatatgcttcaagcagttggtcttcctgtgcaaaaactaaaacgtgaaaaatacggagatctgactttacaaggcctacgtcctggggattaccgtgaactgaacaaaaaagaagtcagcagtttgctgaaccactcaaaatgaacacttactttttataagtgttagatgttgcgttttttgaatagatatgtataatgaatatgtaaacaaaaattatataaggttcgtcttcaggggcagggtgaaattcccgaccggtggttatagtccacgacctattttgcaaaaaaatagctgaatcggtgaaattccgataccgacagtatagtctggataaagaagatagagcttatttgacgacgcttgatcaaataactctaactctattttccctggaaaatagagttttttcatttggagagaaacgtcaaaaagttcgctgaagaggagtcctaacaggaggatttcaaatgaagaacacccgtgtacagaaaatggttgcagtagcgatgtttgctgcgatcgcattagttttacagtattttgcttttccgatcatgccggcttttagttttttgaagatcgattttagtgatatctcggtattgatcagcatgttcttattcggtccagcggccggagttgcaacagcgttcttgcgttcagtattacatctgctgactacaggtttttctccggataatttggtaggagacactgctagtttcttatcaacaacgatctttacattcccgatttattatttctttagtgtaaagaaacagcataaaggaagaaacaaatttttaggtgtcattacaggaaccatcgctctaactatttttatgagtatcgcaaattatttcgttattacgcctctttacttaatgtttttagggctgaacgcaacacagatgctgggcatgtctttagcaaactatgtactgattgggatcgttcctttcaacttgatcaaaggattcatcgtgagtgctgtctttttagtgctgcatgcgcaacttcttccatggttaagtcgaaaacaacatcagttcgaacaacgtcatacagcagtcaaataaatatcaaaaagatcaagaaatttcttggtctttttttttggaaaaaaatacaagacatgcaataatgtaaacgttttatttgtttgttttgagtatttttttgatttatgcataaaaatcaatcaattctttgcaaatgtgaaattcttctccttttaaaagacgaaaatgtttgtttataaaaaaaggaaacgctacaatgaaaaagaagaaagctttaaaaacctgaaaaaagaggagggaatagggaaaaacgaactttttgaacaaaagttttacaaaatgcgtgttattatttttgttctgatactctttttgataaaataacattagagccaaaattgttgtctctaacggaaaagaaaggaagaagaagatggaacaaacaaaaaagaaaaaatttcaaatgccttcagcgtatacggtcttatttattattattgcagtaatcgctgtacttacttggtttataccagctgggcactatagtgtagacgatgcaggcaacatcgtcgctggatcatatgaacgagtacaacaaaatcctcaagggctgtgggatattttcatggcgccaatcaatgggatgctaggtgtaccagcgggggagctaactaaagaaacacctgctgcaatcccaatctctttcttcattttggttgttggtggatttttaggtattatcaacaaaacaggggcactagatgccgggattgcttcagttgtgaagaaattcaaaggaaaagaaaaaatgcttattccagtattgatgctgttatttgcattaggcggctctacttacggaatggcagaagaaacgattccattctatgctttactgatcccagtcatgatggctgtaggctttgatacagtagtagctgtagcaatcgtattagtagggtctcaagtaggctgtctagcttcaacggtaaatccttttgcaacaggcgtagcttcacaagctgttgggatttcgatgggtgaaggtattggtcttcgattcttgatgttcgttattttgttagctatttctattgtatatgtgtatcgttatgcatcaaagatcgaaaaagatccaacaaaatcattagtatacaaccaacgtaaagaagatatgaagcatttcgatattgaagcaatcggtcgtcaagaagtaatcacgaaaaaacaaaaacatgttaatgtattgttctttattacttttggtatcatgatcatcagtttgattccttggacaaccttgaatgcgaatttcacgatttttgaatcattgacaaactggttaacaaaccttccggtactaggtacggttctaggtaaaagcatgcttccattaggtgactggtacttcccagaaattactatgttattcttagtaatgtccatcgtagtagcaatcacttatggcatgaaagagtctgaatttgtctctgaatttttagctggtgcttctgatttgatcggtgtagcaatcgtagtagctgttgctcgtggtatccaagtggttatgaacaatggattaatcacagacaccatcttacattggggcgaacaaggattaagttcattatcttcaagtgtattcatcattattacatttattttctatatccctatgtcattcttgattccttcaacttccggcttagctgctgcaacaatgggaatcatgggacctatgggtgaatttgccggcgtcggtaaggatttagtaatcactgcttatcaatctgcatctggtttagtaaacttaattacaccaacatctgctatcgtaatgggtgctgtagcaattgctcgtttcgatgtttcagtgtggtggaaatttaccggtaaattaattgcgatattatttgtagccatctgtgtgatcctaggtgtagcagcaatgttctaaacctagacaaatacaggtacaaggtctatcataagaatgaagaaaccgataaacggctatcgataagcacgtggataagtcaatagctccattcagtgagtgttttttctttcatcatttgttaagaacattctgcttgctgatggagcaggcttaaaacgtcattatttgagaagaagaggttgtgtcggaggaatttgacatgaccctttttaacatattaggaggataatatcatgaaaaaatttgtgacagaacaacatcatgaacaagcattagaatcattgagcgaattgatccgaattccttccgtactagatgaagcagattcaggacaaggacatcccttcggtaaaaaagtgattgaagctttggataaagtattggaaatcagtgaaaagctaggatttagaacatttaaagatccagaaggctattacggttattcagagattggctctggagatgaattattcggtatcttgtgtcatatggacgttgttccagcaggggacgaaaataattgggaaacaaaaccattcgatccaactataaaagacggctggttagttggtcgcggatcccaagatgacaaaggtccttctattgcggcaatgtatgccgtcaaagctttgattgatgctggcgtggaattcaagacacgtattcgttttatctttggtacagatgaagaaaatttatggcgttgtttagaaaaatataacgaaaaagaagaaggaattacgcaaggatttgcgccagatgctgaatttcctttaatttatgcagaaaaaggcttattgcaagcttacttgacaggaccaggaacgaacgagttttctgtaaaagctggaggagcgttgaatgttgttcctgatgcagctccttactctggagaaaagctttctgaagtaaaagaagcattgaaaaaacacgaattcgatttcgaagaacaaggtgaaggcatcgtcgttcttggtaaaagtatccacgcgaaagatgcagcacaaggagtgaatgctatttctcgtctggcaattgctctttcagaagtatttgattttggcccaatcaatttcttaggaaaattagttcaagaaaatgcaactggtgaagctgtcgtgggcaaaacagaagatgaacaatccggcgagctaacgatgaactttgcaagtttggaaatcacaccagaacaaacaaaaatcggtgtagatatgagaatccctgttacattcaagaaagatgatttagtagctaaattaactaaaacagcagaaaaatatgggttgacttatgaagaatttgacttccttgattcattatacgtgccactagacagtgagttagtgaaaaatctattggggacatatcgcgatattactggagacatgactgaaccgtttgtatcaggcggcgctacttttgctcgtacgatgaaccagtgtgtggcattcggtgcgatgttccctgatactcctgactttatgcaccaggcgaatgaacgatgggaattaagtagtatgtataaagcaatggaaatttatgcagaagctgtgtatcgtttatgtgctaaataaaaataaacatacaaaaagggcggatattcaaatggatattccgtctttttttatttgatgctggaaagtttgcatttctctcttatttttttaaggtataatcatacttgattaagaaaaaggggtcactcagatagaaaaggtgggagaaagtgaaaatatttagacgaatactaattggcttagtcatcattttaggattactcggtggagccggttattactatatacagcaaaatacgtacgaaccatcgtcagaagcgcaagtgttggtaaaagaaggaaaaaacaaagaagattacttattttttgaaggagagaaaaagaatcatggaaagtctccattacttattttttatcctggtgctctcgtagagccagaaagttatagtatttgggcgcaagatttagcaaaaaacggcttttcagtcgctattgtcaaaatgccacttgatctagcagtgatgggcggaaacaaagcggataaggtcaaagaagattttccaaattccgattatgtgatcggtggccattcattaggtggcgtaatggcaagtcgttatgtcaataagaatcattcagacaaacatttaaaaggggtattcttcatggcaagttatcccgacaaaaaaggaacattgacagaatcagctgttcctgttttatcgatcacggcgacaaaagataaagtattgaatcaggaagcttatcaagaagctaagcagtatttaccggaaagaacagagtatgtatcaatcaatggcggaaatcatggaggttttggcagctatggtgagcaaaaaggagatggagaggcagaaatttctaacgcagaccagcaaactgtgatcgtcaatacattggaaaactggctgaaaaagttgaaataatataaatgggtcctatagggtccgtgaaaaaactagtcaattaactatagatagcaaatgaatctttcaaaataagtcgggatttcacggaacaagagaaacagatcccggcttattttcaagtttagagaacttagtgtacgtttttaaagtttcgtttatatttatattttattttctaataaaatcgctcgaactggacatttttgatacgctttttttacatatgtttcttcttccggcatcacgaactgttgatgagcctctggttcttgggcaaataaaacgattccttcttcatcataatcgaaaatatctggcgcttcgatttgacaaagaccgcatgcaatacagcgttcaggtacaagtttacatagtagtgacatttctaaccatcctaacttaaggagaataatatgattgtttttattttatcgctattttcatcaggacacaagctgcggattagttctctttaccaactccttgtgggaaaacgaacgacttcagtacttatttatggatttacccacgaacttttgtttatccataacagttttccagaattgaagcaggataagttttatcaaattttgcaaaaaattgcgcagcaaggttggatcgaaataaatgaaaatgaagcaaagctaacgcctgcaggggctgatatgttgtccgaacatcaaatagaacatactggtttgcgttttgaccgctatggcagaacaggggaaactagttggcggctcattaaatttgctgttcaagtaatttctaatctggcaacgggtattcaagactatcttccagcagagacaagtcctttttatactttccaactaaaaaaatggcttagtgaaagccaattgccacgtgaaattttgattgatactgcgtatgagagtttggtgcagctgttttcggagataccagaagaagcagcagattttttagctaaccaattatctggaaatgagcgaacagggctgcttccttatcagctggcaaaaaacaatgatgagtcagcggtttatctgcaacaaagcagatgtatccaccttttgttagcacaaatcgaaaaacggccagattcgctttggcacgctttgatcgattcattattacagcaaaatttcaatcaaagcatgatgatcaccaagcagatgtttatgaatggtcagacaattgaccagatcatggcaatccgtcatttaaaaagaggaacagtaacagatcatcttattgagtgggccttgttttttgatgattttccatacgagtggattctctctgcagaaacaatcgaacgtttggaaccaaataaggattccgtgcgagagtggcgctttagcgaatggaatgtagatggacaattagattatggagaatttcgtttgtatcaaatctatctattgagaaaggaagcgatacagaatgttaataaatgaattaaaaaaatattttggatttgattcatttcgtcccggccaagaagaaattattcaggcgttgcttgatggagaagatactctcgctattttgcctacaggaacgggaaaaagcctttgctatcaattgacggggtatttaatggaaggtctggtcatcatcgtgtcaccgctgctttctctaatggaagatcaagtgacgcaattacaaaaacgaggggagaaacgagtagctgctttcaatagtttactttcgcaatctgaaagaagatacgtcctccgtcatctatcgcaatataaatttttgtttttgagtcccgaaatgttgactaatccttctcttttagagcatctgaaaaaacaaaatattgcgttatatgtagtagatgaggctcattgcgtgtctcaatggggagttgatttccgtccagaatatcaacagttaggaaaaatccgaaagcttttaggaaacccggtcacactggcactaacggcgacagcaacagatttagtagcaagagatatacgtcatgtactatttgatcgaccaccaaaagagatcagacaatcagtcaatcggcaaaatatctcgctttttgttcggaaaacgcagcaaaaagaacaagaacttgaacacttcatggaaagagcacaaggagcggcaatcatttattgtgcaacaaaaaaagaagtcgaacgattgtatcatttattcagggaacgttttacagttggatactatcacggtggtcttgatgcagctcaaagaagacaacttcaacagcagtttgtaaaaaatcagctgcagtttctcattgctacgaatgcatttggtatggggatcgataaatctgatatccgttatgtggtccattatgatttgccagacagtctagaaaactatgtacaagaaatcggtcgagcaggcagagatcaggaagaaagtgcagcaattcttttttatcaaagtggggatgaacgtatccattatttctttaatcaactttctagagaacagcgacaaagttttgagctttatttggaatatgccacagagcaagctccctttgatgagctgcaaaaaaaatggatggagctgatccagcagtctgaaaaaccagaaaattgggtggaacggctcaaacgtcaggaaaaagaaaaagaattccgcctgcagcagatgcttcgctatattaatgaagaaaactgccgcagaaaattcatcttagcttattttggcgaaaaactctccgaaaagccgcagaattgttgtgatattgatggagcaaaagcagaacttctgccaaagaggaagcttttttctaagactgaacaacttcattgggaaacgattttactaaatttatttaaaaaaaacatggaacattgattttttaggacaagacactttttcctatggtataatacacacgatagagtttaggaggtaaaacagtgagcagaaaagatagacatcaatctacagaaaataacgaaacacaagaaccatgggaacaaccaatctacgatacagatgatgaagtttcatcaagaagttctcagagacaacaaaagaaaggaaatacattatttctttcgctatttttgattttactggtcttatgtatcgctattccagcaggtgcttatttctggatcagaaatggatcaagcaacaatgcaacagcagcaacttcttctgaaacttcgacatcagtagtagaaagttctacaagtacaacaaaagaggagtcaactgagacttcaacagtagaatctagtacaatcgcggaagaatctactgtgtctcaagatacaggtgtaacgtcagaaagcagtattgcagcagagacaacaccgacttcctcaagtgaggcaacttatcaagcaggggattcaagcagcaatgcagcagaaacaacaccttcttcatcagctgcagccggttcaacaacgactgttcaagcaggcgaaggtccaaaacaagtggctgagcgtgcagggatcaccactgatcaattgtttgaattgaatggcttagatccaaacaactttatgctttaccctggtcaagaattaagaattaaataataatagccgcgctttgcggctttttttctgagaaaaaggagttatatcatgacacaaatcagtattgcaatcgacgggcctgcttcatctgggaaaagtaccgttgccaagatattagcaaaagaattgaattatatttatacagataccggtgccatgtatcgcgcagtaacttatttagctattacgaacaatgtatctttttcagatgaagaagggctagtttcgctgatcaaaaagtatcctatctctttttcgcaacaagaagatggacagcatgtattcatagcatcaaaagatgtgactttagaaatccgtcaaccagatgtcacaaaagctgtttctgaagtctctgcacatggaaaagtcagagaagaattagttgctgtccaacgaaaaataggggaacgcggtggcgttgtcatggacggaagagacatcgggacagctgtattaccgaatgcagaagtgaaaatctttttagtagcaagcgtaagtgagcgtgcagaaagacgtttcaaagagaaccaagaaaaaggaattccgactgatcttgaaacactgacgaaagagatacaggaaagagaccattatgattcaacaagggacgtctctccgctgaagcaagcagaggatgctgttcgtatcgatacgactggcaaatcgattccagaagtcgttgcagcaataaaagctgttgttttgaaaaaaggttatcttcttttttaaattaagaaaaaaaatgaaaaacaattgttttttcaaggaaaacgaacgaaatcgctttattttttttgaataatcaattaaactaaaaacagtaccgtacttacggcagaatgttggttaggaggacaagtgttatgacagaatttgatcaaaatcaagagaacaaccagtcaatggaagacgcaatgaaaagcgtacaagaagtaaaagttggcgatgttgttaagggcgaagttttagtcattgaagacaaacaagtgattgtcggaatcgaaggggctggagttgaaggagtcgttccggcaaaagaattatcaactttgccggtagaagatatcagcgaagtagtaaaagtcggtgatgtattagatttagtcgttatcagtacgatcggcaaagataaagaaaacggcagctatctactttcaaaacgccgtttagatgctaaaaaagtttgggaagatatcgaaagagatttccaagagggcaaggtcatcgaagcacctgttacaaatgttgtcaaaggcggtttagtcgttgacgtcggtgtacgtggttttgtccctgcatcaatggtggaagatcattttgttgcagacttttcagactataaaggcaaaacattgagctttaaaatcatcgaaatcgaaccatcagaaaatcgtttgatcttatcgcataaagcggtagtggaaaacgaaagagaagaaaagaaaaaagaaattctttcaactatccatgagggagatgttctcagtggacgtgttgcacgtcttactgattttggcgcatttgtcgacctaggcggaattgacggtctagtccatgtctcagagatttcacatagtcatgtagcaaaaccaagtgatgtattggctgtcaatgatgatgtaaatgtcaaagtgttgtctatcaatcctgaacaagaacgtgtttccttgtcaatcaaagacacacagcctggaccttggtcagaaatcgatacaaaagctccagttggcacagtattagacggaacagttaaacgtttgacaagcttcggtgcctttgttgaagtgttccctggagtagaagggctagtccatatctctcaaatttcacataaacatattgcgacaccacatgaagtgcttcatgaaggtgacgaagtgaaagtgaaagtattagagatccatccagaagaacatcgtattgcattgagtatcaaagctttagaagaaaaaccagcttcagaagaagaaccaaaaaatgttgagtcttatgaattaccagaagaaaatactggatttactatgggagacattttaggtgatgcgttgaaagaagaagtagaagaaaaagcaaccgatgattctgaaaaataattgattttgtatctgtgactgagatgaaagcagctgcttttgtctcagtttttcttttgaaaagcgattagtatttcaataaggaataaaaatacttcgtttaattgacaatctatgcttgaaagttggcaatgcattcgttaaactaagtgagattggaaacttgtgaggaggaaataatatggcaaatccaacaattgcaatcgttggccgcccgaacgtcggtaagtctacgatttttaaccgcatcgctggtgagcgtatctcgattgtcgaagatactcctggagtaactcgtgatcgtatttatgcaaaaggtgaatggttaggtcgagaattcagcgtgatcgacacaggcggaattgatcttggcgatgaaccttttatggatcagatcaagcatcaagcagaaatcgcgattgaagaagcagatgtaatcatttgtgtagtcagcggacgcgaaggcgtgacagacgcagatgagatggttgcgaaaattttatacagaagtaataaaccagtgattttagcagtcaataaagtagataatccagaaatgagaaacgatatctatgaattttattccttagggctaggcgatccttatcctgtttcaggaagccatggactagggattggtgatattttagatgaagcagtgaagtatttctctgaagagactgaagaagaggacgacgacacgattaagtttagtttgattggtcgcccaaatgttggtaaatcctctttgatcaatgcgattttaggagaagaacgtgtaattgtttcggatattgaaggaacgacccgagacgcaatcgacacccacttcgtttctgaaagtggtcagaaattcttaatgatagatacagctggtatgcgtaaacgcggaaaagtatacgaaaatactgaaaaatacagcgtgatgcgtgcaatgcgtgccattgaccgttctgatatcgttttgatggtactgaatgctgaagaagggattcgggaacaagacaagcgagtagcgggttacgcccatgaagctggtcgtggaattattatcgtcgtgaataaatgggatcttgtaaagaaagaaaccaatacaatgcgtgatttcgaacaagagattcgtgatgaattccggtatcttgattacgctccaatcgtttttgtttctgcagtgactaaacaacggttggaacgtctgcctgaaatgatcgaacaagtaagtatgaaccagaatcttcgtatctcttcggctgtgttgaatgatatcattatggatgctgtagcaatcaatccaacaccaacagataaaggaaaacgcctgaagattttttatgctacacaagtcgctgtcaaaccacctacatttgtcgtttttgtcaatgaagaggaattgatgcatttttcttatgaacgtttcttagaaaatcaaatcagaaaagcatttacttttgaagggacgtccatccgaattatccctcgtaggagaaaataggcattttaccatatcgacgtttttttttcaaaagaaaaagacagtttcgtttgttacgtttctatgactaaaaaaagcatgtgaaaattggtaaaaaccttgctattaagcggttcatatgatatcgtgataacagaatattgaagttaatcaatatttctttttaaacttctggaccactcagaaagttttaactaaatgatatttctatcatatctcttgtggaggaggtgaatctatccatggcaaacaaagcagaattaatcgaaaaagttgcttcagctactgatttaactaaaaaagatgcaactgcagcagtagatgctgtattttcaactattcaagatgctttagctaacggcgaaaaagttcaattaatcggttttggtaactttgaagttcgcgaacgcgcagctcgcaaaggtcgtaacccacaaactggtgaagaaatcgaaattccagctagcaaagtacctgcattcaaaccaggtaaagcattaaaagacgctgttaaataagacagttgaaaaagcgcttgtggctctagggctacaagtgcttttctttttatttcctagcagaaaaggaataaataagagacagagattccgaatccgtatgtcatacatagaaaacacatgtattttatttaatttttatttatttccaagttatgaggtgagctttgctcttatcttttctagaatttgcttactaatggtaaaataaaaataagaagaggagggatgcgtatggaacttgattatcaagtagaagatgcgttgacgaaagtgttttacggagaaacgctagtcagtcagctaagagaactttccattgatcagccaatcttatttttaacgaatcagcgctattatgatttgtttgcagataagatcaacccgttatttgcaaatcaagcaaacaatgactggtatatttgtgccaacactcaatgcaatcatttaacagaattaaagaacctgcttgatttcgtcaaacgctatcccgaaaatcaatccatgtttatcatcggatttggaaatgaagggatcatggatctggcaggtttttttcaaaaacatacaacccttgattcatcactatggatgatccctgtatcgatccgttctctaagccgagcattaacaccgcagcggacgattttgcagctaccaaatcgtgtagtgctgcaaaccatcaatctgccagaacgcatcgtttatgatcaaacaatcagcgagcggcaggtggacggaaagcagattgactttttgacttttatctgttgcggaatgatttgtgatcatcgttttttgcaaaatctgtataaaaactatccaaataaaaagcaattaacgactcggccgtttgccgggatgatcgaagaaatgatctatttttatcaattagaggcagaaaacctgtcaaattatggtaaactgtttgaacaagctttttatctgaccgaaaatggccatctactttctgctagtatgaaaaaatttttaggaatgatgtttcatttcgtgtggaatctccaagcatatccttttgatttccaactaaaaaacttttttgtgtggctggacttgcttggctatccaatccactggctggaacagatttcaaagatggagtatttggaaaaagttctttttttggcagaaaaaagcaaaaaaatacttgttttagaaaaaataggtataatagacggataccaacatccaaacgaaaaagaattattgagaacaatgacggtatttcaacaaatcgtcagtgagataagagggaattgaaatgaatacaaatagcgaaaaaatgttgcaagctttatcagatgaagacttgtcacaagcacaaatctttttagaaaaagcattaaaagaagacccagcagatatattagctgaactaggcgaagaattgctggctattggctttttgatcgaagcaaaacagatttttgaacaactgatcaaccaatacccagaaaatgacggactgaacatcccgttagcagaaattgcaatcgaagataatgagatcgacttagcttttgaatacctggaaaaagtggataagcaaagtgattactatccgcaaagcttattggcgatagctgatttgtaccaagttatcggaatccctgaagtgagtgaagcaaaattgaaagaagcagctgggttgcttcctgatgaaccattgatccagtttgcgctagctgaattgtatttttcagttgatcgtttcaaagaggcagcagtggtttatgaaacattgttggcaagcgggataaatgaaatttcaggaatctcgatgcaggaacgtttaggacaatccttaagtatgcaaggagaattcgaagcagctatcgtacctttagaagaagcactgaaagaagaaaggacagatgatcgactgttccagctagcttttacgaatcttcaattgaaagaaaatcagcaggcaatcaactatctggaagaacttcgagaagttaatccgcattatcaatcgttatatctatatctaggacaagctcttcaagaagaagaaatgattgaagaagcacaaacagtgttagaagaaggaatcaaagaaaatccttaccaagtcgaactttatcacctggcctcggaaaatgctttccgtctgcatgatagacagcgagcagaagaacttttactgaaagctttagaagtaggagacaaacaagatgaaacattacttactttaagtaatctttacttggatgatgaaagatatgaagatgtgatacaagtgatcaatcagatggaagaaactgctaatccttatgcagaatggaacctagcccatgcttataatgaattagaagactttaccgttgcagctgtacactatgaacaggcttatcatgaactatcacatgaaccagatttcttgaaagagtatgcctttttcttaagagaagaagggcagctgaaaagagcgcaagaattattgacttattatttaacacttgaaccaggagatatggaggcactgtcattattagatgacctaacagagaggtgagaaaaatgctaattgatgtacgggaaaagaagaattttttaacgtggatggtcaatcatgtatcttttagccgaagagaagttttttggatcttgaattatcttgccaatcatgaagcgattttaagcaatgtccactttgttgaaggggcgaattttgcggatcgaggactgcagatcagtgatctatctgttgaaggggaacccatgaaattgtttttgcagggaaaagaatttacggacacagaccagatttttcatgaaatccgtttgaattggaaaaagcctttatatgtggaatgtatattcgaaaatgcttggcagacaagagaatatctatctatcttagaagacaatccattttcttcttgggattcttcagtcagtgaagaagatactgaattaattgaacgatattttcaagaaaaagaagaagaggcaaaactaaaaatgctttatgctcaaatcgatcaagcactagaagatggagatagggatgcttttttgaaattatctgatgaagttaaccgaaagatccttttgcagacacaaaagaaaagtaaccgggtaagtgaacataacaattagttaaaaatagtatagtactaaaaaagacaaaggtcagctggatgtggaatctttcctcatagcctatctttgtcttttttcttatagttttttcagtaatcttgtctgtggcttcaaataagtaaagccttgcccttccacttcatgcacattgatgattgaaaggaaagctttttcgtcaatctcgtggacgatcctcttagcttcagttaattcactagagctaacgaccatatagatgattttttttgaattaccagagaatgcgccttctccagaaaggaaagtcacacctctttgcagaccggtcatcagtagtggtgcaatctcttcgcttttgttggagacgacaagtagaccttttgcagaatatccgccatctaagatcgaatcaatcacacgactgaaaacatacgaaacaatcaacgtatacatcatacgtttcaagtcgatataggttaatgaagcaagtaagacgatgatatcaaatgccaatagggaacgccccatagtgatgccgtaattttgttctaaaatccgagcgataatatcactgccgcctgttgttccacccatgcggtagacgatcccgcttcctacacctgcaactaaacccgcaagtagagaaacgatcagtagatcatgctgtaaattgatttctagtggaaccctttgccagatccataaaaagaatgacaaagaaagtgtacctagaacagtataggccaaggaacgtttaccgaggatctttcctcctagtaaaatcaatgggatgttgattaataaagtcgtataagctggatcaataccaaataaagctcttaagatcaaggtgatccctgagactcccccttctgctaaatgattagcgatgttcaagtaaacaagaccaaatgcataaatacttgttcctataatgataaaaagaacttcttttactgtttttcgtttgaccatatgaattccagctttcaatttatgtatttttcacagaatttccattttagaaattccttcctaaatgtagcatggaaattcgattttctcaattgctcttatctaggatttgcgttaaagttttggtaagatagttttggagggaaaaagatggataaaaagcgttctttatacagtatgcagcaggaagtggatgaatatatccagcaattcaaggtggggtatttctctccattagctcagatggctcgattaactgaagaagtaggtgaattggcaagagaagtcaaccacacttatggagaaaaaagcaaaaaggcttctgaaccagttaactcggtagcagaagaacttggtgatgttttattcgttacgatgatcatggctaattcattgaatatcgacttaactgaagtttttgaaaaaaacatggaaaaattcaatcaaagagaccataatcgctttgagcgtaaggacgagtaaacaagatgaagtggtcctggccttgaagactctgaaacggacttgtcaaacagtcaccatgcaactgagtctttatctcaggacaagaaacacgcaggaaaggttggaaaaatgaaattaaaacaattacctctggaataccaaaaggcaattccagttctgaaaaaattagagaatgcaggatatgaagcttattttgtaggtggaagtgttcgtgatatcttgctgaaccagccaatccatgatgtggatatcgcaacaagcgcatttccagaagaaatcaaacagctttttccaaaaacgatagatattgggatcgaacatggaactgtgttggtattagaaaatgatgaacaatatgagatcaccacatttcggacggaatcaacttatcaggactaccgtagaccagatcatgtcgaattcgttcgttcgttgtcagaagatttgaaaagaagagattttacgatcaatgcgtttgctttgaaagaagatggagaaatcatcgatttgttcgatggtctgcaagatctagaagaacagatcttgcgagctgtaggcaatcctcatgagcggttccatgaagatgccttacgaatgatgcgcgggttgcgttttgtcagtcaactagggttcaaattagaggaagaaaccttctacgccatcaaagaaaaccacgagctattaggtaaaatatctgtagaacgtataaatgtggaattcatcaagatgctcttgggaaatgaacgggccgcgggaatccatgcatttattgaaacagagtgctacatttgctgtcccggtttgaaagaagaaggcgaagcacttttacgtttgctgaattaccatccgtcccattgaaagaagagagccaagcatgggcattattgatcagccaactggatctaaaagaaaatgagattcgttcctttttgaaatcgtggaagtgttctaaccaaatgattaaagacgttcaagcacttgtccaaggactacgacaacgagaaactggagctttggaaccattcgaattgtacttcttaggcaaaaaacatgcactgcaagtagaagaattgatgatctattttgacgaaacacctcagatggatgccgtaggagaatcctatgatcgtttacctatcaagtcattaagcgaattagcagtagatggtaaaatcttgctagaagaaactggaaaaaaacctggtaagtgggttagtgaagctttgcaattagctgaaaaagccgtcgtagaacaaagaataaaaaatgataaaaaacaggttttggattttttatcgaaagaaaaattgatttaaaaaacactagactgtatctgctcagctttgttggctacttaaagtgggcagatacgtcattagaagaaaaaacataagatgtgaccacttacataaatttgtgctaaactgaggtagtacaagaataaattacatcataaaggagtctttttaatgagtaaagaaatgacagcgctaaaattttattttagaaatggagaaacctggacgatcaaccgccgtcatatcggcgatctttggatcaaacaaatcacaacaagttttggacgaatcaatggcagtgaatttgttgaaatccatccgtgtgctggatttaaaatcgaaatcttccatgaaggggacgcagttgcgacacatgatatcaacctaggcggactggaaatgggcatgtttaatcgcgcattgaaatacgaagatatcgagcgaatggaaatcctttaccgaaatggcacacctgatcttgtgtacttcccatatctagataaaggaacagaaggattagacaatcaatatcaatcaacaaaaatcagcgaaaaaacaggtaacttgtatatcgtgatcaatccagatcaacgtgtagaagatgtatacggggaatttttcgaataaatcgatttttacgcaaaaatgaggctgtgaaagagatgtgtcttattactactgataggctgtctcttccacaccgtttattcagaataagggactgtgacaagatttttgtcgcagccccatttttttgttgtgataaaagaacaagaaaggcaggaatgggaaagtaaacatccttttgtcagaaacttttatctttcttaagttttacttgatatctgatactatttggaatagaatgaggcgttgaaaaatttatggaaatttctaactagcaataaacgatgaaacaatgaaatatttttcatccaaaaagaactttgctataatgatggaagtttgtgtataggagatctggaaaatgagagagagttttgaacaacaaaaaaaactgttgcatgatcgctatggcgccctttcgatggatgaccgccgtcaaatactttgtaagttgcgtaaaagaaatatattgatgtatcgtcagttggaacgtctgaaacatgatctgcttcgtttggagtcaaaacgtgtacagtgtgaattagaggggaaccaaacacaggttgaagtagtcgaaaccaaaattttaaagaaaaaagaacaatttttaaaaatgcttacacaaaataaaaaataaaggggatggacgatggaatttgctgagttagttattgtatttgcagtaacgatcaccttatcgaacatagctagccgcattttgccaatgattccagctccactgatccaaattttccttggagtggtattaggtctgacagagtggggacaatcaatcgattttgaacctgaattgttcttagttatgattattgcaccattgttatttagagaaggagaaaaagcagatatttcttcgattctcaaaaatttcgggacaattttgttcttggcatttggaggagtcattttgacccttgtcggggtaggtgcgacgttatcattcctgttgccaagtgtcccacttgctgcctgctttgcttttggagcagcgttaggtccgacagatgcggtagcagtcagttctctttctggacgagtgaatatccctaaaaaggcgatgcatattttggaaggagaaggtcttttgaatgatgcatctggtgttactgccttccagtttgctcttggtgcgctgatcaccggatctttttcagcagtaaacgcggggatgagtctagtagtttctagtattgggggagctttgatcggctttttgcttgtctggttcaaacaaaaaataattcatttgatcgaaaaagcatcagcacaagatgtcacagggtatctgctgatcgaacttttgcttccttttctagcctatgtattggcagaggcatttgatgtatctggaatcattgctgcagtggcagcaggtattctccaagcttctggttttaggaaaatctctgtgtttgatgcagaattgtcgagcttgtcccacagtacatggacaactattgcttttacactgaatgcattagtatttatatttttaggaatcgaattgacgcaagtgttctcgccagtatggggagacggtttatatccaaacggtcttttattagcgattatcgtattaatctctgtcatgctttttgtgatcagattcatttctatcagtcttttttatgtattcaaagatggcagtaaaaagttcaaaaaacagttgaacgagatcttgatcttaacatttggcggtgtaaagggaacagtcagtttggctacgatttttattttgccattttcaatcaataatatgatgttttaccagcggtctttgcttttgtttctgacggcgggtgtcatcttagtgactttggtcatagggatcattgtcttgcctatgctgacggaaacagaggaagcgaaaagcacggatttgaatgctttgatgattttagaagaggtcgttgaagttttgcgaaaagaaataaaggaaattgatcgtaatacaaaagaatttttagccactgaagcagtgatagaaaattatcaagaacggatacgtgatctgtacttggaagatttaaccgatgatgaaaagcaagaagtacaagaaatacaagcactgattttgtcgatcgaacgggatggattggatgaaagttatcgttcgggcaagctttcttctaatggttatcgtttttactcccgttttctttctcgattcgaacattctatcacaagccagattttgtcttttatcggcttttggttcattgttgtccgtaggttaatgcgaatcgttctccatccgaaaatgttttggcaaagaagatatgctgatcgtcagacatttattagtgatgaagatatccaagaaatcagagagacatatcaaaaaaatactcagttgattattgaaagtttagataacttgactgatatttatgatgaaacgatggttcaattttttatccagcaacgcaaacttgaaggaataaaaatgaactcggggaatttgatttcttcgtggatgatccagcaagatagtctgtttacgaaaaaaatgctaagaggttattatcttgaaagaaaaatcattgatgaatacgaagttgctgaaaaaatcacgacgttttctgcgaacagctatcgcaggaatatcaatttgttagaatcttatacgatgaacaaaccatctgataacttttctttccgatttgcgtttcgagcaaagtcaaaaaaaacgagtccaataaaataaaaaggtaaaaattttcaagttttataaaaaacaaaacatatcagaacaggatcgaatcggtcctgttctttttttgagaacacaaaaagaacaaataccaaaaaaattttcctgaagttcactatttttatgatacaatatccaagataaggagggaacatgttgaaagaattaaaagtaactgacctcaaaaaaacttatggtgaaaaagatttgtttgaccagatttcttttttggtccacgaaaaagaccgtatcgggttgattgggacgaacgggacgggtaaaacaagtctcttaaatattattgccggtatcgatagcagcgacggtgatcggcaaacagtgttttatccaactgattaccgtattggttatctttctcaagcagctgaattttccgatgaattaactgttctccaagcagtctttcaaggaaacagccccttgatccaaactgttcgagcatatgaggaagcattgatcgaactaggggaaaacggagaagaccctgatgtgcaaaaacgttatgctaaagcagaagaacaaatgaataaagaagatgcttggactacagataccaacgcaaagattattttgcaaaaattaggaatcagtgaattagataaaaaaatcagtactttatcaggtggtcagaaaaaacgagttagtctggcgcaagtgttgattgatgaacccgatttactattactagacgaaccaacaaaccatttagattatgaagcgatcgagtggttggaaaactatttgaaacaataccgtggcgcactattgatggttacccacgatcgttattttctagatagagtagcaaaccgaatcttcgaactttcatttggaaaattatacgagtataaaggaaattatgaagcttacgtcttagaaaaagcagaacgtgatcgtgtagaagtagaacaagaagaaaagcgcaagcggctttataaacaggaattagcttggatgagggctggcgtacaggcacgtggcaccaagcagcaagcacggatcaaccgtttcgaagatctaaaggagaacttgtaccaagtaaaccaagaagatgatttagagctgaacctagcgacacaacgtttagggaaaaaagtactggaaatcaaagatggcagttaccgtataaatgaccaaacactgctagaacatttagatttattgattcaatctcgggaaagactaggtattactggtaaaaatggtgcgggaaaatcgacattgcttaatattctagctggcagaattcccctggatagcggtacaatgtctatcggtgaaacggttcatcttgcgtattatacacaagaaaatgaagaaatggcaccagataaacggatgattgcttacttacaagaagctgctgaagaagcaaaaacagcagatggcagtcaaatcggagtagcagaattacttgaacgatttttatttccaagatttatgcatgggacactgataggcaaactttcaggcggagaaaaacgccggttatttttgttgaaactgctgattcagcaacctaatgttttattattggatgaaccgaccaatgatttggacatagcaacattgacgattttggaagattattttagaagttttccaggtgctgtgatcactgtttcccatgaccgttatttcttggacaaggtagcagataagttattagtattccaaggaaacggaaaacaagaactttattacggaaacatgtccagttatttactgaagcaaaaagagacccagcagcctgctgaaaaagcgaaaccaaaaatacagagcaaggaacctgctgaaaagaagaaattatcttacatggaacaaaaagaatgggaaacgattgaagatgagattgcagaacttgaagaaaaaatctcattgctccaagaagagatgaatcatcaaggagataatttcactcgattacaagaattgcaaaacgacgtatctgaaacagaagcacaacttgaagaaaaaatggcacggtgggaatacttgagtgaatgggtagaagattaggaggaaaaaggatggaacaagcgtatcttgacttaggaagaaaattgttggaagaagggcatcgtaaagaagacagaacaggcacaggcacattaagcttattcggataccaaatgcggtttgatctgcaaaaagggtttcctttgttaacaacgaaacgagtaccttttggattgatcaaaagcgaattgctttggtttttaaaaggagatacgaatatccgctatctattacaaaataaaaaccatatttgggatgaatgggcatttgaacgctacatcaaaagtccagactataatggaccagatatgactgattttggccatagatgtttgacagatcctgaattcaatgaagaatataaaaagcagagcaagcttttttgcgagaagatcctaaccgatgattcctttgctgaaacatacggcgatcttggacacatctacggctatcaatggcgtcactgggaaacaaaagacggtggctttatcgatcaaatcaaacaagtgatcgaagcaatcaaaaagactcctgattctagaagattgatcgtttctgcatggaatccggaagatgttcctagcatggctttgcctccttgtcatacgatgtttcaattttatgttcaagagggacggctaagctgccaattgtatcaacgcagtggggatgtgtttctaggcgttccgttcaacattgcaagttatgcgttgctgactcacctaattgcacatgaaacaggtttagcggttggcgaatttgttcacacattaggagatgctcatctttatatcaatcatatcgaacaaatgaaagaacaattgagccgagaaatacgcgcatttccgactttagttttgaatcaggaaaagcagtcagtatttgattttgagatggaagatatccaattagaaggatatgacccacatccggcgatcaaagctcctatcgctgtttagaatcagaaaggatgagaaaatgttagctgcaatttgggcacaggatgaaaacggattgattggaaaagaagaccgtcttccttggcgtttgccaaatgatctgaaattcttcaaacaaatgacagaagcaaatacactagtgatgggacgaaaaacattcgaagggatgggtagccgtccgttgccgaatcgtcagacgattgttttgacgagagattcttcctataaagcagaaggcgtgcatgtcatgcatagtgtggaagacgtgcttgctctggaaaaagaaacagacggtatctttttcatcgctggagggtcagctgtttatcaagaatttctgccattttgtacgatattataccgtacagtcatccatcatgtattcgatggagatgcttattttccacctgttgactggtctgattggtcactgatcaatactagtcaaggagaaatggatgaaaaaaatcgttatccgcatcaatttgaaacgtatcagcgtaatgagaatcctgtaaaaagcgggacaggcgaattgacgatataaaaaagctatggatagactagctgttatttagagctgtcccatccatagctttattttttttattaagtaaagaataaaacagagaagtacataaaacctgcacctaacataacaaacaaatgccaaacaacatgcatatagcggatagaattcaagctataaaagaatgcgcctatcgtgtaagaaagcccgcctgctaccatcaaaataacaccagtcattccaagagagtgataaagaggaacagcagccacgacacagagccaccccataaaaatatagatgatcgtagatacttttgatactctctcccgtttatgcaacgtcaacgctttatatataatgccaagaatcgcaaacaaccagattaatacaaataaagtccaacctagccatcctcggatactcagcaaacaaaaaggagtataacttcctgcaatcaaaagaaaaatcgaactatgatcgaatacttggaacaccttttttgcttttgtaaaaatcaatgaatgaaacaaagtagacgttaaaaataaaagaatcatcatcgatccatagatagcataagagacaatatggagggaggaatgcaagtgggcaccttttactaaaagaaccactagtcccgcgatactcaatccagtcccaattccatgggtgactgcattaaacacttcatttaatatttcatacgttcgattaaatttcgttttttccatgaaaacggctcctttactaggtgtaattaatgaaaaatcattatttgtctgttatactaaaaatagaaattgtcttacatgtagtttaacatgaataaggcatcttgttaaagaaagagagagagaaaataatgacaaatgtaaaaatcgtaacagattcttcatgtacgatggaaaaaaatgtacgcgatgctttaggcattcgtgtcatgccgctatccatcatgatcgacggaacagtatatcccgatgatgaccaactagacggcgaaagatttatggaaatgatggcgaaagcaaaaaatctgcccaaaacaagccaaccaccaattggagaattcatctcgatgtatgatgagctaggagaagacggcagtgaagtgatttcgatccatatgacaaaaggcttgagtggaacagtagaagcagcaagacaagccagtaatctaacaaaaacgaaagtaacggttatcgacagtgataccactgaccaaggattatcttttcaggtaattcgagcagctgaattagcaaaagaaggtaaaacagtagagaaaatccttgaagaagtcaaaaaagtacaagacaatacaaaattatacatcggaatatccacactagataacttggtaaaaggtggaagaatcagccgaacaactggtttgctgtctagtgttttgaacatacgcgtggtgatgaatttcgcccattctgaattaatccctgtaactaaggggcgaggaaagaaaacgttcgataaatggtttaataatttgaaaaatgaactgaaagaattgccaaatgtgcgacaaatcggtatttcacatgcggatgcaaaagaattggcgcaagaattcaaagagggtttgcaagaattattcccggacatgcatatccctgtactgcatacgaatccggttatcgctacgcatactggtaaagacgcgtttgcaatcatgtattatgtagattagtcgaaaagaggataagccctcagcctgaaaggcttgcagcttattctctttttctttataaaattaggaaaataattgttttcttttttcataaagactacctttttgataaaatttttgataacattagaaccaatcgaatacaagaggtgaaaaaatgaaattaacgaaacgacatttgatcctcgttttgttcccattattaattgcgatcatcatctatgcaggtttagctgcttctataccgaaagctggcccactaatgaaaccagtaactactgtgagagaagatccaaataaaaaagaaaaacttcactacatagctatcggagattcgctgactgaaggagtaggagatcaaaccaagcaaggaggattcgttccccttgtcgcaaatgatctaaaagaccgttataatttgaccgcggttgaaacagaaaactatggtgtaaatggtgaacgaagtgaccagatcttaaagcgagtaaaaacaaaagaagaaattcgaaacaatatcaaaacagctgattttatcacactgactgttggcggtaatgatttgatgaaagttatccaaaataatttattcgggttaacggtcaattcctttaaaaagccactgaaaaactatcaggaaaatgtcacagaactattggaagaatttcgatccctcaataaaaccgcacctatttacattttaggcatctacaatccattttatttgaactttcctgagatcactgacatgcagacaattgttaacaattggaacaaaggaacagaaacggtgacaaaaaaaatgccgaactgctactttatcccaatcaatgatttgctttatcaaggattgaatcaggaagtaggtgtcacagaagaaggaacagatcaaacaactagcacgacagaaaatctaaatggcatcaaaaataatgtgctctatgaagaagatcatttccatccaaataatttaggttatcaattgatggcaaatgcagtgagagatcagctgatcgagacacaaaaccaatggttagagaaggaggatgatcaataaacatgaaaacaagatctgacgtatcttcaaacaaaacaaagaaaacaaattactggaaattcgccttccttatccttcttggggtagtacttggttcgaccgtatttttaggcagccgtatttttgctaatcgggaaccagaactcccagaaataccagctcttacggaaagacaaggagatcctgtcttaacgatcaattcaaataaagaaaaagtcaatcaaatcatcagctttttccttagtgagtatcaaaaagatagtgatattgaatataaattttatttggaaaatgaagcactactcaatggtactttcgaagtactaggttttcctatcgatttctatttatattttgatccgtatgtgatggaaaacggaaatgtccaactaaaagctagaagtctttctatcggaacattgagtttgccaatcaaagatgtgatgaatatgatcaagagaaactataaattaccagattggatcgaagtcaatacagatgatctgactatcatgcttaggttggatcaattccgaatgcaaaacgggatgtatattaaagcagataaaatcgacttagtaaatgatgacattcggtttagtctatatttgccaaaagatacctctgatgcttcaaacaactcaaataccaacaaaactagcaccagcagtactgaaagcaagacaaaagaaaataaaaaatcatcggatgagtagtattagagggggaatcataatggaacgagcaatatttgcaggaggctgcttctggtgtatgatccagcctttcgacacgcttcctggtatccatacagtgatgtcaggatatactggagggcatgtaccagatccgacttatgaacaagtaaaaagccaaacgactggacatacagaagcagtggagattatctatgatccaacattgatttcatatgaacaattagtagaactttactggcagcaaactgatccaactgacgctttcggacaattcgaggatcgcggtgacaattatcgcccggtgatcttttatttgacagaagaacagcggatcattgctgaaaaaagtaagaaacagttagctgaaagtggacgtttcgaacagccaatcgttacaaaaatcgaaccagcccaaccattttatctagcagaagaagaccatcaagagtattataaaaagcatcctgaaaattttaaaagaaaccatgcacgccgggctgcctttatcgaagaaaattggaggaacgaagggtgaatcgaagcttttttcattatttaatgacactgcgaggcggtggcacacatgatgctttatctgttttcgctacagaagccggtaaagacatccaatttcctaagcacagctctagctacgaagaaatttctaattatctggaactgaatgtcgactatttgccgtccatggatatctttgacgaagcatgggaaaaatatttagaaaataatcatgacatataagagatagttttgtactttatgatcaaaaaagttttttgtccaatagcctaattgaaagaattatttttatttcagctatctagtcgcatttttttgatatttttcttataataaagaaagaatgaaaaaaagagggatggattgatagagattgacaaaaaaacaacgctatattaatcgcttctggcttgtattcaaatacttacttgtttctgtattccttgcgttcatgttgcggggatttttattcatcccggtaccagtggaaggcaattcaatggaaaacgtgttgaagcaaggtgatatggttgtgatggaaaaattttcggagatcagacgatttgatattgttgtttttcaattagcagatggcacgatttatatcaaacgagtaatcggtcttccaggagaaaatgtcagctaccaaaatgatcaattgaagatcaatgggaaagtagttaaggaaccttatctaactaaaaacctgaaatcagatcatgcaaatgcatcctatacgacggactttacactacaagagctaacgggacaatccaagcttccggaagataattattttgtacttggagataatcgaagagtttcaaaagatagtcgttcgtttggcacgatcaataaaactgatattctaggtaaagcaagatttgtctattatccacttgatgaaataaaatggatccagtgagaaacaataaagcgtgcagtctgttgagactgcacgctttattgtttaatccaaaatcagtttactaccttagtacgtaaaatcaaacagctcgtttaaacacttttctagcctctaaagttttgataaatgaataaacaaccattatttgaatagggatttggatcatattcctgatgaatctacctagaaaaattactttgaaatctgcaccaaacaaaacagacatcagccaagaattgataaaaaggctgactgggatcataatcaataattgggcagcgatgacggaaggcaggtttatctttttatgatataaaaataagccattaataaatccaccaaggaaagccgtgataagaaaagcagcttgaaacgttcctgaaccaaatatcgtgaaatttaaagtgttcgacaacatttcaagcaaaccagcccagatcggtccatatagataacccataagcgccatacttaaaaatccgaatgtgatttgaaaataagcaggaccaatcgctatcttgtataagatgacatcaagggctaataaaagagcagaggtcgacaacaatcttgcattcatttcgggcaatctaaaaacgtcttttgcaatcaaagtgttcaaaatattctctcctttgtcagttaataataaaaggataccataaaatcaccaatgtgtcatgacacattggtgatttacatacactggcatctaacaattaaaaaaagggtgagaagactgcttttataaactgtaaaaaagagattgtacgaataaaaaaaatagaggcggagaatacttatcgtatcatccgcctttgtttttttgttataaaaaacgtcagattagttatctgcttacatcttcatccatacgggttctaatgtatttccgtctagatcttggacttctaatgaaaacatttcttcttcaggcattcccatatctacttcgtggaaagtaccaccattttcttttgcaatttgagcaaatttttttacttcatccgcattttcaacactaaacgaaatcaaagcaccacttgtttttttattatcagctatttctttatcttttataaattttttataaaaatcatgagagagaagcattatccaaaaagtgtcatcccataccattgaaccagcttcttcagtagaaaattcttcattttttttaaaacccagcttttcataaaaagcaacggaacgattgacatcagcaacaggaaaattaacaaaaaccatactattcatttgtttcgtctcctttctgttttgttcgtctatcatctcttatttaggaaacgctgtcaaaaatttagattcatatatagaaaccaaaataaaaatttgcatcatcaaaaaagtgaagatgtgatagaatgaggactggttcactttcacttaactaatagatggaatttctttataataaaaaagtgaatttatattgaaaaagaaaaaaacaagtaaagccggggaatattccggtatgaaaggaatggagagaacaatgaccatccaatggtttccgggacatatggcaaaagcccgacgagaagtttctgaaaaaatgaaatatgtggacatcgtatttgaattggtagacgcacgattacctttatcttctcgtaatccaatgctagatcagatcattcagcaaaaacctcgccttgttttattgaataaagcggatctggcagatccacaacagacaaagctgtggcaagaatattttcgtaaacaaggccatcttgcattagctatcacggcacaagaaagtaaaggaattaaaggtctagtacctgcggctaaagaagcattgaaagaaaaacgggcaagagatgctgctcgggggatcaagcctcgcgctattcgggcaatggtcttaggtattccaaatgttgggaaatctacgttgatgaatcgactagtaggcaagaaaattgcacagacaggaaataagcctggcgtaacaaaaggtcagcagtggcttcgtttaggtaatgagttggaattgttagacacaccagggattttatggcccaaatttgaagatgaagaaatcggcaaaaaactagcgctgacaggcgcgatcaaagaccagcttgtccatttagatgatttagcgatttacggattagacttttttgcccgatattattcaggaagaatcagcgatcgttatggtttatcaatcgagcaagaagaaaaattggcaccggaattactgatggatattacagcaaaacgtgggtataaagaagactatgatcgtggcagcgaattagtcgtgcatgatattcgtcaaggaaaacttggacgatacacactggatcgttgcgaagaaatggagcaaaaaagtgatgactgaatccatccaaagtatcaaagaacgattgaaaagcatacagagaatagatgatcctacactagaatcattaagaaatgatccacgcaaaggcgtgcagcaagcactggcttcttttgaacgacgattgaaaaaggaagcattaattaaggaaaaatatgaagaaatgttttgctttgaaaagcaagggtacgcacaaggtcaccaatggattgccggcattgatgaagtaggaagaggaccattagctggacctgtcgtggcagctgcagttatcttgccgaaaaatgagatcatattagggctgaatgactccaaacaattatcagagaaaaagcgagaacttctttatcaacaagttcaagaaaaagcccctggcaatcgggatcgggatcgttgatcagcagacaatcgatgatgtgaatatttatgaagcaagtaaattagcgatgatccaagcagtagaaaaattgtccattgtaccaagctatttgttgatcgatgcgatgaccttggatttgcctattcagcaggaaaaaataatcaaaggggatgcacgatctgtgtcgattgctgctgcaagtatcattgctaaagtatatcgagaccaattgatgaaagaatatgacgtgctttatcctggatatggtttctcgcataatgcaggttatggaacaaaggaacacttagaaggacttgaacgacaaggaattacgccaatccatcgtaaaagttttgcacctgtaaaaaaatatttacaataaaaaacagccgcttttacgtatcttattagaaagagagacgaaaggcggttttatgatgtatcaaatagaagaaaatttattgaaacttgcttatacaaaaggaatcagtagtcaaggaaaatgggcacttgctaactggatgatgcagtatccttataaagaaatcggatttgaagacatcattaagataggtaaaataaccaaacaccgggagctgtttcgcaaaagttggcaggaaattcacgctaactggggcaaaatccaatcgaaacagtcgtttatcacttgctttgatcccaaatatccccctcagctgcttcacttgacctatccgccaattgtactgttttataatggtgatctatctttactttcttgtaacatgttaagcgttgttggtggaagacacacttctgctttagccaaaaaaacagtttattatttactaaaaccagtgatagaagctggatatgtgatcgtcagtggctgcgcgaaagggatagatacatacggtcaccaagcagcaatctctcatggtggacggacaatcgcagtcattggaacagggatagagcaagtctatcctgctgaaaatcgtgacttgcaagaggtgattgcaaatgatcatcttcttttgagtgaatatcctcctcaatccggcccgaaaaagcattgttttccaatgagaaatcggattatcgcagctttgtctaaaggaacatgtgtctttgaagccaagaaaaaaagcggctctctgataacagcacagcaagcattggatcttggaagaacagttttttctgttccaggaaatattttaacagaacattctaccggatgtcatcatttgatccaagacggtgcagtttgcacggtttcgggtgaagatatcttggcagaatttaaagaataacaccatacttttcatttgcttttcttgacaaacgttttctgaatggatatgattagctacgatttgtatgaatcctcttttaatagtaggaacacgacaatggaaaggagtccattcagtaatggcgtataaatatttagtgattgtagaatcacctgcaaaagccaagacaattgagaaatatcttggacgaaactataaagtaatggccagtgttggccatataagagatttaccgaaaagtaaaatgggtatcgattttgaaaacaattatgaaccccattatatttctatacgcggaaaaggcgatgtcatcaaaagcctgaaagccgcagcaaaaaaagctcaaaaagtttacttggcaagtgacccggatagagaaggagaagcgattgcttggcatttagcgtacctacttgggttggatctgaaagaaaaaaatcgggtggtcttcaatgaaatcacaaaagacgcagtcaaagcagcttttaaggaaccaagaacgatcgatgtagatttagtagatgcacagcaagctcgtcgtaccttagacagaatcgttggttattcgatcagtcctattctctggcgtaaggtcaagaaagggttaagtgcaggacgtgtccaatctgtcgctttaaaaattattattgaccgtgaaaaagagatccgagaatttgttccagaagaatattggagcatcgacggtaattttaaaaaagctcgcaagaaattcaaagcaaatttctggggaatcgacggtaagaaaaagaaattaccagatgcacaaagtgtaaaagaagtcactgctagaattgatggaacagacttcgaagttaaaaaagtagaaaagaaagagcgcaaaagaaaccctgcgaatcctttcactacaagtagcctgcaacaagaagctgcccgtaagttaaactttcgaacaagaaaaaccatgatggtagcacagcaattatatgaaggaatcactttgggtaaacaaggaacagtcggcttgattacatacatgcgtactgattctacccggattgccgatacagcaaaagcagaggccgcagcatttattgaagatacgtatggaaaagaattttctagacatgatcaccgaaagatcaaaaatgctcaaggcgcacaagatgcccatgaagctgtgcgtccaacgagtgtgcttcgtacaccagatgaactcaaacaatatttagataaagatcaattgaaactttatacattgatctggtcacgttttgtggctagtcagatgacaccagctattttagatacaatgaaagtgacattagaacaaaatggtgtcatcttcattgcgaacggttcaaaaatcaaattcaaaggattcatgcaagtgtatgtggaaggtagagatgacggcaaagaagagaaagaaaatattcttccagaacttgaagaaggcgatgtagtccaatctgttgatattgaaccaaaacaacattttactcaaccaccagcacgttttagtgaggctacgttgattcgtgcactagaagaaaacggggtagggcgaccttccacttatgcaccaacacttgatacgatccaaagacgctactatgtaaaattgacacaaaaaagatttgagccgactgaactaggagaaattgtcaattcattaatctgtgaattcttccctcaaatcgtcgatatccatttcacagcagaaatggaaggagatttggataaaattgaagaaggcacggaagcgtgggtcaaagtggttgatcgtttctataaaccgtttgaaaaagaactgacgaatgcggaagaaaaaatcgaaaaaattcaaatcaaagatgaaccagcaggattcgattgtgatgtctgtggacatccgatggtgataaaattagggaaatatgggaagttttatgcttgcagtaattttcctgattgtcggaatacgaaaccaatcgtaaaagaaatcggtgtgacttgcccagtatgtcatgaaggacaagtcattgaacgaaaatctaagaaaaacagactattctatggttgttcccgtttcccagaatgtgaattcacttcttgggataaaccagtgggcagaaattgtccaaaatgtgacggatatctggtcgagaagaaagtcaaaggcggtaaacaagtagtctgtgtaaatggagattacgaagaagacatccaaaaataatagaaaagaggttctttcattgaaaatggtaaatgttgttggagcagggcttgccggaagtgaagctgcttggcagatcgcacaagcaggagtccctgtccgtttatatgaaatgcgtccagtcaaatcgactgaggcgcatcacacaagtaattttgctgaactagtatgttccaattcattaagaggaaacagtttggctaatgcagtagggttattgaaagaagaaatgcgccgattgaattcggtagtaatcacttcggcagatgaaacagcagtgccagctggtggtgccttagctgttgaccgcgattctttttctgaaacaattacccgaaaagtcaaagagcatccattagtaacagtgataaacgaagaaattactgaaataccggaaggaatcaccgtagtagcaacaggacctttgacttctcatccattagcagaaagcatcaaagcattcaatggttcagatggtttttatttctatgatgcagctgcaccaatcgtagacaaagctacgatcgatatggataaagtatatttgaagtcccgctatgacaaaggagaagcagcttacttgaactgtccgatgacagaagaggaattcaaagctttccatgaggcactaatcaatgccgaagtggcagaacttaaatcttttgagaaagaaaaatattttgaaggatgtatgccaattgaagtaatggcacagcgaggattcaaaacgatgcttttcggacctatgaaaccagttggattggaagatcctaaaactggcaaacgtccttatgctgttatccagctgcgtcaagacaatgctgcagcttctttatacaacatcgtgggctttcagactcacttgaaatggggcgagcaaaaacgtgttttccggatgattcctgggttagaaaatgctgaattcgttcgctatggtgtgatgcaccgaaacagctttatgaattcgccagaattgctgaaaccgacttaccaatcaacgaaacgcgaagatctgttctttgcaggtcagatgactggtgtagaaggctatgttgaaagtgcagcgagcggactacttgctggaatcaacgccgcacgcttagcaaaagaaatggaaccagtcgagtttccacaagaaacagctattggaagtatggcttactacattactcatgcggaaggaaaacatttccaaccgatgaatgccaactatggtctgtttcctgaactgccagagcgcattcgagacaaaaaagcaagatatgaagcaattgcacaacgagctttaaaagctaatgaggcaataaaaacagaattagaaaaaactgcaatcccaaatgagtaaggaaactccatgaagagggtgagacggatagtctcgctctttttcttgcgtttttcttaagaatttctcaaacaaaatgtgaggaattgcgccaattgtgaacaaacttagaaatattggttaaattctgacaatttatttgtctttttataaacgctgtgctaaattattctctgggacaaaaggaaggtgagaaaatgacagaagccacgtgggaacaaaaatttttgcgttatttgattgtcgaaagaggatattcagaaaaaacgaaagaagcatatgaagaagacattctccatttcaaacattttttggaggaatctggagacgctgatctgctgaaggcggaatattttacggttcgtgtctatttgagtgcattagctgatcatcgtcctagctatagcagaaattctatcagtcgcaagatagccagcctacgttcgttttatcagtatcttctcaaagaagaagtgataaaagaaaatccattttcttacgttcatctcaaaaagaaaaatttgagactgccacgttttttttatgaaaatgaaatgcaagcactttttgacagcgtagcaggagatagtcctttggatttgaggaaccgcgctttactggaagtcctttacgggtcaggcatccgtttaagtgagtgtagcagtttgtcggtatcagacattgattttgattcagaggtcatgttgatccatggtaaagggaacaaagagagatatgctcctctaggttcttttgctcaagatgctctgcaagaatatttcagggaaggccgccaggtattgatgacaaaatatcacgaagagcatgatatcgtttttgtgaatcatcatggaaaaccaatcacgcctactggaattgaatatgtcttgaatcaaatgatcaaaaaaagcagtttggatagtgatatccatcctcacatgctgcgccatacatttgctactcatttattaaataatggggcagatttgcggacagtccaagaattgctaggacatgccaatttatcgactacccagatctatgcccatgtaacaaaagaaagtttacaaaaaaactatcgttctttccatccaagagcgtaaaaataaggaaaagaacaaatttaggaggaaacaaacatggtcgaatcaccatttcattcaaccactatctgtgccgtcgaaaaagacgggaaatttgctatggctggagatggccaagtaacaatgggtgaatctgttgtcatgaaaggcactgcaaagaaagtacgacgtatctacaatggagaagttgttgtaggtttcgccggaagtgttgcagatgcgtttactttagaagaaaaatttgaaggcaaactaaacgaatataacgggaatctacaacgcgcagctgtcgaattagctcaagaatggcggacacagcaatctatgcaaaaacttgaagcgatgctgatcgtaatgaatgataaagaaatgcttcttgtttcaggtacaggagaagttatcacaccagatgatggtatcttagctatcggatcaggagggaattttgcgttggctgcagcccgagcaatgaaaaactatgctcaaaacgacatgagtgcgaaagaaattgcagaaaatgcgttaaatattgccgcagatatctgtatctttactaatcataatattatcgtagaagaactgtaagaggtgagtagatatgtatgaattaaaacaaacaccaagacaaatcgtaagtgaattagatgaatatatcgtaggacagcacgcagcaaaaaaatctgttgccgttgctttgcgtaaccgctatcgccgtttgcagttagatgaaaaaatgcaacaagatattacaccaaaaaatatgctgatgatcggacctacaggggtcggtaaaacagaaatcgcacgacgtttggcaaaaatcgtcaatgcaccatttgtcaaagtcgaagcaacaaaatttactgaagtcggttatgtcggaagagatgtagaatcaatggttcgggatttagtagaaaatgcgatccaaatcgtagaaaaagagcagtacagccgtgtatacacaagtgctaaaaaaaatgcagaaaaacgtttggtaaaaatcttggtacctggtatcaaaaaagaacagaaacaatccactaatcaatttgaacaaatgatgaatctttttaatgctagtcagcaaaataccgctgaaccgcaagaagaagtgacagaagatattcgaatcaatcgccgtacagtcttggaacaactacaaaagggtttactggatagtcgtgaagtaaccattgaagttgaagaccaaaagaaacctgcaccaatgatgaacaatggattggagcaaatggggatcgacctaaatgaaactctaggtgctttgacaccgaagaaaaaagtggaacggacggtaacagtcaaagaagctttagagttattgatcaaggaagaatcagcaaaattagtcaaggatgctgatatccatagtgaggcaatcaaattagcggaagaaagtggaattatttttatcgatgaaatcgataagatcacttctaaatcacagcaatctggagaagtatccagagaaggcgtccaaagagacatattgccaattgtcgaaggttcacaagtaaacacaaaatacgggatcatccaaacagatcacgtcctattcattgcttcaggagctttccatttgtctaaaccaagtgatctaattccagaacttcaaggacgcttcccgatacgggtagaattagatgatttgacagctgaagattttgtgaagattctgaccgaaccaaataatgctttagtaaaacaatacgtcgcgttgatcggtacagaaaatgtgtcagttacgtttacaaaagaagcaattgaacggatcgctcaaatcgctttcgatgtcaaccgtgacacagataatatcggcgcacgcagactgcataccattttggaaaaactactagaagatctattatttgaagcaccagatatgcaaatgggagaaataacgatcacagaagcatatgtggatgacaaacttggctcaattgcggcaaatgaagatttaagtcgctatattttataaaaaatcggaggacgacaatgacagacttgctaacgaaaacccgcaagataaacacacttttgcagcaaaagaatacttttgacatgcaagcagatttgccttacgataaaatggctgtcacactaggtggtattcttgacagcaacacctatatcataggaagtgacggagtattactaggttataatgaacgtcacgatgtgaacaatgaacgaatcaaaacaatgtttgttgagaaacaatttcctgaatcttatactgatacagtggcacagttgatgaaaactgaagctaatatcccaattactagtgatattactgcatttccggtagagtcaagagagaaatatccatttggtctgacgactgtcgttccgatctttggagctggcgaacgtttgggtacgattatcttatctcgtatggaacaatcgtttgcagatgacgatctagtcttagcagaatatggagctacggttgtcggtatgcagatcctttatcagaagtctcgaagcatcgaagcagatgtacggagtgcaacggctgtccaaatggcaatcaacacattatcttatagcgaattgaaggctgtacaagctatctttgaagcattggatggagatgaaggtcgtctgactgcttctaatattgccgatagtatcggcatcactcgttctgtgatcgtcaatgctttacgaaaattggaatcagctggaatcattgaatctcgttcgttaggcatgaagggaacttatttaaaagtattgaattcccgttttaaagacgagttagcaaaacacagttattagaagtaaggggactggggcagatagaaatgtttgttccagccttcccattttaaaaagtaagtcgaagttggaggaatggcaatgactgttattattcaaaatgaccagctgatcgccgaaatcgctgaacacggtgcggaattgatcagtctgaaatcaaaagaacatggtttagagtatatctggcaaggtgatccagcgtattggggcagacatgcaccggttttattcccttttgttggacgtttaaaagatgatcagtatgtttatcaagggaaaacatatcaaatggggcaacacggatttgctcgggatatggattttgaagtcattgaacatggacaagaaatggctagtttcatcttaaggagtacgccggagacattagaaaagtatccatttgattttgaattagtgatcagctatgaattaggaggagacggcatcacggttcattatcaagtggcaaataccggtgaaaaagaaatgttcttttctatcggtggacatcctgctttcaatgtacctcttgaagaaggattgtcatttgaagatttctatctggcattttctccattgaaatcaagattacgcctaccattgaaaggcccattcatcgatatggatcaaaagacgttaggtcagacaaatacgaatctggctttgaatcgtgaactttttgagcaagatgccttggtttttgaaacaaggggtctaaatgcgtacgccattcgaagtgaaaaatcttcccatagcgtaactttaagctataaagatatgccttatgtagggatctggtctccttatccaaaagaagcgcctttcgtttgtatcgaaccgtggtgcggaatcgctgacacggtgaacagtagtggaaacttgatggaaaaagtagggatcaatcaactaggtgcccatgaaatcttcaagacaaaatattccatcacagtgaagtaagaggttgtgaccgagaagttagcagggaacaccgtttaccaaggtgtgtaaaaaagctatcctgtaagtaataagggagtgtgacatcgatttgtcacactcccgttttatctctttggaatgaaaaagtatcaggattttttcttgctgctattcaaaccaaacgggattcgactttcagtatggtttctgatacgcttgatattgtctttatgccgataaaagataaaggaagaaactaaaaaggcaatgatcgtcagtaaccaattgggcttagccaaaatcacaggagctacataaggaaggacgatcgtagataaagtgatcaatactgcactgatcatactgctcaaactcaccatacttgtacaaaataaactaacgataaagatgatacaagaataaacaaaaaatacaggattaaatcctaaaagcattcctgcacttgtcgcaacagcttttcctcctttgaacccagcaaaaatcggaaatgtatggccaagaatggcgcataccccaaaccaaagagggttaatcccagaaaggtggaagatcatcggcaaacaagtagccaatgtaccttttaaaatatccataagcaggacaacaatcccggctgttttgcctaatacacgaaatgtattggtcgttccagtattaccgctcccgtgttgtcggatatcttttttgaaaaacaatttgccaatccagacaccggaaggaatagaacctaaaagatatgctaaaataagtaataagatcaatttcattttttaccctctttcaagttgaaaactatcctttattttagcatgaataggtaacaggaacaattgaaaaaatgaaagatacaagtataatagatggaataaaaagaaaagcaaggggtggcagaaatgtctgtaaaaaatccaacacaagaaacgattttcaactatttggaagaagcaaaaaatattgccgtcgtaggcttgagcaataaaccagaacgaacaagttacatggttgcacaggtattgcaagacaatggatataaaatcataccagtaaatccattattggctggtgaagaaattctaggcgagaaagtctatgcgaatttgacagaaatcgatgatccaatcgatatcgtagatgtatttagacggagtgaatttttacctgaaatagcaggtgattttttgaaaactgatgctaaagtgttctgggcacaattagggattgaaaacaaagaagcagctgagatgctaagaaaagcaggacgtacagatatcgtaatggatcgttgtattaagattgaacttggtaagttgaaagaaaaccaaaaataaaaatgaccacaaagaagagatgatcgatagaggggaatgtcgaaaaagcggttaggagataattaaaattgatttctcgtctaccctcttttttttcacgaccttttctagtatgataatcgtggtgcggttttgccgcaaagtattattgaaggagcgtttgccttggcaaaaaaagtaaacaacgaatacaatgactcgtccatccaagtattggaaggattagaggcagttagaaaaagaccagggatgtacattggatccactgacagccgaggcttgcatcatttagtctatgaaatcgtcgataatgcagttgacgaagcattatcaggttatggcagtgagattgatgtgaccatccatgaagacaatagtataactgttgcagatagcggacgtgggatgcctgtaggaatgcatgcttccggaataccaacagttgaagtgatttttactgtgctgcatgctggcggaaagtttggtcaaggagggtacaaaacttctggtggactgcacggtgtaggagccagtgtggtaaatgccttatcgaaatggctaattgtaacgatcgttagagatggcgtagagtatcagcagaaatttaaaaacggcggtaaacctgacggtactttgaaaaagataggaaaaacaaaaaaagcaaacgggacgactgtccattttttaccagatgatacaatattcagtacaacgaaattttcatatgaaattttagccgaacggttaagagaatctgcctttcttctaaaaggcgttaaaatctctctttctgatcttcgtggagaagaaccagtcaaggaaatttttcattacgaagaaggaatcaaagaatttgttgattatctgaatgaagaaaaagatacattgacaccagttgtttatttttcaggagaaaaagaaggtatcgaagtagaggtcgcttatcaatacaatgacggttattcagaaaatgttttatcttttgtcaataacgttcggacaaaagatgggggaacccatgaagctggtatgaaagcggcgatgacgaaatcttataatgaatatgcgagaaaagttggtttgctgaaagaacgggacaagaatctggaaggtagtgatttcagagaagggttagctgctgtactttctatccgtgtacctgaaaatcttctgcaatttgaagggcaaacaaaagaaaaacttggtacgccagttgctcgtaccgtagtagataacgtcatcagtgaacaaatgggcttttatttgcaggaaaatagcgaaatgagccagatgttggtccgtaaagcaatcaaagccagagaagcgagagaagcagcacgtaaagccagagaagaaagccgaaatgggaagaagcgtaaaaaaggcgaatctcttctttcaggaaaattgacacccgcacaatcccgaaaccctaagaaaaatgaattgtatttagtcgaaggggattctgctggcggatctgctaaacaaggaagagacagaaagttccaagcaattctacctttacgaggaaaagtcatcaataccgaaaaagctaaaatgcaagatatcttgaaaaatgaagaaatcaatacgatgatctatacgattggtgcaggagtcggtcctgagttttctatcgaagactgtaattacgacaaagtaatcatcatgaccgatgcggatacagacggcgcccatattcaagtattactgcttactttcttttatcgttatatgaaaccgctgattgaagctgggaaagtatatatcgcgttaccgcctttatataaagtatccaaaggacaaggaaagaagcaagtcattgaatatgcgtggacagatgacgaattggcagcaatgattaaaaaagtcggcaaaggatatatgctgcagcgatataaaggacttggagagatgaatgcggaacaattgtgggaaacaacgatggatccgacttcccgtacgttgatccgcgtccgtatcgatgatgctgcgcaagctgaacgtcgagtaaccacactgatgggtgacaaagtagaacctcgaagaaaatggatcgaaaatcacgtgcaatttacgctcgaagaagatggcagtatcttagataaaaaagaggatactgaaatctctccttcagtttctaatgatttattagatgaagaacgagcagataaaaatgaaaacaatcagttatttgaagtagaataggaggtcacctgatggaaaatcgacaagaagtacaagaattaactttagaagaagtgatgggtgaccgcttcggacgttattccaaatatattatccaagaacgtgcactgcctgatatccgtgatggattgaagccagtgcaacgccggatattatttgccatgaacaaagatggcaatacgtatgacaaaggattccgtaaatcagcaaaatctgtcggaaatatcatggggaattatcatcctcatggtgacagcagtatttatgaagcgatggtccgcatgagccaagactggaagttgcgggaagtactgatcgaaatgcacgggaataacgggagtatggacggtgatccacctgctgcgatgcgttatactgaagccagattatccaagttaagtggagagatgctagcagatatcgagaaagaaacagtcgatctcgtgtggaattttgatgatacagaaaaagaaccaacagtccttccagctcgatacccaaaccttctcgtcaatggatcgacaggtatatctgctggatatgcaacagaaatcccgactcataacttagctgaagtgatcgatggcacaatctatatgatcgatcatccacaagcgagccttgaaaaattgatggaatatattcctggacctgactttccaacaggagggatcttgcaaggaaaagatgaaatcaaaaaagcttatgaaacaggacgaggaaaagttattcttcgttcgaaaacaaagatagaggcaatgaagggtaataaacagcaaatcgtgatcacagaaatcccatatgaagtaaataaagcgaccttggtgaaaaaaatggatgagatccgtttgaataagaaaatcgatggaatagctgaagtacgagatgaaagtgatagaacaggtctgcaaattgtcgtcgaattgaaaaaagacgccaatgctcaaggaattttgaattatttgttcaaaaacactgagctacagatcaattacaatttcaatatggtcgctatcgaccatatgactccgcatcaagttggactgaaagacattttaagaagttatatcgagcatcgaaagcaagtcataacaaaacgtagtcaattcgatttagccaaagctcaaaaaagacagcatatcgtagaaggattgatgaaagctttatcgattctggatgaagtaatcgcaacgattcgtgaaagtaaagacaaaaaagacgccaaaaagaatttagtcgacgtctttcaatttacagaagaacaagcagaagcaattgtcacattgcaattataccgtttgacgaacacggatatcacagagcttcaaaaggaatccgaaagcttgattgcgcaaatcacagagttgaataaaatcctttcaaatgacaaagagcttttctctgttatgaaaaaagaattgcgagaagtgaaaaaaaattattcttccgctcgtctaacgacaatcgaagacgaaatcgaagaaatcaaaattgatacgcaagtcttagtggcacaagaagacgtaattgtcagtgtgacgcgagaaggctatgtgaagcgaacaagccttcgttcttatagtgcttccaaaccagaagaaatcgggatgcgagaaggcgactacttgctatactcaggtgaattgagtacattggaccatgttcttctgatcacaaataaagcaaatgtgatctaccgccctgtccatgaactacccgatttgaaatggaaagatgctggtgagcacatttctcaaacaatctccaatctgtctgtagacgaatcgattttagctgttttcccatatcaaaaaattcaagcagagaaaacatttgtattcatcagcaagaatggattgatcaagcaaacacgaatgacagagttcgaaccatggcgcacctataagagccgtccgctcagctgtatgaagctaaaggcggaagaagatgaactgattgctgtgtatctgaaagaagatcagccaggcttagatgttttcttagtaacgcatcaaggaatgggtttgcgctatcctttaacagatgttcccgttgttggagcaaaggcagctggagtgaagtctatgaatttgaaagatggagataggattatcaacgggctgcttgtgttagcagaaggtgatacgccgatcgtaatcgttactcagcgaggagctgttaaacgcatgcttgctcaagaaatcagccaaacttcacgtgcgaagcggggagtgacggtcatgcgtgagctgaaaaaaaatccgcaccgtattatctatatgtcggaaggaagatcaaaagaaataaccttgatgaatcaaaaagggcagcagttaacgattgacccaactgatttccctataggtgatcgaacatcgaatggatcatttgcgatggatgagaaaaaaggtggagaagtcatcgaagttatcgatgctcctgagattttcatcgagtcgtaactgttgtagtattttaatgaagagacgccatctgtattaatacaggtggcgtctctttttcattcatttttaataaatccttatacgtttgcaaaaaaagatgaaagtgttcacaatgcttaaatgttggtatgtcaacgttgatttaaatatatgtaaataaaacataaaaattgttaaataaaaaacaagaaaacccttgcaaagatagggtgctgtgttatactaatcacgtaaaaactgttacataaaacagaaatttaggaggtccatacaatggagcaatggaatggatttaaaggtaccaaatggaaagaaggcgtagacactagagactttattcaaaataactacactgaatatcgcggtgatgacagctttttggaaggcccaacagaagcaacagaaaaattatgggatgaattgcaaaagttaaatgatatccaattcgagcgtaacggtgtctatgatatggacacagaaatcgtatcaactattacttcacacgatgcaggctatttggataaagatttggaaaaaatcgtcggtctacagacagacaaacctttgaaacaagcattcatgccgttcggcggaatcaatatggctaacaatgcgctaaaaagcaatggctatacaccaaacgatgaattgacacatattttcactgactggcgcaaaacacataatcaaggtgtatttgacgcttatactgctgaaatgcgtgctgctcgtaaaaacaaaatcattacagggcttccagacgcttacggtcgcggacgtatcatcggtgactatcgtcgtgtggcattgtatggaatcgactatttgatggaacaaaagaaaaaagatcatgatatgactggttatcatacaatgagtgaagaagtgattcgtttacgtgaagaaatcactgaacaatatcgtgcattagcgcaaatgaaagaaatggctgcgaaatatggctatgatatttctaaaccagctgcaaatgcaaaagaagctgtccaatggctatacttcggatatttagcagcaatcaaatcacaaaatggtgctgcgatgtcaatcggacgtatctcagcattccttgatatctatatccaacgtgatttggataatggagtaatcacagaaaaagaagcacaagaattgatcgaccacttagtaatgaaattacgtatggtcaaattcgcgcgtacacctgaatataaccaattattctcaggattccctatctgggctactttatccattgcaggtatgggattagatggtcgttcattagttacaaagaatgatttccgtctgcttcatacattaacaaatatgggaccttcaccagaaccaaacttgactgttttgtattctgaacaccttccagaaggattcagaacatatgctagcagaatcgctatcgaaagttcttcgattcaattcgaaaatgataatcagcttcgtgaacaatggggttctgatgattgtgcgattgcttgctgtgtatcaggaacagttgtcggaaaagacatgcaattctttggcgctcgtgctaacttggctaaaacactattatatgccatcaatggcggagtcgatgaagtgactggcgcccaagttggaccagaatatcgtccaatcacatcagaaatactagactttgaagaagtgaaacataacttcatgaatatgatggattggttagcagaactatatgtcaatacgttgaacatcattcattatatgcatgataaatattcttatgaagcagctcagctggctttgatggattctgacttgcaacgcacatttgctacaggtattgctgggatctctcatgcggcagacagcttgtcagcgatcaaatatgcaaaagtaaaagcaatccgtaatgaaaaaggaatagcagttgattttgaagtggatggcgacttccctaaatacggaaatgatgatgaccgtgcagatgaattagtttcatggatcttggaatacttcatgggacaaatcaaacgtcataaaacttaccgcaactcaaaaccaacaacttcattattgacgattacttcaaatgttgtttacggtaaaaatacaggaaatactcctgatggccgtgaagctggaaaaccacttgcgccaggagcaaatccaagttacaatgcggaacaaagtgggttattagctagcctgaactcaacagctaaaatgaattacggctgtgcattggatggaatttcaaatacccaaacaatcaatccttcaggtcttggaaaagaacaagatacaagaatcgaaaacttgcgtaatgtcttagatggatacttctcaaaaggagcttatcatttgaatgtcaatgtattcagtaatgatttattgcgtgatgcaatggaaaatccaatgaaatatccgaacttgacgatccgggtatctggttatgcagttaaattccgtgacttgacaagagaacaacaattagatgtcttgatgagaacttcacacgacagaatgtaaaaagttcgtgaaaaaagtttttcgacttagcgtcgaaaggacgttgaatagccatcgcatcaaaatcgaataatcagtatgcttatttgaaagaaacgatttacaggggcaggacttgtatgttccgtccctgtaaattttacacataacgaagcggcaattgcgaaaaattttgttcagaaagcttcgcttcgacagctaacttgtacttaaaatgaaatcaaagaaaagatgtgaacttaaatggaagaaaaaacaatcggctatgttcattctatcgaaactttcggttcagtagacggacctggactgcgctttgtcgtgtttatgcaaggatgccgcatgcgttgccaattttgtcacaatccagatacttggaatattggcggagggaaagaatacacagcagatgaacttttagataaagcagaacgcttcagaccttactggggagataaaggtggtattactgttagtggtggagaacctctattgcagatcgattttttgatcgaactatttaaaaaagcaaaagagcggaagatgcatactacattggatacatgcggaaaaccttttacgtatgaagaacctttcttttcacgttttcaagaattgatgaagtatacagatttactgttatttgacatcaaacacatcgataatgaagagcataaaaaactaacgcattgggacaatgaaaatattttagaaatggctcaatatttgtcaaaaatcaacaaaccggtttggattcgccatgtactagttcctgagcgaagtgattatgatgaatatttgatccgactagacaactttattcaaaccttgtcaaatgtagacagagtagagattcttccttatcatacgatgggaaaatacaagtgggaaacacttggtttgaaatatccattagaagggatcgaaccacctacaaaagaacgtgtcgaaaatgctaaacgattgcttcatacagaagagtatacaaaatatttaacgcgataggtcgcatcggaaagaagataagtattgcttctttccgtttttttgctattattaaataggagaaatcacaaaggagcgaatgacatgtcaaaaattttagtttttggtcaccaaaatccagatacagatgcaatcggggcagccattgcgttttcacacttgcaaaatgaattaggtaaagaaacagaagcagttgctctaggtacacctaatgaagaaacacaatacgcattagaccactttcagctatctgcaccacgagtagtagagtcagctaaagcagaaaatgcagatgtcatgcttgtggatcataatgaattccaacaaagtatttcagatatcagcgaagtaaatattttagctgtagtagaccaccatcgtattgcaaactttgaaacagctaatccattgtactatcgtgcagaaccagttggatgtacaagtacgattattttaaaactatataaagaaaaccaagtaacaattcctaaagaaatcgcaggaatcatgctctcagctatcatttcagatacattgttgttcaaatcaccaacatgtacgcctgaagatgaagcagctgcaaaagaacttgcagcaatcgctgaagtcgatctaaacacttatggacttgaaatgttgaaagcaggaacaaatctaagtgataaatcagctgcggttcttcttgatttggatgcaaaaagtttcccaatgggcagttccaacgttcgtatcgctcaagtcaatacagtggaccttaatgaagtgatggatcgacaagcagagctagaagcagcaatggaagatgaaatgaaagcaaatggctacgatctgttcgtattagttgtcacaaacatcttagacagtgattcagaattacttgttgctggtaaaggaaaagaaaaagtagaagaagctttccaaacaactttgaccaacaaccgtgctttgcttaaaggtgtcgtttcacgtaaaaaacaagtcgtacctcaattgacggctgtatttagctaatcaaatggtagtatgaagcattcaaaatgaatggataagcgattgatataaaaagaaacatagaacatactaaaggccgaagaaatggaggagaataacagtcaattatgactcttgttcttcctcctttttacgtaaaagccttttaagtaaaataaaacggatagaaaagagaacatatatgaactattattcaaaaaataaggaaaacttttatcaaaaactgaccgatgatccgcttttttcttcattgaccgattatctatatgaacatcgagaacaagaaacgattctaagagaattgaaaaaagaattttcgcaaaataaattttcccattttcttgatttattgatcgatgcaggattaatcaagagggaagaacgaagatatcatttgaactttccaatatttgatcctaaagattacttgcaacaagccacttcggctgctgaaaccatagctgaacaattgaagagactctctgttgatgaacaaaaattagcgatgggagaagttatttgggcgtattgtttcgaagatgaacggaaagaagcgtatttttatggagtaagaaacagccgagagacagaattgctgaggacaactgcaggaaatgagaagtaccgttttatcacactttcctctatagaacacttcccgcttactttggctaattacttttttgtacagaagaatcagcttcctgtaacgaaggcattcaaagaattagccgaacttattggagacgtaaatgaatcgtacttttttgatcaaatagaagttatcgttgacaggatacgtaagaataaatataaaaatcgccggcctagtattttccatcagtctctacttgtgacgaatactataaaggaagaagaatcattcacattagaattacctattgtcgaaaaaaacaattttgagattgaattaccaacattggatccttcattgacaatggaggaaatggcctttcttaaacgacaaatcttttctgagctgagcaagaaatttataccgcatgcattttcttatatcaaagaatatggaacagttttagtgagtaaaacctaagagagcagtaagcaaaaattatactgattcttgcaggaggagcctttctcttcctttatggttaaaagaattatttgagtattttgcctatctaccacctattagattcactacatggtctggaaacaaaggaatgcaaaaaaatggtgagaaatgtggaatgacaaaggaagtagtgataagaaaagttagatttttaaataatcaatattatgattcagtcaagtatggcattttatgggaagaactagctgattagattaggaagtccatttgataatccagaatcactaagaaacgaatggcgagtcattaataatttatccaatcttgggttattcttttagattgaagtgtttaaaactaaaaaagcatttatgaagtcgtaatagtcaggcttcaaaatgctttttattttgtttgttttttctttgccacataaatacacctagactgacgatgaagagcatatccaacagatttcctgcgacttggatcgtcgaagggttggtcagtggcattaaagcaaggacaaaaaaggaaaacaagctgtaaataaaacaggtgacaggaactaatcgaaagaagagcggacatttcaattggctaaaaatgagtgaaaaaataaaataagtaaaaatggataaaatcacgactaaaccattcatgataaagaagaaaagcgtattgtgattaaacgaataaaaaagaattgctaaaaaagaaaacgttttaaatgcaatcaatacgcttgaagcttcgtttaacgtaccaggatgtcgatgaaaaaaataggcaccgaaataaacagaaaacagtaagccgcaaagagaagacaaaatcaaaaaaaacggattttcttcggcttctgtgatatcagaatgatccaaaagcaaccagcctaatgcactagaaggcgcatgtgaggtcttaaggtatgaataacatagaaaaaataagatcgtcaaagttgcaaaaaaagagcctaaatgtaaaaaattagtggttctacgttgaatttccataatatctccaaattaaattgataagtatataaagtataataacaaattgatgagtatatgtcgatgttttttaatcaaaataataaataaaaactgtctaacatttaaaatttaatttagatattagacagtatttaagtttgtgagttattttccttgtcgttttctcacttttttagtccagaaaccacctgaaatatattttggctcataagaaatgataaaagcacgctcttcgatttctttgatcaggcgatacagttcacgttcgctttttctaggagaaagtatttcgagaactagccgctcaccttccagccccattgcagaagtctgtgtcacaccataaccgtgttctctcagtatacccggcaaacttttatcttctgcgctatttgctggcaaaatcgttgtgaccatgatgtatcctaatgccaatttgtcttcaatcaaaattccgacactgatacctactgcgtaacctaacgcatagacaaataaattcagtggattatctaaacgatctaaaacaagggataagccgacgatataaatcgtgatctcgaccatactgacaagtggagcaatcagtcgatagcctttcattgtcaacatgaaacgtaacgtgttcagagtgatataagcaaaattaatgaggaagatcatccccaacatttttggatcaatcatttgtaaaactcctttcatttatataacaacaatatcaaaaaaaatcgtaagtgaagaaaaattgaaactttatacatacaaaaaaatgataaaatgattataatagaattataaagataggttaggtgattaaaatgaaaacggtcaatcgtgtgttttgtgccagccacgtgctaagtctccttctcagtatatacttaggtgtctattcgattcaacagccaattgaggtagagaacattgtttttcagatgtcgctgacagatggtttaattttaagcgtttttttctttttgatactgtttattggtaatattttcggtagcgttgccagttttttgaatttttctatttatccactcctttcgctagcattaggagtggtgggactttgttctctgtgcttatttcccgagccattcagtcctgcatttatattatttggtacactgaacctgttccagacaactgttggagcatggttgctatggcgatcaggaaatttaatgaaaataggtgagtaacaattgaatccaattatattgaaacgttctgtccatcatattccagtgttagaagttgttctgaaagaattaagagaggaacgtattcccgttgtcatctattatcacggatggcagacaagtaaggagttagttttgacgcaaggaagaaaaattgcgcagcagggcattcgtgtgatcctgccagatgcgatgaatcatggggagcgcaaacagccggtttcttctattccatcctatacattttgggatagtatctacggaaatctgtttgaatttgacacacttatcaagcatttagaaaaaagaggtcttctacatgatcagcttgcagttggcggggtttcgatggggggaatgacaacatgcgccttgttggctaaacatcctcatatagtagcgggcgtgtgtttgatgggttcccctgcacctttggaatatggaaaagaaatcgtaaggcgcgcatcggaatataattatgtcgtaccaaaagactattttgatttgatttcatgggttaagagctatgatttgtcattgcagccggaaaagttagctggacgtcctctgttcttttggcatggacaagctgacgaaaaaatcccttatatacaaacggaacgatttgtagaaaaaaatcggcataagtcttacggaaaagaaattgtttttcgttcctcaaaaacacagcgacatatggtacaaataccactaatggaagaagcttccacttttttagcaaaaaatttgataaaaaagtataaataattgaaacggaaaatcactcatgacgatagaggattttccgttttttattttgggctataataaactctgttaggaaaatttggtataattgatagtaagaatgacaacatgttagaaaggaagagagcatgcccactttagcagatgttgcaaaacgtgccaatgtttcaaaaatgacggtctctcgagtcatcaatcatccggaacaggtgactgacgaattgaaagagttagttttctcagcaatggctgaactggattaccgtccaaatattgctgcaaaagcacttgtcacgaatcggtcgcagatcatcaaattatttatactggaagaaatcgacacaactgagccctattacatgaatttgctgatgggaatcgctaaacggatcggtaaagcgcattattctctccaattagttacaaatgatgccttcgacgtcggttcttgtgatggatacatcatcacaggtgtcagaaaaaaagacttcgattggatcgaccgtttggaaaaaccagttgtcttgtttggggaaaattctgaaggatatgattatgtagacagcgataatgaatatggtacagcaaaagcaacgcaatatgccttagaaagagattatcaaacgattatttatatcggtatcgaagtggacgagccttttgaaatttcaagggaaactggttatttatctgtgatgaaggaagttgatcttcctagtaaaatcttgcggtttccaaatcattcgacagaagtagaaagatatatgacagaaaactgggcagattttacagataaaacttgttttgtatgtagttcagatcggctagcactaggagcagtaagagggattataaatgctggaggacacttgcccgaagaatttggtgtgattggatttgatggggtatttttagaccaaatcagttcacctaaattgacaacgatcaagcaagatattatacgtatgggtgaagtatgtggagaaatgttgttaaaaaaaatagaagaaaaaggggcgagtcaaggttatcgtcgtttttttcctgaactagttatcagagagacaacgaattaagtcttattactatatatatatttatgaaattcatcgctattttcttaaaataatcagcgcattgctactgaaaacaatgaatctgtgctattattgagaaaagttccatttttgagaaggatggtttgaatgaaagaaatcagacgaaaacatttccgttttcctgcgtacgatgatgagttaggcgtaaaattaaccaacgacaagaagcgagtattatttgacggacaagaagatcttttgactgaacagaatcagtccccgtttgaacagatgaaagaatttcatttcacgaacacgaacaccgagaaaatccgtcgcaagcgtcgtgcaacaaatggattgaagtcagctccgcgtaaggaaaatttggaaaagcataaaggaaaattaccggattataccggccattaccaatcagaaatcacatcgacaggacgaaaaaaactttttggtgattcctctcgttctgtcagacaaagtgaaacaaggacagagtccaagcatactacacgaaacgcatctgttgacacgaaggtgcgggagcgttcttattttgttcctaaatatgtacccgcatcgattatcccagaccctagagaaagcaaaatttctgaggatcatttaatcgaatcgatgaaaaaaacggatgactcttatctgttgttcgatacagaaccgacgccgtatcaagaaaaaagaaatggtgagccgtctgtacgaacattcaatcgaacaaaaacgttagaggaaacaaagcagtcagaagaaaaaaaatcgaaaaaaagccatggtatcttagaacgctcattacaaggattgatcgatgatcaaggaaactctttgggagaaaatagctattttaaataagtgatatacaaatttatattcggctacagttggaaaggaaacgctgcggcgtttccttattttatactctatccgaaagtttatatcgtatcctcaaatttttttgagtttaagcgaattttttctcccaataagtaagaaaataatggcaaaataaaaaaacaaactattttcgcagatcgtttgcaaaaatagtttatttttttataaagaagattttactgaataatatcattttagtttacataatgatatttctgtaaattaaataaagtagtgaaaaataagaatcagtgctctaactgttcaagaggatcaagtggttcaaatgtttctgtagtctgttttgcttccaattggggcaaaacagatccaatttccagatacttcactttattcaatgtataagatagaatagaacagctaagtaatgtatacagaaaatgtgtgagatccaaataaagcaaggagacaactaaaataccaaaagtaatcaagaaaagacttttgccaatcttaatatgaaaatatttttcaatggcttgataaatgatatctgttccgcctgtgcttccgccgaatcgaaagacgagaccgcaaccaatgccagaaagaatacctgtcatcaaactattgatcagtagactatctacagcaaaatgtatatgaaggctctcccataaatgtaaaaagaaaactagcgcaaatgttccgacgatcgtccggagaaaagcgtgttttccaaaaagaaacaatgagataagcaataaaggtaaattaaaaagcagtgaagtgacagaaggagcgaatccaaaaagattatgcaaaagcaaagcaataccagtaaccccaccatctgccagcttagatggaatattgattcctgtcacagctaatccgtagattcctgcgcctaaaatgattccgcacaattctgtaaataaatttaattttttcatttctagcctcttttcttttgaaaattttcagcaacttctttattatactgacttatactcttacttcaagaggaaaatgaaaaaaattatttttggctgtttctttttatttatcaaataaggagtggaaaaatgcgagcagcagacttattgacaattcttacaaaatcacccaaaaaaacagagtatcaaggagtttttttggctcaagaacaaaaactggtgcctgtgacaatggtccagataaataaagcaaatcaatttatctttttatttgaacacggcaaagcaccacttgctatgaaagacatctttctttttttgatgaagaaccgtgagaaagctgtttattatcagtcaaaagaagaactcattcctctttatggagtgaaagagatagaaaataaagtggtgatataagtaaaaataagaaaacaagacgtttatgatgtcaaaacaaccattttttacatttttggcaaaaaagtgtcatgatacagtataatattcgttgaacaggccaataaaggtgttctcccccacgagatttctactttattggctgtttctttttattaaaataaaagttgtgtgtgtaaaaaagatatagctgattccaagtgacaatttcgtatagatttttatggtattcgtagtgaaaaaacgagaaccaaaaagttgatccgactttgttgcttggattctttttttgtcagcatatttagaggtatttttttctttttttgttcgtgctgtaaggttaaggcaagacaagttagttgggaaaaaggaaagaaatgtttatacttaaagaataacagaaaggaaggtcgcatgaataattttatacaaacattaagtgaaagaaaaggcgagttgctggaagctgcatttcaacatctgtccatttctctcatttctttgctgattgcagcactgattgctattcctttagcgatttgggcagccaatcataaaaaaatggcagaagtcttattgcagatcacgggtgtgctccaaacgattccttcacttgccttattaggtttacttatcccatttgtagggatcggaactgttccagcattgattgcacttgttatttacgctttgcttccgattttccaaaacacgtatattggtctagctgaaattgacccgtctattgaagaagcagcggtagcatttggtatgtccagaatgagacgcttgctgaaagtagagcttcccatcgcattacctgtcattatctcaggtatccgaactgccttagttttaatcatcggtacggctactttggcagcattgatcggagcaggtggattagggacatttattttgttaggtattgaccgaaatacacctgttttgacattgattggtgcgatcagttctgccttgcttgcaattatattcagcggactgattcgctggttgcagcataagaaacctcgatattccatcattactttagcagcagtggtgtgtttatttggcggcgtttctttatatcagtctgccttgtttaaaaatgaaaccatcacgattgctggaaaattaggagcggaacctgaaatcctgatccaaatgtataaagaattgattgaagacaacacaaaaacagaagttgaattaaaaccgaattttggcaagacgagttttttgttcaatgcactggatcaaggtcaaatcgatatctatcctgagttcacaggtactgtcctagaaagcttggtgaaggtacctgaagcaatgaaaagtgctgatttgacaaaagaaaaaacatatgacgaagcagaagaattattgaataagcaattcgatatgacattattaaaaccaatggcttaccaaaatacgtatgccttggcagtcaagagatcttttgcgaacgaacatcaacttaaaaagatttccgatttggcagctatctctgatcagatcaaagcgggattcacactggaatttattgatcgttcagatggatataaaggaatccaagaagcatatggcttgaatttttcaagtgtacaaagcatggagccaagtttgcgttaccaagcaatcaataatggagatgtcaatattgtggatgcctattccacagatagccagctcaaggagtacgatctagtgactctagaagatgatcgagggttattcccagcttatcaaggcgcaccgctgatgaaaaaagattttgctaaagaacatcctgaaatcgttaaagcactgaataaattaagcggaaaaataacagaggatcaaatgattgatatgaattaccaagtcaatgtcgaaaagaaaaagccgacagaagtagcacgaatcttcctgaaaaatgaaggattagtaaaggaggaagatcagtgactaaattaatcgagttcaaacatgtgcaaaaaaagtatgatggaaagtatgtcatcgatgacctaaatctggcaatcaaaaaaggagaaatctttgttttggttggtccttccggtagtggaaaaacaactactttgaaaatgatcaatggattatctaaaccatcagcaggagacatctacttcaaaggaaaatcgttaaatgaatataatctgcagaaaatgcggtggaatatgggatatgtgctgcagcaaatcgctttgttcccgaccatgacagtcaagcaaaatattgaagtcatccctgaaatgttaggttgggaaaagcagaaaagagcagaccgtgtagatgaacttcttcaaaaagttggcttatctcctgatatttatcgagatcgtatgcctagagagttgtctggaggagaacagcaacggatcgggatcatccgagctattgctgcaagcccagatgtgattttgatggacgagccatttagcgcattagatccgatttcaagaaactcattacaagaattggttttgtccttacacgaagaattgggcacgaccatcgttttcgttacgcacaatatggaagaagcaatcaagctaggtgatcgtattgcatttatgaaggatggagaaattatccaatgtgacacaccagagcagttattgatgaatcctaaaaacgactacgttcggcatttctttgatgaaccgaaacagacgaaagagtggcgagtagaagatttagtcgtcaatggatatttcttaaatgaaataccagaaaatgctcgtcaacaagtttgctttgatacgcctatgaaagaagtatattcgcttctttcggtgtatccaagcattgtgatagtagaaaagcaaagaagtattgggtcgctgacaagtaaagaaatctttgcttttttaagtcgagaggaggaaggaaatgaaaacatatgatgcaatcatcatcggttcaggtgtgagcggcttaagtgctgcttatggattgaaagaagcaggtaaaacagtactagtggtcgaagaagatctatggggcgggacttgtcctaaccgtggatgtgatcctaaaaaagtcttgttaagtgcagtagaggcacgtaatcgggtaaaacaattgagtggaaaaggttttaacgagatcccaactgccaactgggaagaacttcaaaaattcaaacgaacatttacggatccagtcccagaaagccgaaaaaaacaattagcagaagctgaaatcgatcatctttcaggaaccgctcgttttttggatgattcatctattgaagtcaacgaagaagtcttccatgcggattacttagttttggcaaccgggcaaagacctacgatcttaccagtggagggaaaggaatacttgaaaactagtgcagactttttatcattgcctgtactgcctaaagaaatcatttttatcggtggtggttatattgcttttgagctagctacgattgccaatgctgcagggagcaaagtaaccattgtccatcataatcaacggccattaaaagaatttgaggcgtctttggtagaggaagccgtccatcaaatggaagcatctggcattcagtttgcttttggtgttgaaacccaaaagatcatttcagaaggtactcgctatcgtttagtcggaaaagagacggaattagtagcagatatgattttttgtgcgactgggagacagccgaatacagaatctttagcacttgagcaagcgaatatcgtctttgataaacacggaattgcagtcaatgattatctgcaaacgagcaatccaaaaatttttgcgtgtggagatattgtttcaaggaaaaccccaaaattgacaccagtcgccacttttgaaggaaattatgtagctaagcggataacggatgcaacaagcgaacctatcaaatatccgattatacctacgatcgtctacgccagtcctaaacttgctgaagtaggagttacaaaaagtcacgcctcttcgtcagatcaagtggtagagatggatcttaccagttggttcacctatcatcgtgtcaatgaaccagttgctaaggctgaattgacctttgaccagcaaaattatttgattggtgctgcagtgattagcgagcaagcagacgaattgatcgatgatttgacactcgtcatcaatcaaaaattgactaaaaaagagttggatagctatatcatggggtatccgacattggcaagtgatctctcctatttattgaaataatcagcatgataactaaagcgcttgttgctttttccttcttgtgctacactttaaaaaatgaatacctgtttctggggatgtcgtagacgacatgagagtaagttgtgaacttagacccattgaacctgtcagttaatactggtgaagggagaaacatagcagacgcttgaagcgggttactatgtcgtgcccatttcaagcgttttttgttattcatattagaagaaaggaggtaacaaaatgaagaaaaatctttatccagcagtcagtatggcattcattttaattatttggcagattgttgtcatagtttggaaaatacctgcctttattttacccggacctgctgctgtattttctgcattagcggcagatgcacaagtattactttcccattctgtcacgacattaaatgaagcagtgcttggtttggtaatagctagcgttctttcttttattactgccttggcaatggattattggaagtttttagaaatgtctttttatccgttactagtgatttcacaaatgttgccaatcatggtgttagggccattacttaccctatggtttggtttcggtatgcttccaaaagtgatccttgttgtcttgataagctattttccgatcgtagtttctttttcggatacattgaggaaagtatcaaaagagcaaatcatctttttgaaaacgatgggggcagatacagggaagatttatcgaatatataaaataccagcgggtttatccggcttcttttccggtttaaaagtggctgctacttattgtgtcagcggagcagtcgttggagaatggctaagcgctcaagcaggcttagggtattacatgatacgcgtaaaaaacagctaccagatcgataaagtttttgctgcgatcatttgtgtcattctattgagtttattgctgaatggcgcttgttcattattgaaaaaagggtattatcgtatgctttatattttttaagagaaggggatcaaatgaaaaaattatggcttttattaccgctactgttgcttttatccgcttgtggcactgcaaaagaaacaagtagcaaacaagaaataaaggatttgaaaaaagtgacacttgttttggattatgtaccgaatactaatcatactggcatctacctagcaaaagaaaaaggctattataaagaggctggtttaaatgtccaaatcatcgaaccaggagataattcgacaagtattggtctagtaggtgcggacaaagcacaatttggtgtaagttatcaagaagatgtcacttatgctcacgcagatggacagaatataccagtcaaagcaattgctacagtgatcaaacataatacttctggattcgccaccctatcagacagtaacatccattcaccaaaagattttgaaggaaaaacatatgcaggttggcaaagtccaagtgaagaagctgtcttaaaagctgtgatggaaaaagacggcggggacttttcaaaactgacaatggtaggaagcaatggagaagggccagaaagcttaggaaaatcctcagatatccaatggtactttgaaggttgggatatgatcaaagcaaaagaagcgggtattgaactaaactatatcccattgaaagaattagatgaacggttagattactatactccggtaattattacgaatgatcaactgatcaaaagtgatccagaattggtacagtcttttatggatgccacgaaaaaaggctatcaggaagctattaaggatccaaatgacagtgctaaactgttgcaaaaatatgcaaaagaaaatgatcggacgtttttagaagaatcacaagcattcttgtcaaaaaattatacggatgatcctgagaattggggattgatggaagaaaaagtttggcgcaattatacagcttttatgcaggaaaacggattgatcaagcaagatgtaccttcgcaagaactattcactaatcagtttataaaataggagtgatagatatgtcaatccaaatcagccacttgaatgtagtcattgaaaacctgaaaatattagaagacatccatttcactatccctaaagatacctttacatcgattgtcgcgccaagcggagccggtaagtcaacattgctgaaaactttaacaggagtccagcctatgacttctggaacgatcaaagtagacgatcaaaaagtaactggtctccatacagcatttagttatatgccgcaagaagatatgttacttccttggctgagcgtctatcaaaacgttacgttatatcaaaaaatcaatcatctaacaatcaatgaagaacaagtaagggattatctggatatctttgggttaaacggctatgaacattttttgccggaacaattatctggcgggatgaagcagcgaacggccttgttacgaacaatcatgaatccttcttcttacttgcttcttgatgaaccatttggagcgttagatgctatgaccagagggcagatgcaagactggatgttgaagctgcctaaaaaagcaaagcggactactttacttgtgacgcatgatatcgaagaagcaatttatttatcagacaggattcttgtgctttccgcccgtccggcacatgtgattgctgagattcaagtgcctgaaaaacgacggtcacgtgaatggctactgcagcaatcagagttgaagcaaacgatttatcagttattggcaggtgaattagatgttaagtgatgctcattgtcatttagatgggagtcagagtttagcactccttcagcaggaacacacgattttgacgatcatcaattgtgattcgccagaagaatggaaggaaaacagacagcttgcagcaagtaagactcaagccttaagttacggtatccatccttggaaagcagatagctatacgtttgaacaagttgagccttttttgaaaaaagcaaggatcatcggtgaaatagggttagataatatttggacgaatgtaccgatgactacacaaaaaaaagtatttgagcgacagcttgcttttgcagccataaatgagaaacctgttgtactgcacacaaaaggatgcgaaaaagagatcttaaattatatccaagcttaccctaatcactatttgatccattggtattcttctttggactatcaacaagactatattgatttaggctgttatttcagcattggtcttgatttgaaaaagaatccagcagtctggcaactagctaaagcagtcccaatcgaccacttacttattgaaacggatggactacatgcagcagagtgggctttaggggggattttttcagaaaaagattatgtctcactgcttgaagaacagttaaagacaatcgctgagatcaaagagctatcagttgaagaagttaaaaaaaatacttatcaaaacttggaacgtttcattagattaggtaaataaaaaagagatgtgacacaactagtgtcgcacctctttttggctttctttgtataaaagtaaactgtttgattaataaatgaatcttagtaccaaccgtttgcttcccagaatgctttcgccgcttcccaagaaccataacgtgaagtaacatattgttctgctactctttcttggtttgcagcagagtagtcaccatttaagtaagaagaatctaattggtaacgtccgatgtaacgtccgttcgttgctgtgtaagaaccgcttgattctttttgtgcgatccattcttttgcagagcttgtgcttgctggagtagcagcagtttctgttacagcaggagcaggttgtgtttcagcaacaggcgctgcttgtttttccgtttgaaccgtttcttgtacaacaggttgttcagcttggactggtgcttcttgaacggctgcttgaggttcagcagctgcttgtgcagagccttctgttgggattgttaattgttgtcctgagtaaatcaggttaatatcagaaattgaatttgattctgcaatggcattgatcaaggagttatcaccaacgtatttttgagaaatcgttgatagagtatcacctgattgaacggtataagcttcgtccgcatgagcagtcgttcccatgaagaatgcagcgccggcagccaaagttgttccaaaaagtaaagttttaagtgatgtcatgaaaaatctcctttattcgttaaaaagttttatttgttgtgttcaacgaggaatactttaacacgtgaaaatatttcataggtaaaagaagcatgacaatttatgacaaatccgcgttttttgtaataaatacagtaatctatgaaatgaaaagggttacgtttaataaaacttgcttttttgtttttgttcaccataaatatttatttaagaaagtattaacctgcatttttctctataaaaaagattttttaaatagataaaaaaggaggattaaatgagtatttgatagtatttatattaaaattacatatgtaatttaaaaacgcttgacattgtgtttgagatcacttacttttagcatgtaaaagtattggattaaggagctatgcaaatgaaaaagaaatttattactggtgggattgtcgttgcatttctatgtctaattggctacacaggcacgcggtacgcaaatgaaattattttgtggggtggagagacagatattgatacaatcaatgagaatctgacacagcttgatcatacattgacagataaagagcaagcgattacagatcttaccgctcgactagcacaaaaagaacagacattgcaagattcaaaggcagatgtccaagaataccaaacaaaagtaaatgaattagaaaaccaaaaaaatcaatcggcagcagaaaaacaaaacttagaaagtcaattagtcagcaaggatgcacaactacaaagcaaacaaaatgaaatcaatgtcaaactagatgagatcaaccaaaaaaatgatgaaatcaatcatctgaatgcagattggacagcaagactacaagaagcacaagcaaaactttcagaattacaaaatactgtaaatggtttgaatcaacaaatcgcaacactgacacaagaaaaaacaaatgtagaaactcagttaacagatacacaaaagaaattagacgaagcaactgctgaaaactcaagcttgaaacaatatattcaaaagttagaaaaagcaaaagatgaagtggaagatacagctgataaatctcagcaaattgttgaagaacatttgcgtaaataatctttcttaacaagtaaacctaaattagtaaagaagcaacagtaatctatactgctgcctcttttttttagtacatgtccttcatcttcgcaggaagtgccaatatgattttaagaaaggtaatagacaaaaagtcaaaaagataaaacagagtttcttctttacaaagggaatgtatgttcgtataatggtattgaggtgaaggttatggagaaaaaatatggaacagtagataagatccgtactttgcaagttagtgccagaccgttgatccgtttcagtttaaatggggtcaattgtttgattgcttcccatagtttgaacttcctagctgaagtagacgaagggatgaagttagtcgttacaggttattataataatagaaagcaatttgttgtgagatcctatcatgtgttagggaaacccaaaattgtggtagaatatgagaaaagtctatacccaagaaaaaaggtccgacaagatgaaagaataaactagaaaacaagcggctgagacaaaaatgtcctagccgcttgttttggaaagatggatgcagacgatgggatttgaacccacacgagcatacgctcacaagaacctcaatctatatataactacatgtatttaagtatttgtgatgaatcactaaactttccaaactcatttgagggatattgcttaaagattgaacagatcaattcgaagccctattagtattcgctcaatggggggatcagaggccataaaaagagactagtcattactagtctcaggtagtggaattgtaggattttaaacgttcctggagagtaccggtatgtaactcgaagaggtgattatcatagtcgtaaaagtaaattgaagaagcctcgcctttcacacgagaacgtcctggttcgacagttaaacctaacatttggatttttgagacaaacgaatctatatcttgttcgtcaattttaaaagcaatatgattgtatgtctttggcagtttattcgacgaattctgcattactgcaatccataggtccttaactaagaaaaatttttctggatataatgaaaatttttttgttgactatcgtagatttcttttgcatcaaataaggtatttaacaattaagtatttaaaagataacttttaagttatctttaagtaatgcttaaagctatgttatactctattaggaaatataagaaggagtataaaaatgaacaaacataatagaaaaataacgaataacaaagaactgatcttgttactaatagggatttggggtatctttttactctttaatatgtatatgccgactatgagagcggatgacgtagtttatgcaagtagattagatgaacttggctatttgggtgcttcgatagaacattataagacatggagttcaagaattattatagaactattcttaatgttcttttctaaacactttatgctatggaaattattaaattctacgattatgttaggaattgtagtattactttgcaagtatgttgagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctcccagtatgtttttgagaaaataaatgttaaaaatttattattggtttgctctatatactgtttaataccattgacagtaatgggggaaaccggttggagagcaaccaccttgaactatcagtggccagtagcatttagtttactaactttttatccgttttttcaactcttaagaggagaagaaataaatagaaaaatatattgggtaagtattcctttattgatatttttaactaatcaagaacaagtcaacgcctgtttttttgttctaacaagtatagttagtttatatttgattgtcaatggacgatataattataagttatcagtattttcaataataagcttagcagaattaattttctctttgacaactccagggaatgcattacgtgctgcacatgaaattaataaatggtttcctgaatataaaaatttcaactttcttaataagttagatttaggtatttcatcatttggaaagccgttttttttagacatgaatatcttatttttattgctatttttcttaattttccttctaacatataggaaatgtcaaaactattatgtgcgtatattgactgcattaccgtttttcttaaacctgattatttattttggtaatacaatgggtcaaagctttacttacgtcaatggaaataaaagggcaatgatttggagtagtagtaacctgaataatctctttacagagttaggaacgaaactgtcacttttttatccaggtacttggatagctactttagtagtcttggcattattactatgtttaattgttggaatttatttaagttttgacaataagaaaacttctatttttttagttattttgatgataatgggattttgttcaaggttaattatgggattttctcccacagtatgggcttccggaatgcggacgtactatatactttatgttgttatcgccatcttagtactaatggcagttaaagagctaatgaaaagcatgagtgtacaaaaaaatgaatttatgcaatttggattaaccgtgcttggtatttgtacctttataataacggtgataaacagataatatacaaaaaatccctcgctttagtattaggtgagggattttactcgtttttcgattaattgttttaacacttgcaagtttctacgagtagcttgtttccgaccttcatatactcacctcaggctgtttacatgattgtacgttctttttgtaaaggatacagtgatatgtatataatggcataaagaaacgttcaaacaaaaaaactcgtgaagcaaaattaacttcacgagttgtagtgcagatgatgggactcgaacccacacgagctaacgctcacatgaccctcaatcatgcttgtctgccaattccaacacatctgcgtaataataacacactaatgatagcgaggttttacatagttgtcaagctcaaaaatgggaggacttattaagatggagaaatatgacggagaattttcaggactgggaatgatcttaggtgtattgattggacttgcattcggacgttttttgcttggttttatgctaggaatcatttgtggaattgcaatggattgggcagcgaatctatggaatgactatcatgacaattaagttctcaacgcttgtttgtgtttttttaatacttacgtttttcctaaataagtggcaaaattttctaggatggagtatgatattgaaatagtaaataacaaaaaatttggaaagttctaactttttgaaatgagggattggctaagtgatgagagaatttgaaaaatccaacaaattagaaggtgtcagttacgatgttcgcggtcccgttctagaagaagcggagcggatgcaagaagagggcattagtattttaaaattgaacacgggaaatcccgcaccttttggatttgaagcaccaaacgaagtcattcgtgatttgatcatgaatgcccgtgactcagaaggctactcagattccaaggggatcttttctgctagaaaagcaattgagcaatattgccaactgaaacattttccgaatgtgacgatcaatgatatctacaccggcaacggagtgagcgaattgatcacgatgtgtatgcaggggttgctggacaatggagatgaagtactggttccaatgccggactatccgttgtggacggcttctattgcattagctggaggcatacctgttcattatatttgcgatgaagaggcagaatggtatcctgatattgatgatatcaaatcaaaaataacgagtcggacaaaagctattgttatcattaatcctaataatcctactggggcactttatccaaaagaattattagaagaaatcgttgaagtagctcgacaaaataacctgattatttattccgacgaaatctatgatcgcttagtgatggatggtctagaacatattccgattgctacattagcgcctgatttgttcgttgttacgctgaacggtctatccaaatctcatcgtgtagcaggatttcgagtaggctggatggtcctaagtggagataagtcacacgtcaaaggctatatagaagggctgaatatgttgtcctccatgcgtttgtgttccaatgtattgtctcagcaaattatccaaaccgcgctaggcggttatcaaagtgtcgatgagctgctcctgccaggcggaaggatctatgaacaaagagaatatatctataatgcaatcaatgatattcctggtctttcagccgtaaaaccaaaagctgctttttatatattcccaaaaattgatacaaagcgattcaatattttggatgatgaaaaattcgttttggactttttacatgaacatcatattctacttgtacatggtggtggatttaattggaaccagccagatcattttcgaatcgtttatcttcctaaaatggatgatttgaaacaaacagctaagaaaatgagagaattcctagcaacctatcgccaaaaatgattttaaaaaccaaatttttcagtaggagggccacagacaaacacactgaggctctctttctagtggagttttcttaaataactaaagtatattatttagttgcaagtcttttcttgaagtttgcgacttcctaaagtaaaatacgaatagaatgcgaatacgcatattttggggaggatacttatggaaacgttaatcgagtcctttggaacgatcattaaagagattcgaaaagaacaaaaaatgacgcaaaaaatgctttcgcatgatatttgttcacaaagtgtattaagtcggatcgaaaataatgaggaactgccgaatgtattggtgatgatgcagatttgtcaacggctaggggtaacgattgatcatgtgatgaatctctctcgaaaaactactcggacaaacgataaattatttgaactgttggatagttgtttccaaaaacgtgattatcggaagttagaacaagtactaaaatcttctgatatttctgaaaatctgtatcaagcaactgactttcaacgctattattattatctcggtgtttgcgaattcacgttgcgtcaaaatatctctcagtccctttattatttgaaagaagcattaagctactctagccaaaaagaaagaatccatgtttctgacacagaaatacaactgattagttgtatcggaaaaatatatggtgtggcaggaaaaacggctgaagcacgctactatttgagtcgaagcatccaactgctgcatcaatcagctgatgaacgatcaaaaagtgaattttcgcaaattttttataattatggaaatttcttattccatcaaaatgaaatcgacgaagcgttagaacaggtgaatcaaggaatctattgggctcaagagaagaatagctactattacctcaatgatttatttgtgcttaaaagcttaatatacaagcgtaaagaagaaccagaaagagcagcattctatgaaggcttagcacaagctgtgaaacaaatttcaaaaaatttgtaaatggtgtagaccattcttgacttcttctctaaataagagtactttagaggtagaaaaacaaagggagagaatagaatgagaacttttatctatgctgacaaattctttttagcgtcaggtgtcaaacatgcaggctatcttgaaattaccgatggactttttggtgaatacaccaaagaactacctgagggagaagtcaacatcattgaccaaagcggcaaatggattgctcctggtttggtagatacacatattcacggctatatgaatcatgatgtaatggataatgatgcagaaggcatcaaagtgatgtctgaaggtctgttatcttgtggagtgacttcatttttaccaacaacattgacgtcaagcaaagaacgtttaaaagatgtagctgagacaatcggcaaaatgtatcaggaagcaccaggagctaaaatcaaaggaatctattttgaaggtcctttcttcacagaagaacacaaaggggcacaaaacccaagttatttcggggatcctgatttggatactttccatgaatggcaagaagcttcaggtggtttaatcaaaaaaattgctttagcaccggaacgtcaaggtgtagaagagtttgtcaaacaagtgactgaagaaggagtagttgtttctctaggacacagtaatgctacactagaagaagcgcaaaaagctgttgaagcaggcgcaagtgtatttgtccatgctttcaatggtatgcgtggattgaatcatcgcgaaccaggtatggtgggtgcgttattatctttagaacatgtcttttctgaattgatttgtgatggccatcatgtacatccaaatgctgcgggaatcctaatggaaaaagcaggacatgatcatgtcgcattaattacagactgtatgatggccggtgggatgcctgatggaaattacaatttaggcgaatttccagtagtagtaaaagaaggaacagcacgtctagaatctggcaacttagctggaagtatattgaaattgaaagaagcaattaaaaatgttgtagactggggattagcaacaccagaacaagcagtcatgatggctagtctgattccagcaatcagctgtaaaatcgatgatacatgtggaaaaatcgctcaaggacgcgatgcagactttatcgtattgaaccctgatatgacattggaagcaacttatctagatggcgtggaacgtttccacgcataatataatttaagttaaccttaaaactaaacttcttaagtttggttttaaggttttttttgtgttctagtaaaaatcactttacataagtttcaaaagtttctttaatttcctattgttcaataagtaacaatgtaaagataaaattaaaaatgttaatacgtattagcaaaataaaagcttttttttattgtgaataaatgaacataattaggaggagaaagatgaacttatttgacatttttcgatcgactttgacagatatgtcgattgtcagtgcaatcacttcaacagtttttattatattattagggtttgtttgtagaaaaaaggggattttttctgaatctgttggaaaaattctatcgaaagtcgtcttaacagtggctttgccagcactggcatttcgagctttcatgcaagatatcaatacagaattactgatgcaaggaatcaatgtcttgatttggggattagttatttatattattcttattctagtttcaaaaccttttttcttaagctataaaggggataagcaaacaacgttgcgtgtcctgacgatctttggttctacgacctttttcggaacgcctatcgtcagtgcgatttatggtcctgtcggcgtgatgtattcctcaattttcaatattggctaccgaatctttttgtattcttatggatacataaaaatgagtggcttgaagatggaagctaaaaatatcaaagcgatgttcgtcaatccaatcattatcgctacttttgccggccttttcatttggctgttccaagggtatctgccacaagtgtcagttacaggtgcagaaggagagataagccaagtagcgtttttgcgaattgaccagactgcaccgtggctatttcagccgatggattatttagctggtttaagttcaccattggcgtggctagcaatcggcgcaacattaggtgaagtaagcttcaaaaaagctgcatctgaaaaaacttcatggtattacagtctagtcaaagtggtatttgtacctgcattgaatatcgtgattctagcagttttgacggcaacgaatattctaccagtcaattttgaagcactggcaacaatcgttatcatgatggctacaccagctgcaacagtggcagcagcctatgctatcagttttgatagggaggcacttttagcctccaatgcatccttactgtcaactatttttgctgtggtactgacacctgtatggatcgttgtattacaaatgattcatggcataggtttattttcataagaaatggaggaagaaagtatgagaatcgcatgttacggtgttcgtccgaacgagatagatttttttgaaaaattgaatatttaccattatgatctcagtctttatgaagaactgttgacacatgacaatatcgtgtcagcaaaggaccatgatgctgtattgttgaggggaaattgtatagcagatgagaccaatcttgcaaaaatgcaggaatatgggattcgttatgtttttacacggactgtgggagtcaatcatatcgatctacaagcggcagctgattttggtatgacagtagcccgtgtaccatcgtattcgccaaatgcgatagcagagttatctttgacttttgccatgatgcttttgagaaatactgcgtatacgacgatccgaacatctttcaaagattttcgagtggatgagcaaatgtttagtcgtgaaatcagaaattgcacagtagggatcataggaacaggcaggatagggttgacggaagctgttttgtttaagggactaggagccaaagtgatcggctacgatattcatcagacagaagctgctaaaaaagtattgacgttccactcgcttgaagagttattagccaaaagcgatattgtcagtattcatgtacctcatatcccaggtgaaaacgatcaaatgatcaatgaaggatttttagctcaaatgaaaaaaggtagcatcttgattaatacagcccgtggagagcttcaagataatgaagctattttaagagctttgaaaagcaatcatttagctggttttgcaaccgatgtttttgcaaatgaaacagaggtttttttccgatccttcaagccatgggagacgattccagaccctgctatccagcaattagtagaaatgtaccctagagttcttgtaaccccgcatgtaggttcaaatacagatgaggcattatcaaatatgatttcgacaagtttcgagaactttcgtgaaataatagaaactggaaaaacgaaaaatgaggtatctcttcctaaagcccgtcaattaagataagaaaacatggatattcgtcaataaaatgtttaaaaatagtccaagtaaacagttgttacttctgtatacttggactattttgtatgggataattcgatgactcaacagtaatctgtgagctttttccgcccattctttgtcaattcataacaggttagcggccggccgatttccaaatatttgattctttcgttcaatatatcttgttctactaaaaaattcaaatatttcttgacggatatacgtgacagtgagcttttttgagccagttcttttgttgaaaaaatagtatcttcttttagaataaatgcacttattttttttaaagtcagttttgacagacctttaggcaaatcgatgaatgatggtatttcgtgaatgggagtggtgtggttgaatacttgatcgatcaatttctgatcggctttttcagtcgtttggattgtctgagagaaagcaagatacttttcgatcgccagctgaaaacgttgcaaagtgaacggtttgatcaaataatctaaggcaccgtagcggatcacattctttatggtttcgatatcatctgcagcagtgatcaaaatcactgggatatcatttccttgctgtctaagccaagataaaaaatggataccactttcgccaggcatgtatacatcaagcagcagcagatctgcgtttttttgtctgaaatatttttttccttcttctacatttctgaaactttcgattacgttcatattagggatgctttccacaaaagtacgattcaattctgcaaccattggatcatcttcgattatcaggacatttgtcatcattttgatcttccttttttggtaattctagatagacgattgtaccgccatttgtttgtttggaaaattctaaaaatccaccgtggcgtttgacgattgaatggatgagattcaatccaaacccacgattgattcccttcgtcgaaaaacctagcgtaaatattttttctgagatttcttctgatatcccgacaccgtcatcgcagacggtcacgatgaatacttcagcttctgtgtcatagtttaaatgaatccggacctgtccgtttctttcatgtttttgtagcacggcttcttttgcattatcaagtaagttccctaacacttgcaaaagtgaatggatggagtcatccatctccattttagggataaaagaatcgctttctaacagcatttcaacagattgttctttggcttcgtttattttgcctaataaaaaaccggcaattgcaggtactttgatcagacttgagacttggccaatctcttttttataattttgatttagctgctggataaaatgggtgacttcttcatacttcttcaaatcaatcaaaccagaaatgacatgaagtttattcatgaattcatgggtttgagctctcatggagtttatatattgtttcgtccccccaagctcctccattaatttcattacttctgatcgatttcgtaaagttgcgactgctcctaaaaaacggtcattgctaaaaagaggtgtaacgctagaaatagtttctatcccatttaaatacatggattgagtccgaacggtcgtttgatgctcaatcgtctctttaaacaaacgtcatatagattatcactgatttttttcctacttcgaaatccaatagctgctctgtttggtagaaaatgttttttgcaggtgtattgatcaagaggatagttttatcagaagagatggctaagattccttcatctacttcattttcgataatcgttttttcacttaactgttctgctatttcttgtggttcaagtccaagcagtacttttttcattttttgggcaagaaaaacggcgcctatgatgcctacgctaagtccaataatcaatgaaaaaacaatcattttttgtccatctttgacttgattgtcaatcgtgttgtttgttaagccaacacaaactgcaccaataatctcttgatcataataaatagggacgaaatagcggaagccgaaccctaacattccttctttttcagagaaaaattcttgtcctccaatcacttttttcacatcttcatgacttgagaaaggaagaccgatgtaacttgggtctgcgtgagaatatcgaatgccttcagggtccatgacaacgataaaatctaaattcgatgcaatcatgatttcatttgttattccttgaatcgcatgtgtcgggtcaccagtctgcagctttttttggatgagtttatcattggcaacgattttagcaatgctagagattttatctgacacactagatcggttcatcgaaagaataaaattcctgatcaatatggcagaaacaatcaaagaaacgaatgtggagaaacaaacgacaaggatgatcgtgttctggagctttaatggttttttcttaaaaaaaggaaacataggctacctcgaaagaatttattgtgaaaattttaacatgaaaacaaaaatttaacaaattgtcaacgataaacacaaccttcctataaaaaacaccactgagtcggtaaaagaagctatacagaattttcaaacattggtatgatagacgtagaaatggaaggaggcgtgtatatgatagggggaatcgcacttgagacgatttattggtatacattgctgatttgtgcaggattggcagtcctattgattatttttggagatgtattcgattttgatggcccgcttgatccgatgcttattatcccttggttaactttcacaagcttatttggttttctaggtgagcgtttaacagatcaatcatctttatttttatttattgctagtggaggcatatcgatagtgttggtatttttgcttaatttctatatattgatgccgatgaaacatgccgaatcaacgatgtcgtcttctgaaaaaactctggaaggacaagtagctgttgtgatcacaccgatccctgtacgaggtatgggagaaattcagttgaaaagtgttaccggttccattagtcgtccagcttgtttttacagcccccaagaacagacagctgagcggggaacgaaagtattgatcattgagatcaaggaaagaatctgttatgtcatgccttatgaaagcatgataaaagcttaaaggagcgtgtgttaaatggaaataccagttgtttttatcgcgatcgcaatcgcagctttgattttactgatgttgctgatcgtctttgtagcgaagtaccagacagcaaaaccggatgaagcgttgatcatcagtggaagttatttaggaagcaaaaatgtgcacattgatgaaagcaataacaaaatcaaaattgtgcgtggaggtggcgcattcgtcttgccagtttttcaacgttcgaatcggatcagtctattatcgagtaaattggacgtctccacccctgaagtgtatacggaacaaggcgtaccggtgatgtgtgatggtacttcgatcatcaaaatcggttcatctgtagaagagattgctacagcagcagaacagtttttaggcaagacaagagaagaactggaaaatgaagcaagagaagtattagaaggacacttgcgctcgattcttggttctatgactgtagaagaaatctatcaaaatcgcgataagttcagtcaaagcgtacaagaagtcgcttctgtagaccttgcaaaaatggggttgatcatcgtttctttcactatcaaagaggtcagagacaaaaacggttatcttgactctttagggaaaccaagaatcgcccaagtcaaaagagatgcagatatagcagaagcggaagctctaaaagaaacgcgtatcaaaaaagctcaagcagaaaaagaatcacaagcagctgaattacagcgacaaacagagatcgcagaatcattaaaagaaaaagaactgaaattagcaacctacaaacaagaacaagatgttgctaaagcaaaagcagaccaagcctacaatttagaaagtgcccgagcacaacaacaagtaatcgaacaggaaatgcagattaaaatcgtagaacgtcaaaaacaaatcgaactggaagaaaaagaaatcacacgtcgtgaaaagcaatatgattcggaagtgaagaaaaaagcagatgccgatcggtacgctaaagaacaagaagcacaagctcaaaaagtcaaagaagtgactgaagccgaagcagaacgattccgtgtggaagcactggcagaagcggaagccaataagacacgtttagctggacaagcagaagccgaagcagcactagcaaaaggaaaagcagaagccgaagcaaaacaaaagatcgccaatgccttcaaggaatatggcgaagcagctgtcttgagtatggttatcgatatgctaccgcaattgatgcgcgaagcagcacagccgctaggaaatatcgaaaaaatctctgttgtcgatacaggaagcagttcaggagaaaccagtggagcgaaccgagtgacaaattatgccacaaatttgctttcttctactcaagaaacactaaaagcgacaacaggacttgacttgaaggaaatcgtagagaatttgtcgacacgtgggactactagccaagtaaatatgtatgaagcgccaaaagaggcagaacaaaactcgatgaaggaagaataaagtagtacacttcaccgttcaatcaaaaatggaggaagactttttaaagttcttctctccatttttttattttattgcaaaagaaaattagtcctcgctatttttcttttgtttttggatcttagcttctatctcttgtaaatttgttcttagcaatcgttctttcttttggagttcgaccaaatcttctgatagttcttccttcttttctgtttcaggaggacgaagaaagaaattgataccgattgcaatgaatgtccctataaaagtatctagtacacgttggatagcatacaaagcggattcgccttgagggatgctcaacgcaatcagcaacaacgtagctattgcggaaatgataccggaattattgttaataccatctgacacgacgatcacaataataactagaataggaagcaagatcaattctaccaaaaaatcattgtgaaaatagcttttgacaaaaaaataaatgatagctaatgtaccacctaatgtattgccgatgatcctagactttccaaaagaaacggttgtagtcaagtcctgacgcaaagaaaaaacagcagataatgcagcaatcatcgggattcctcgttgagtcaaatgaaaaaacaagatacataaaaaaacagctaaggcacttttgatcgtacgcatacctagtcgaaaacggccaaattgcatagagattctcctttttggtctttttactatcatacctaaacttttgtctgatagctagtttttcattattcaagtataattaaaataaaaaagggggaagtaaatgcgtataggaatgcgaacagtcaaaacagtgatcagtgtcttcttttcgatggtcacagcgggtagcttatcgctgttgtattggccagctgcagggatcattgcattattaagtgtaggaaataccaagcgctctacattgcgtacgggcatgaatcgaatcgcagcctttatattagctacggcaacagcactgttcagtttttttgctgttgggtatactatttttggcttcagtctttttttattcctgttcatcccgcttgcctctcgcttcaaattaaccgaagggatagtagtaaattcggttttggtcactcattatttagtggaggaaaacatgtcttggcagctgatcggcaatgaagcgggattaatggcgattggattagtatttgctttgcttgcaaatgtttacatgccagatcgtacgaagcagctgaaggaaaaccaaatacagatcgaaaaagaatttcgaaatattttgagacaaatggcagaatttcttttatcagaaaataaagaagatgtgcagatcaaatgcgaacatttactgacattcattcgcgaaagccaagaagatgccagagaacatcaagaaaactactggctcagacagccgctatactacgaaacttacttctctatgagaagagcacaggccaatgtgattaaagacatgctggaaaatctagagagaatccagcaaccagcttattatggaaaacatatctatggtttattgatttatactgcagaaacattttcagagtcaaatgatggcagacaaattttaacacgtattgaagaagtttatgtattgtatcggcaaatgcctctgccgactagtcgccctgaattcgaggatcgagcagaattgttccagtttttgcagtcttttaaaagttttattgaaatcaaggcagaattctcccaacaaaaaatccaaaaatagaggttgtgaattcagctaatattcaggtcaaaaagctgatttcacaacctcttctttaaacggtgttctcctgtcaactcctcggtcacaagtcacaatattcaacaaacatgagaagctgttttttgaaattgctccttgtgactcggagctgaacggtaggctcacaacctctttcttaaacggtgttcaaaagctttcctctgcggtaataagtccagccaaacgaaaaataggaggagctatttttgtttggctgttcttattacttgatgcagaacagctttttcacaaccttttaaaattacatatttttccatagaacttgcatttgatccaagatttcgatgacatcttttgtcaagaagagagagcgattgggcaagtcaccttcaatcatgtgtaccatattctttatttcgtaattcattgcttcagatgtattcccgctttcgatgaattcctttgtaccatctgtaaataagatctccgcacgatcagcacgcgggtaatcagcaatcgtcacataaccgttctcaaaggcaacgataccgacttttggcatttttgcctgaaaagtcaagctgacagcagcaagttcattttctttgttacgcaagatagtgacggattgttcgtccacgcctgtttcaaaaggaaccattgtagaggcaactacttcaggttgagagctcaaaaagaaacgagcgaaagatacagcatacgtaccgatatccaacagagctcctccagctaattctggattgaagaaccggtttttagggtctggttctttgtaactgccgaaaggtgcttggatcatttttaaagcccccagttttcctgtatccattattgagcgtaactgctgataaagtggcatgttgaagattgtcatcgcttctgctaagatcaaattcttttcttctgctaagcgcatagcgtcagccagttcttttttattcatcgtgatggctttttcacatagaacgtgtttgcctgcttccaatgctgccaagatatggtcgatatgctgtctatttggtacagcaatgtacacgatgtcgatttcagcatcgtctaacatttcttgatagcttccgtaagcttttggaatattgtaacggtgagcgaagttttccgctttttctgaagttctggaagcaactgctgttagttcgctcgtctcttgattgaagctttcggcaaactcatgtgcgatggtaccaagaccaacgattccccattgatattttttcatctgaaaacgctccttcatagttggattgagtttcttgtctgtctattattataacaaaaatcacgaagaataaagaggagaggacttgaaacattaaaaaaaatgaaagcagcgatttaagaggtgctttttgatcaaaacttaagtagaatagttaaaaggaggggataaacgtgcatcaagtatatattgatcttattatgagtgtattattagaacagtttgaaactgaaaaaaattttttagatgaatacttgctgatcagtccagaacaatggcaaaaatggaaagatggcgagaaaaatctgccatctgaagcgatgcagaaagtaaaaaatcttttcactgattatgaatggatgctaacgcaaaagattttgcgtcaaacgattatttttcccgaaaaacgaaacgttgccgttgcagagtacaagcaaatcaaaacacgcatcgcgcaaaaatggcttagcagcaaagcagcaaaagtcgagctgatccctttgaaaaataatcagcaggctggtagataccttgacttgaaagtaagtattcaatatgatgaatggggctatgatgatattttgaattttcgtctgccagcagatgttcaaaaacagatcgaaggagaaaaaatcgaacttctcgattgggtgaatgaaaatctggaagaaacttacgttcatgaggcgaatggggaacgtgaagaacaacgaaaggatttttcaagtgaataaatttttaggatttggagcagttgtgattatgatcgcagcaatgggctatgttatttttagcgatgatgattcgcatgttcaagccggcaatcaagcagtcgaacgaacaagcaccaaaacaactgctagtaaagaaaagaacagtcaaacaaccagcagcaaggtaaaggacaaagaaacaaaagatcgtacgtccaaacaattgccagatgttaaaacagacgattggaagctagttttggttggtccagatcacaaattagaaaaagaaattgatgagtctactcaattggcatcattaagtaacggatacttgatcgacaaacgcattgctccagaatatgaagcatttgccaaggctgctgaagcagctggatttccattagtgatggtctcagcttaccggtctgtatcatcccaacaacaagttttcgaacaaaatgtccaagatgtgatgagtcgtcaaggtgtatcagaagaggaggcgacaaagattactaaagaaacgattacggagccaggatacagcgaacaccacacaggtctggcagtcgatgtcgtcgatcaaaactggtacaacagttatccttctactgtattggatgcaagttacggagatcagcctggagctaaatggatcgcagataatgctgcgcagtatggatttatcgttcgttatccaaaaggacacgaagatataactaagatcacatatgaaccttggcacttacgttatgtcggtaaagaaaacgctgagtatatcaccaaacaccaattgacgctagaagaatatctgaatgaattaaatgaaaagtaggaattgatcatggcgaaaaaaaagtggaaaaagcaaaagcgcaagaatatccgttggccagcagtggttgccggtgtagcagtgatactcttagcctttgttttttccttgaagaatctgtcttctccttttactgataatcagcaagaaaatgaagcgcaatcccatcagcaatttattgaacggcttgttccgcatgcccaagaactacaagatggttatggagtgcttcctagtatcattttaggacaagctatattagaatcaaattggggaaaaagtaccttggctagcaaatacaataatcttttcgggatcaaggcttatggggatcagaagaaagtaagcctggaaacaaaggaatttgttaacgaagaatggataactatccaaggagacttcaaagtgtatgattcatgggaacagtccatggatgaccatacacaactgttcgtccaaggagtagattggaatcctgcgctgtatgaaaaagtgattacggccaccaactatcaggaagccgcacaagcattgcaagatgcaggttatgcgacagaccccggttatgcgcaaaaaatcatccaggtcatcgagacgtatcaattgaatcagtatgaccggagatagcaaaggagaagtggctgatggcagaacaatttacgccagaaatcatgacggaattgagaaaagatatcgtaagagtaccggaaatcattttagaagcaagcgggatcaagatatttggaaaattgatccgttcgatcatctttactacggatattgcgatcatacgtaatacaaatgcgaatgcagtaattgctgtgtatccttttacacctcatccagcgattactaaaagcattattgaggcagctgacattccagttttctccggtgtaggtggtggtttgacacaaggtgctcgttcttcctacatgagcatgttcgcagaagcgcaaggttcgttaggggtcgttttgaacggtcctacgcctttagagacagtaaaagaagtttgtcgagtagttgatattccagttatcagtacggtaacgtcgaaatatacagaaatagatgaaaagttagcagctggtatttcgattatcaatatcagtgcaggtaaagaaactgcagaagcagtacgccattttcgtaaaaaatatcctgaacttcctatcattgcgacaggtggtccaacggaagaaagtattgctgagaccattcaagcaggagcaaatgccatcacatatacgccaccaagtagcggagagctttttagtcgtaaaatggaaaaatatcgggaaactgagaaaaagaatcatgaataacaggtgagaatcaaaagacgaggaagagcagatagtggctcttcctcgtcttttgtactccagtactatttgttcagaattcaaaaaaaagagaaatttttttgttttttacctgtaatgtacataagaagagttaaaaccttttgttattattagcattctaacaaaaaaatgtcttgatttattgaagcgctttctatagaatgaaaaacgaataaaaactaaaaaaggcacccgacaatttagtagcagctaaattgtcggggcttgaaaagtcagcgggaactgaccaatcaagttgccatagtcaatgcttgtgcatcgacgtgtatattgtacctaatttcatacagaattactagttatttttctgttttttagggaagagcgcacacgaagaagcatgcttatttagctatgtcaaggatattgggcagttgtctgatatccttttttctttgcgtaattatcctcccatcattgaagcaagaagtgtttttagcgatgaaagaagaatcagcactatctaatttttcttgaaagtattgagttgttcatcctaggcagaacgataaggcaagtcttggtttttattccccttgaaaaagatcgtttaataaatatgttctgtataaaaatacagtatattgaaaaataacaatggaagtagaggtgcagagaatgaagaaaagaatgagaatcatcttagctttaagtgttatgttattcttcttgacggcttgtgggcaagaagatgacaaaaaaatcacgctgaacatggcttggtggggttcgcaagtccgacacgatgcaacagtaaaagtaatcgagctttatgaagaaaaaaatccccatgtgacgatcgattatgaattttatgattatgaaggatattacacaaaattaggtacactagcagcatcagatgatatctgggacattttccaactgaacaatcaatttcctcaatacatcaatcagattgaaccattagatgaatatgtggagcaagggataattgatatttctaatgcagatgaatcctatttagcaacgacgacttacgacgggcaattagttggactgtctaacggggtgaattcgtttgcgattgcttacaataaaaatatatttgaacaattaaatatccctgaaccagcttcaaattggacatgggatgaatttgaacaaatcagctatcaaatcactgaagaattaggaatctatgctatttcaagattcgaagattttatagctggctgtattattcaaataccacaagttgagaaaggattgaatttttataatcgggaagatctatctaacagcttgggatttgaaaatccagactatctaacagattttttccagctgcgtaaaaatctggtagacaaaggggcccatccagaaccaggtggtggagctgcaagtacgacggatctgtcttttcaggcggttagggatagagaagcggcaatggtgtttctatcaagtaaccagttgacagaaatattgtcaggggctcctgaagatatggagattcagttgattaatccacctcgcagaaaagcagatggagaatctggtatccctttacgttcttcgcaaatgctgagtatggcaaaaagctcagcccataaagaagaagctgctaagtttattgatttctttcaaaacagtgaagaagccaatgaaattttaaaaggagaacgtggtgtaccaatcatgtcgaatattcgagaacagctcgctcgtgcagatgatgcaactttgcaagcgacatttgattatttagaaatgatttccgatatggacaacggcgaagtgaatgtctttgatagtgctttgaatccggaaattcaagaccaatacaatcttttagttgaaaaagtcatttatgaagaagtaacagcagaagaagcagcagagagtctttatgagtttgcgtcaaacattctaggatagcagcaggaggaaggcatgaaaaaagaaaaactaaaacggttcttggatcaagacaatgtggtcggttacgtatttgcttctccattcatcctaggatttctattgataacagtgataccgatgatcttgtcactttattattcgttcaccgattatcgtttgggaaatccagtctcatggatcggcttggataattatataaagatgctgagtgatgcccgttttttgaactccatccgagtcacttttctctatgtatttgcatctgtacctgtgaaactgatctttggtctattgattgcttatcttttaacgaggaatatcaaaggaacgactttctttcgttctttgtattatgtgcctagtttgatcggtggcagtatttctatcgctctagtttggcgggagttgttttctaaaaacgggttagtgaatattttcctggaacgattaggcgcacctgcgctttcctggtttagcgatcaaaaactggtcatgatccctcttgttttgatgtctgcttggcaattcggttcggcaatgatcatctttgctgcaggtatcaaagagatcccaggctcgtattatgaagcggcagagatcgatggagcgaacaaatggcagacgttttacaagatcacgttacctcttctttcgccgatcattttgtataacttggttatgcagacaatcgcggcgtttatgacttttacgcaggcatttatcattacccaaggtggtccgaatgatgccacgaacttttatgctctttatgtgtataaccaagctttttcttttaattctatggggtatgctagtgctatttcgtggatcatgctgttgattatgggagatgtcacctttctgattttcaaatcatcaaaaaaatgggtcgttgtgtgaatgagaggaggaagaaatgaataatacagtaacgaaatggtttcaatacggttttattttgctattaggtctagtcatgatttatccggtcttatggatgatcgcaggttcttttaaaacggatcaagagattatgagtggttcgctgaatttgattccagagacttttcaatgggaaaattacgcaaaaggatgggcggggtttgctggaatttcattttttactttctttaggaattcgtttgtcatctctgcagtttcgacgatagggacagttctgagctcgacttgtattgcttacgcattatcgagaatcgatttcaaaggaaaaagattctggttcgtcgtcatgttagtaacgatgatgattcctgcacaagtgattttgattccgcagtttattatttacaatcggctgaatttggttgggacgtatgtgccgctgattttaccacatttttttggacaagcatttttcatttaccagatcatgcaattcatggtcagcatccccaaagagttagatgaatcagcgattattgacggatgcagcaagtatagtgtctttaccaaaattatttttcctttgctgaaaccttcgatcatcacgacgatcatcatccagttttattggaaatgggacgacttcatgggaccattgatttatttaaacaagccgagatcttacacggtatcgattgccatcaaattatttgcagacgctggatctagtacgacttacgcgagtatgtttgcgatgtctacgttgtcgctgctaccggtttttctgattttcttattcttcaataaatatcttgtccaggggatcagtacaagcggtctgaagggctgaatatgaaaaagccaatagaagagatgtttctttacaagctcaactactatgtctgtcggatttttttaaccagtcttatcagtaatgctcttttcgctttagttctaggatgtttgttcactttaggattagtgctgtctgctcgtgttgtctatctgatttattttttgatgatgtatccttcttattatctatctgtccattacttggcagaaaaaaaggtatgttggaggaaaggaaaaatcaaacggatgtgtttcatcattacgttgtttcagctgtttgtcattatttttgcagttgattggtatttattagtgggaaagattggagcttggtatctgattccttttctattgtgtctgttgctttttgtatcccatagtttttttagtacgctaattgatatctgcaaagaagataaagcagatagtcttgtttatttgatcaaaaggaatatctggctgttgtcaaaaaacgtcaaggggtttctgtggtatttatgccttttgtatggactgttctggtgtatacagcatgattttttactcactgcattactgtatccagggctgccatttgtcacagtattttgcttaaaagaaaaggagaatgactttaaatgaagaaaaaatatgtacaagtcggacttggtgggagagcgcgttttttttatgaggcaattgcctctacgtatcatcaaacttgtgaactagtcggtttttgtgatgtatctcaaacaaggatggattatgcaaatcggatacttgtgaacaagtatggacagaaaaaagtaaagacatgtatgccatcacaatttgagcaactactggatgacgtacggccggctgaagtcattattacgtcagtagatcgaacgcatcatgattatatcattcgtgcaatgaaaaaaggatatgatgttatttgcgaaaaacctctgactatcgatgaggaaaaagctcaagaaataataacggtccaaaaacagacgggaagaagcctgcgagtcacttttaattatcgttatgcaccgtatcacacgaagataaaggaactgatagaaagtgatgtgattggtgatgtgttttctatccacttcgaatggctgttaaatacgcaacacggggcagattatttcagaagatggcatcgaaataagcacaatagcggcgggcttcttgttcataaatctacccatcattttgatctagtgaatttttggttgaacagccgtccccaaaaggtatttgcattcggtggattaaacttttatgggatgcataatgcggagaaacgcggagtagaaatattttacagtcgatgctatggaagcgaactagctaaagctgatccatttgctatagacctgtcagccaatgaggaattgcgagaaatgtatttagaagcagaaaaagacagtggatatattcgtgaccgcagtgtattttccgatgatatctctattgaagatacactaggcgtaacggtcaaatatgaaactggtgcgattttgacgtattcgctaaacgcgtatatgccgtgggaaggattcaatgtttctttcaatggcagcaaaggacggatcgaaatgaaagtgatcgaaaagtcttacatcaatgcaggtggagataaaaaggatgaaggagcagccgttcttcagtccatccatgtctatccgatgttcggtgagccatatgaggtaatcgtcgaacaagaagcgggcggacatggcggaggagatccgcgtttattagatgatctatttggtgaagaaaaagaagaagatccgtggaatcgggcagcaactcacgtagatggtattttgtcgattttgacaggaatcgcagcaaatcattctattgcttcaggaaaagcagtagtgattgacgagcttgtcagcttaaaagaataagaatagatttacggaaattacttcccgtagtttataaaatcttgccttattgccgataggctgtcttttgaacactatttattcggaaaaaggggctatgacatgctttttgtcatgccttctttttatgtgggctgcttttttagataggagaaaataaaaataactatttaaacccgaacaaaaaggaataatgcattaaaaatcattagattttacaaaaaaataagtaaaccacgttgtcagtttcagaaagtagtgttagactgttttcaatatttgaaacaacattttttattcaaatatggcaaactgccttcacgtgcaaaacagttgcaagaaaatgaatttacactattattagttttacatacctacttatatatcgtcataatatggatgacagtttctagccagtaccgtaaatgctggactataagtaaaagattggctatttcacccttcttttcttatgataaagtggagggtgtttttctttaacagaaacatagtaggtttttgcacaaaagcggttatttcggtattaataaatgataaaggagcaaataaagtgaaagaattagttgaacgtattcaaaaagacggacgtatattaggcgagggcgtattaaaagtcgacagcttcgtcactcaccaagtagaccctgtattgatggaacaaatgggaaaacggtttgcagaagtatttaaagaacaaggaatcacgaaagttgtgaccattgaagcttctgggatcgcaccagctttatttgctgcaagagaattagatgttccaatgatcttcgctagaaaagcaaaaagtttgacgatggatgaagaattattgacagcttctgtttattcttttacgaaacaagtgacaagtacgatttctatttctcgtaaatttttatcttcagaagacaaagtattgattatcgacgatttcttggcaaacggacaagcggcaaaaggattgatcgaattatgccagcaagctggagcgcaagtagaaggaatcgggatcgtcatcgaaaagtctttccaagatggacgtcagttacttgaagaaatgggattgagagtcgtttctcttgcgcgtattgcttccttgacgaatggacaagttgagtttcttgaggaggacgcataatcgtggaaaaagaaacacaaaatggaaaagctgcggttttagggctgcagcatctgctagcgatgtatgcaggagcagtagcggtgcctcttttgatcggtacaggactaggctttaatcaagaacagatgacttatttgatttcaattgatatctttatgtgtggattagcgacattattgcaattgacagttaaccgatttttcggaattggcttgcctgtcgttttaggatgtgcgatccaagcagtagctccactgatcttgatcggaaccaatgaaggagtaggagctatctacggatctattatcgcttctgggatctttgttgtgttagtttctggtgtcttttctaaaattaaaaaactattccctcctatagtaacaggaacggttatcaccgttattggtttgactttgattcctgtagcaatcgagaaaatgggtggaggtaatgcaacagcagctgattttggtgacaaaacaaatctgctacttgcatttgtgacgattctcctaattgtaggcgtgcaaatgctggcaaaagggttcattcgttcaatcgcggtattgattggtttagtcggaggaagcatcttagctgctttcatgggaatgattgatctgagcgcgattggagatgcgccgttgttccatgttccacaacccttttattttggtaaaccaactttcgacgtatggtcgattttactaatgatcatcatttccatggtcagcatggtagaatcaacaggtgtatattttgcacttggtgacattactgggaaaaatgttggagaagaagaattgaaaaagggatatcgtgcagaaggacttgccgttatcttaggcggtattttcaatacattcccttatactggcttttctcaaaatgtcggattggttcaactttcgggaatcaaaacaagaaaacccatctatttctctgcattcttcttgattgttttaggattattccctaaaatcggtgcgttagcacaaatcatccctgagccggtacttggtggaggaatgttagtcatgttcgggatggtggcagtccaaggaatccgtatgctgttggaagttgatttcagcaatgataaaaatctattgattgttgctgtttctgttggatttgggctgggtttcaatgttacgccgacattattcagtcaaatgccgcaaacattgcaaatgttcactggaaatggcatcgtaatgagtagcattacggctatcatattgaatttgatctttaatggattgaaaaaagatgaagaaatattggaagaagccttcaagaagtaatagagcaaaagaaaggttgtgaaatcagcgttttgacctgattgttagagaaacaaacggaaaaatagttcctcgtattttgccgtttgtttgagctaataccgagggtcagctgattgaacaccgttgaaggaagaggtcgtgagcctgccgttcatctccgagtcacaaggaacaatttcaaaaaaaagcttctcatgtttgttgaatattgttccttgtgaccgaggagttggcaggagaacaccgtttatccataaaaaggaatgtgacctaacttttgtcacattcctttttttatctttaataaacacgaacaataaaatgtttttctttgttaacattcgaaatttctttgacatcaaaaaaagtgattgttaaaatatgaatgtagaaaaactgggaggaaaaacaatgacagcaaaaatctctgtgattatggggagtacttcagattgggaaacaatgaaagaagcatgtcaaatattggatgaattcggtgtgtcttatgaaaaaaaggtcgtttctgctcatcgaaccccagatttgatgtttgaatatgcacaaaacgctcgaaaaaaaggaatcaaaatcattattgcaggagcagggggagccgcgcatctgccgggtatggtcgcatcaaaaacaactttgccggttatcggtgtaccggtccaatcacgaacattaaatggtttggattcgcttctttcgattgtccaaatgcctggaggagtacctgtagctactacagcaatcggaaaagcgggagcaattaatgctggactacttgcgatacagatgctttccatgtatgatttagaattggaggctaaattggctgaaagacgttcaatgttggctaaaactgttatagaaagtagtgatcaacttggttaaacctttgttgcctggttcaacgatcgggatcgtcggtggcggtcaattaggtcgtatgatggcgattagtgcaaaagaaatgggctttaaagtaggtgtgctggatcctgtgagcgattgtccagccgcacaagttgcagattggcacattgaaagtgtctatgatgacacctttgcgctgaaagagcttgccagaagaacagatgtcattacctatgaattcgaaaacgtcagtgtagaggcgttaaatgcgattttacccatgtcatttattcctcaagggacagacttgcttgcgattacgcaagaccgcctgttagaaaaatcttttttggaaacgaataacatcgtgattgctccttatgcaacgatcgtcagtccgacggatatccaagatgcgattgacgggatcggctatccttgtgttttgaaaaccactcgaggcggctatgatggcaaggggcagtatgttttgaaaagtcgggcggatctagctcctgccatggaccttttaagagaaggaacctgtgttttagaagcatggatcccgtttgaaaaagagatttcgatcatggtggcaggaaatggtcaaggagatttcacgacttttccggtcgtggaaaacatccaccacaacaatattcttcatgaaacgattgctccagccgcgattgatcaggatgtgatcgaggaggctgagcgtattgcccgtgtgattgcagaagcagtgagcctttcaggtgttttaggggtagaaatgtttttaacaaaaacaggcgggctatatgtgaatgaattagctcctcgtcctcacaattctggacattattctattgaagcttgttctatgagtcagttcgatgcccatattcgaggtatttgtggttggccattaggagaaaaagtacgtttgataagcaatgcagtaatggtcaatgttttgggagaacaactgctggaaagctatcgcttgattgagaataagccagactggcaattccatttctatggaaaaaaacaagcaaaaaaaggtcgcaagatgggacatatcactatcttgacagaagacatccagcaaacgctggaagaaatcaaacaaacgaatatttgggattagaggagaaaaaacatgttagaacgttatacacgccctgaaatggggaatatctggacggaagagaacaaataccgtgcgtggctcgaagtcgagattttagcagatgaagcttgggcagaacttggtgaaatcccgcaagaagatgtgaaaaaaattcgtgagcatgcatcatttgatatcgatcggatcttggaaatcgaaaaattaacacgccatgatgtcgttgcgtttacacgagcggtttctgaaacattgggagaagaaagaaaatgggtccattatggtctaacaagtacggatgtcgtagatactgcttatggctatctcatcaagcaagcaaatgatattttacgggaagacttgaaacgttttacggaaatcattggcgaaaaagcaaaagaacacaaatatacagtgatgatgggtcggacacacggtgtccatgctgaaccaactacttttggattgaaacttgccacatggtattcagaaatgaaacggaacatcgaacgatttgaacatgcggcaaaaggagtagaagcaggaaaaatctcaggagcagtgggaacgttcgcaaatatcccgccatttattgaagagtatgtatgtaaacaattggggatccgtccacaagaaatctctactcaagttctccctcgggatctacatgctgaatatttctcagcgatggcgcttattgctacaagtattgaacgttttgcaacagagatacgcggattgcaaaaatccgaaacacgtgaagtagaagaattttttgcgaaaggtcaaaaaggttcttctgctatgccgcacaaaaggaatccgatcggttcagaaaatatggctggtctagccagagtggtgcgcggacacatggtcactgcctatgaaaatgtcacattatggcatgaaagagatatttctcattcttcagcagaacgaatcatcttgcctgataccacgattttattgaattacatgttaaatcgttttggcaatatcgttaaaaatctaacggtctttcctgaaaacatgaagcggaatatgtctgcaacatttggtttgatttatagccagcgcgttatgctgaaattgatcgataagggaatgacaagagaagaagcttatgatcttgttcagccaaaaactgcgtacgcttgggacaaccaagtgcagttccgcccgctgttagaagaagatccaaccatcacatcggtattatctaaagaagaaatagacgatgcctttgattatcatcatcatttgaaaaacgttgacgtgatattcaaacgagtaggtttggaataaagaagagtgagttgcaaaattcaattaaaatagaatagcaaaaataaccaaaaaagaagcagatccgttagcggttctgcttcttttagtttattatattttcttatcaataataggaacctgattttaaaagcggctacctctttaccgtgcctctttacatacaaaaaatagaggaattaagcgtaaatggcttggctattataactaaaatgctggttatggagatgttgcagcaagttttcgagaaaagcgtattccatctcttgtccattgaataagatctggatacgataatgatttttgaaacgcttctgttcatgaatctgactgattgaaagttcgcctttgtgttctgtctgataaagaaaagtccttttacggcattcagcacagcgcttggttgctcggcggatttttcggaatgtataaaaactagtatctttattgcataaataaacgtctttgatcgacagcaaatcattatatagacaggaacgttcttcagctgttaattctgataaaaaaagctgaccttgttttattgcatcttccatcggcaagtgcctcctcgaacccattatccaaatttttagttaattctaatataccatcattaagtataaatgtaaacgcttgttgatggtataagattttcgtttctgataaaacacgaacattaaaagaatctaatgccttaaatgtacatatttttgttgatttataaaaagatgattgctaaaatttaaagtgaaaaaacgaacaaaaaacgatgtatttgcttttaatgtaaataaaaaggagagacgtacatggagaagaaagaacttttgtatgaaggaaaagccaaaaaaatatatcttacttctgatgagaacttgatttggatagaatatttagatcaagcaactgcgttgaatggcgcgaggaaagaccagataagtggaaaaggagaattgaataatcaaatcacaagtgcaattttccgttatctgactcaaagaggaataaaaaatcattttattgaacaattgtctaaaaccgaacaattagcaaaaaaagtacaaattatccctctggaagtggttatccgaaatattgcagcaggaagtttctcaaaacgtctaggtgttcccgaaggtaaagaattcatcaaaccaatcattgaattctactataaggatgaccagttggatgatccatttatcaatgaagagcatatctatttcttacaacttgcaaagccggaagaaatcagtgagctgaaagcccaagcgttggctattaatgaaattttgaccgaattatttgctaaggtcggtttggttttagtagatttcaagctagaatttggccggtcgaatggacaaattttgcttgcggatgaagtaacaccggatacttgccgattatgggatgaacgtacgaatgaacatatggacaaagacgtttaccgcagagatctaggtgatttgatcccagtctatcaagaagtatataaccgtctatcggaactaactgaagaaaaggagcgagtatgatgtatttcgtaaaagtatatgtaacctataaagattcagtgttagatcctcaaggggaggcagtaaaaaaagcagtccatcgtatgggatatgaaacaatcgaagatatccgaataggaaaatactttgagatacaacttgctgatgcagaagaaccaatcgatacagtgattgaaacgatttgtgacaagctgcttgcaaatgtaaatatggaaacataccgatatgaaatcaaaaaaatggaggaagtataacatgaaatttgcggtcatcgtttttccaggttcaaattgtgacgcagatatgttatgggcagttcgcgagatcatgggcgctgatgccgaatttgtacggcatgatgagtcctctttagaaggatttgatggggttttactgccgggaggattctcctatggtgactatttgagatgcggtgcgattgctcggttttctacaatcatggaagaagtgattcgttttgctgaagaagggaaaccagtattcggtacatgcaatggattccagatattgacagaagcaggacttttgccaggtgtactgagacgaaatgagtctttgcattttatttgcaaaactgtaccattgaaagtcaaccccaagacggcctttacttcagagtatgaagccgacgaaataatctatcttccagttgctcatggggaaggaaattatttctgtgacgaagaaacacttcaagaactaaaaaaaaataatcagattgcctttacttataatgacaacatcaacggcagcgtggaaaacattgcagggattacgaacaaagcagggaatgtgttaggaatgatgcctcatccagaacgtgcagtagaagacttgctaggatcagaagatgggaaacggttctttgcttccattttaaaaaacttcggaaaggtgaccgtatagatgaaaacattgaaagaaccgacagctgaagagatcaagaaaaaaagaatctatgccgaatggggattgactgatgaagaatatcgaatgatcgaagaagatatcttaggaagaatgcctaattatacggaaactggactgttttctgttatgtggagcgaacattgttcctataaaaattctaaaccggttctacgcaaatttcctactagtggacctcatgtgttgcaaggccctggagaaggcgcaggcatcgtcgacatcggtgatggactagcagttgtcttcaaagcagaaagtcacaatcatccttcagccgtggagccttatgaaggagctgcgacaggagttggcggaatcatcagagatattttcagcatgggggctcgtccaattgcgttgctagattcattgaggttcggcgaattagataatccaagaacgaaatatttactagaagaagtagttgcaggtatcggcggatacggcaattgtatcggcataccgactgtaggcggcgaaattgcatttgatccttgttatgaaggaaacccattagtcaatgcaatgtgcgtaggtttgattgaacacaaacatatccagaaagggcaagccgctggcgtcggtaattcgatcatgtatgtaggtgcaaaaacaggtcgcgacggtatccacggagcaacttttgcctcagaagaatttaatcaagaagaagaacagcaacgttctgctgtacaagtaggcgatccttttatggaaaagctgctgcttgaagcgtgtttggaattaatcttgcatcattcggattctctaataggtatacaggatatgggagcagcaggacttgtttcatctagtgcggaaatggcttcaaaagctggctcaggacttatattgacattagatgaagtcccacaaagagaaactgggatgacaccttatgaaatgatgttatcggaatcacaagaacggatgttgatttgtgttaaatcaggagaggaagaaaaaatccaagaactatttcagaagtatgatctagatgcagtcactatcggtaaagtaacagacgacgggcaatatcggctatatcatcaaggagaagaagtagcaaatctgccagtcgatgcattagctgaagatgcaccagtttatcataaagaaatgaaagaaccagctcgaatcgtagaatttcagcagttagctccttatcagccagttatcgaagaacctggacaagtattgcttgatctgctgcagcaaccgacgattgcttcaaaacgttcaatctacgaaacttatgattcacaagtacaaaccaatacagttgtccgtccaggaagcgatgctgctgtgatgagggttagagggacgaataaagcgttagctatgaccacagactgcaacgcgcgctatctgtatttggatccaaaaatcggaggacaaatagcagtggcagaagctgctagaaatattattgctagcggtggtaagcccttggcgatcaccgactgcctgaactatggttctcctgataaaccagaagttttttgggaattatcgacttcagctgacggaattgctgctgcgtgtgaaacgttaggaactcctgttatttcaggaaatgtctctttatataatgaaacggatggtcaagcaatctatccaacaccaatgattggtatggtcggattgattgaggatcataaacatatcactactcaggaattcaaaaaatcaggggatctaatctatatattaggtaagacgtttgcagattttgatggcagtgaattacaaaagatgcagcttggaagaatcgaaggtgtgatccgaaactttgatctatccattgaaaagagaaaccaagagttagtattgacagccatccaaaacggattgattgaaagtgctcatgactgttcagaaggtggcttggcaattgcactggcagaatcagctttcaaacatcagctagggatatctgtacagtttgaattgtcctctgctcaattatttgcagaaactcaatcaagatttgtgttgacagtcgcaccggaaaataagacacgattcgaagaaatgatgggagatgctgctgttttagcaggtaaggtgacggatgaagcgataatcgaaatttcagcaactgacggtcagatcaaaatagaaactgcagtagcaagaaagtgctgggaggatgcaatcgtatgtcttatgaagtgaagagtttaaatgaagaatgcgggatcttcggtgtttggggtcatccagacgccgctagtgtggcatacttcgggctccatagtcttcagcatcgaggacaagaaggtgcaggtatcgtgtccaatgatcgaggaaagcttaaggggcatcgagatttggggctgctttctgaggtattcaaagatcaaagaaaattgcagcagttaacaggagaagctgcaatcggacatgtacgttatgcaacagcaggcaatggaagtgtggacaatattcagccttttctattcaaatttcatgatcagtcgatcggcttagcgcataatggtaacttgatcaatgctcgttcccttagaaaagagttagaggaaaatggggcgatcttccattctaactccgatacggagatattgatgcatttgatccgacgaagtgaagaaacagattttttaaataaattaaaaagtgctttgaatgaagtcaaaggtggctttgcctatttattaatgacagaaacggcaatgattgccgctttggacccaaatggttttcgtccattagcaatcggacaaatgaaaaacggagcatacgtgattgcctcggaaacttgtgcattagaagttattggggcacgttttataagagatgtccagcctggtgagatagtgatcatcaatgacgaaggaatccagattgattgctttacgaaggacacgcagctttctatttgttcgatggaatatatctattttgccagaccagattcaaacatcgcagggatcaatgtgcatactgcacggaaaaatatgggacggaatttagcgaaagaatcgccagtaaaagcagatatggtcgttggcgtacctaattcttctttgtcagccgcaagcggttatgcggaagctagtggaatcccttatgaaatcggattagtaaaaaatcaatacattgcccgaacatttatccagccaacgcctgagctaagagagcaaggtgttcgaatgaaattatctgctgtacgaggagtagtggaaggtaaaaaggtgattatggtcgatgattcaattgttcggggtacgacaagcagacggatcgtccatcttttgaaagaagcaggggcaaaagaagtccatgtgaggattgcttctcctcctttgaaatatccatgtttttacgggattgatattcaaacgcgtaaagaactcattgcggcaaatcacacgattgatgaaatcaaagaatgtatcggtgcagattctttaggttttttaagtgaagagggtctgatcgaatcgatcggtctggaaaaagatgctccgtattcaggattgtgtatggcttatttcaacggagattatccgacgccgttatatgactatgaagaaaaatatcaggaatcactaaaagaaaaagtatcgttcttttaaaagcagaccaagaagggagtatatgaattcaatggcaaatgcatacgcaaaagctggcgtagatgtcgaagctggatatgaagtagtagaacggatcaagaagcatgtcaaaaaaacggaacgtttaggtatgatgggcgctataggaggattcggcggttgttttgatttatcggtctttcaattaaaagagccagtccttgtctcggggaccgatggcgtggggacgaaattagcagtggcaatcgaagcagacaaacacgatacaatcgggatcgactgcgtagcgatgtgtgtcaatgatatcttagcacaaggcgcagagccgttatatttcttagactacttagcaacggggaaaaatgatccgttacgtttggaaaatgtagtaaaaggtgtagcagatggatgtgttcaaggaaatatggcgctgattggcggagaaacagctgaaatgcctggtatgtactcaggtaatgattatgatctagccggatttgctgtagggatagctgaaaaatctcaattattgacaggagaaacgatcaacccaggagatgtgttgcttggaatagcatctagcgggattcattcaaatgggtactctcttgttcgcaaaattttctttgagcagcagcagttttctttatcatcaaaactgccagaattgaaaaaaacacttggcgaagaattgcttgagccaacgaaaatctatgtttcttccttgcttccgctgatcaaagaaaagaaaataaaaggagctgcacatatcactggtggagggtttgtagaaaatatcccgcgaatgttaccagaatctatggctgcacaaatcaaacttggctcatggccgattcttccaatattcggctgtttacaaaaatatggtgaaattcctgagatggagatgtatgaaatcttcaatatgggcatcggtatggtcctggcagtcgaagaatcgaaagtaaaagaaatagtacacgaaattgagcaagctggcgaaaaagtttatgaaatcgggaaagtgatcgccaaagaaaaacatcgtgtggtgtttataggagaagaacgatgagaatcgctgtttttgcttctggaaacggaagcaactttcaagcgctagccgattatctatcgaaaaaaggattggaatcttcgattgactggttgttttgtgatcagcctgaagcatatgttttgaaacgtgcaactgcgttgagtgtaccggcagattgtttttcacctaaagaatttgattcaaaaaaagagtatgaagaagcaattttgcataaattgaaagaaaaaaagatcgatttgatcgtattagctggatatatgcgaatcattggaccggtattgctgaaaaattatgataaaagaatcatcaatatccatccgtctcttttacctgccttccctggtttgcatggcatacgtgatgcctttgaagctggagtaaaagaaacgggtgtcacaattcattatatcgaccaaggtgtagatactggaccaatcatccggcaggaaaaagtgagaattgaacaggaggacacgttcgattctttagaagaaaaaatccatagagtagagcatcgaatctatccagaagtgattagtgaaattattgaaaatggaggctatctgaaatgacaagagcattgatcagtgtatcagataaaactgggattgtagcattcgcccaaggtttgattgaacaaggagtagaaatcatttcaacaggaggaacaaagcatgcgttggataaagctgggatcaaaacgctttcgatcgaagaagtgacagggtttcctgaaatgatggatggccgtgtcaaaacacttcatcctaaaatccatggtggtcttttaggaagacgcgatctccctagccatatggaggcaatggaaacggaaaatatccaaccaatcgactttgtttgtgtcaatttatatcctttcaaagaaacgattatgaaaccagatgtcgaaatagcagaagctattgaaaacattgatatcggtggtcctagtatgctccgtagtgcagcaaaaaaccatgaatttgtcacctctgttgttgatccatctgactatgaagaagtactttcagaattacgtcagtatgggcatacttcactttctttcagacaaaaactagcggcaaaagtctttcgtcatactgcggcatatgatgcactgatcgctcaatacttaacggattgggtggaagaaaaagaaccggaaaaattgacacttacgtatgaacgaaaacaaacgcttcgttacggtgaaaatagccatcaagccgctgccttttatcagtccgctcttctggaaaaatattcgatcgcagcagcaaaacaactccatgggaaagaactttcttataataatatccgagatgcagatgctgcgctacggatcatgaaggaatatgacgagccaacggtagtcgccttgaaacacatgaatccttgtggtattgggacagcatctacgattttagaagcgtgggaagcagcgtatgaagcagatcctgtttcaatctttggtgggatcatcgttttgaatcgagaagtagatctgccaacagcagaacagatgcataagctgtttctagaaatcatcattgccccttcttatacacaagaagctttggaattactgcaaaaaaagaaaaacatccgattactgacagtagactttgcgcaggaagaaaatcaaaatcgagaagaaacggtctcagtcttaggtggacttcttgtacaagatcaagatctggcaatagaaaatgaagaagagtggaaagtcgtgacaaaacgtaagccgactccagcagaagcaaaagcattagcgtttgcttggagagctgtcaaacatgtgaaatctaatgcgatcgtactggcaaacgaacgtcagacagtaggaatcggagccgggcagatgaatcgagtcggttcagtaaaaattgcgattgaacaagcgcaagagaaaatggaaggtgcagttttagctagcgatgcttattttccaatggatgattcggttgaatatgcagccaaacatggtataaaagcaatcattcagccaggaggaagcatcaaagaccaagattctattgatatggcgaataaatacgatctagcaatggtctttactgatgttcggcattttagacattagagaggagtcggataaatgaacattttggtgatcggtgcaggtggtcgtgaacatgcaataagtaaaaaacttttagccagtccgaaggtggatacggtgtattgtgcgccaggaaatccggggatgacaaaagatggtatcaattgtgtcgctatcagtgagcgagatcattcagcgttaatccattttgttaagaaagaggctattgattggagtatcgttggtcctgaagttcctttgttaaatgggatcgtcgatgattttatggcggaaggattgaaaatcttcggtccgacaaaagcagcagctctgatcgaaggttcgaaaagttttgctaaacaattaatggatacttatcaaatcccgacagctaaatccagaagttttgaatgttacgaaaaagcagcagcgtatatcaaagaaaatggtgcgccaatcgtagtgaaagcggacggcttagcagctgggaaaggtgtagtcgtggctaccacagtgaaggaagcgctggatgcggcagaacaaatgttgaaccagcatcgatttggggatagtagcaaaaaaatcgtcgtagaagagtttttggcaggagaagaattctcccttttggcgtttgtccgtaataccaaggtgtatccgatggtcatttcgcaagatcataagcgggcatttgataacgataaagggccaaatacaggcggaatgggtgcttattcaccagtaccgcaaatttcaaaaaagatgattgaaaaagctgtggaagaagttttaaaaccagcggctttgggaatgaaagaactaggacgctctttcacgggtgttttatatgcgggtttgattgctacgaaggaaggaccaaaagtgatcgaattcaatgcgcgtttcggtgatcctgaaacgcaagtcgttctttctcggttgaagagtgactttgcgcaagtaatcgatgatttattagagaatcgtacagtagagttaaagtggcagcaagaaggatacaatgtaggcgttgtggttgcagctgccggttaccccgaagaatatgagacaggaatggttctaccagattttctggaagaagagctttctgtttactatgctggagtttcctcaaataacggcaaactagttggagcaggaggacgtctttatttagtagaagcatacggtgagacgatcaaagaagcacagaaaaaaatttacaccgcgttaatggataaaacgacagatggaacattttatcgtacagatattggagaaaaagctgccaatagcgaactgatcgtgaagtaaatcagctgcttccatttataaaaaatacaacaaacataatcggaagcgccgattttagtgaagccttttcataaagagtgtggtacacttttgttgtgtatataaataaggaggagttcagatgaaaaaaattcaattaggtacttctgatcagaaagcagctgcagtgatcttaggctgtatgcgtatcaacaatgcggaagatccagtaaaagtgattgagacagcttatgaaaacggcattgatttttttgaccatgcagatatttatggaaacggtgaatgtgaagaaatctttgcagatgctctagcaaaaacatcaatcaaacgagaagatctttttattcaaacaaaatgtggaatcgttccaggtgtgatgtttgatttttctaaaaaacatatcattgaatctgtagaaaaaagtttgacccgtctgaaaatggattatgtggatgctttacttcttcatcgtccagatacattggtagaaccagaggaagtagctgaagcgtttgatgaattggaacggtcaggaaaagttcgttattttggcgtcagcaatcaaaaaccaatgcaaatcgaattgctgaaaaaatatgttcgtcaaccattagtagctaatcagctgcaatttggcttgaaacatactggaatgatcgatcaagggattcatgtcaatatgacagatgaagcaagtatcgatcatgacggtagtgtacttgattattcccgattgcatgatatgacgatccaagcatggtcaccataccagtatggattttttgaaggtgtatttatcgggaacgaaaaattccctgaattaaaccaaacattagaagaactagcagctaaatatcaaacgacaccaactggcttggcttctgcttggattttacgccatccagccaatatgcaagtgatcgccggtacgatgaacgtagggcgaatcaaggaaatcgctcaagcttcagaaattaatatgtctcgggaagattggtacgaattgtaccgtgctgctggaaacattttaccttaaagattgtcataagcaggtcaaaagggctataaattaaaaagacagaataacttgaaagctgttttcagcttcgagatattctgtctttttttattgcaaatggaaagagtatcattgtacggatttcgtttattagttatttttgtttttaaggaaaagctgtgtccgatattcttttggagaaatcccttgttttttcttaaataaataactgaaatagttagggtcattataaccaatttcaaaagcaatatctgaaatacgatagtctgattgctgcaataatttttttgctaattcgattctttgttctgtcagataatcgatgaatgtttggttaaacgattgagaaaaaatcgtactgaaatgagagggacttaatgcaacttgttgagcgacccaagttaaggacatatctggatcggtaaaattttctttgataaaatccaatgcatggttcaaaattggctgatatttgttccttgaaggctgtgagggcagagcagttaagaaagaaatgaacatataaactgtcgaacggtaaagcgagtcgtcggcgctgattgctaagcgttgactggtggatgtgcaatgaaccatttcttgcgggattttcttttctttcaggcagacatgctggagtagcttagtcaagacaaataaacgatataatcgtgttcgagttggtgtgccttgtggtttcgtcaagtgttcgatgtacttagatacttcgtttttcgataatgaagacaaatcaagtgagaggtcaaagtaaaagacagaatcaactggaagtttcgcttcttgaatcaaatcctcatagctgataatttgttctttaagggaactggcggtttcaagtatcatctgcgtgatctcaaaagatgcaggtaattcgctgattctttctgcgacaggaccaatggcgacagaaaaattatttttttgtcccttttctaattcatggaccaacgtttgggctacctgataactggtctcgatcacattttcttcaagagaatcaactattaaaaatttgatgaatcgagaggaaacagcagagaagatcacttgttgattctccctaaataaaaacttcaaataatcactgagatgagcgtaatcttcaaagtctgtactgacttggtttgctgctaataatacggtcatttttttccctgctaaagagcgattgaaagattcagcaagtttcaatgtttcactgatcgtaagtgagcctttgaacaaaccgttcaagaaatgattttttttcaattcgaaaacaagatcagaagaagtgtgcgtttctttttgctgcaaatctaaagcagttactgctttttctattgcttgtttcaattcgctacttttaatcggtttaagcagataatcatctgcctgtacctggattgctcctttcatataatcgaaatcgtcgaatccactaataaatatgagacgagtccaaggaagtagtttccttgcttcttttgaaaaagtcaacccgtccatgaaaggcatttggatatcagtcagaatgatgtcgggctgtaagtcgataattgaagacagtgccatctcaccatctccagcttcgccgacataagtgattggataataagaaccaaggacagttatttgttcccgcaagttattgcgaatgaggtattcgtcttcgatgataaaaactttatacatgtttgtttcctccaattgttttgggagatagagggatcatcagtgtgacagttgttccttctcggtatttgctgtcaatcgtgataggtttttgatcatttccgtaataaagaaggagacgcttgtttacgttgtaaagtccgtagccgatactgaaatctgaatcgatccctttggctaactctttacgtatttctgccagtttttctgcagggatgccaatcccgttgtctataactttgaattggatcatctcatcaattttgcatgtggtaatacgaataaatcctttgtgacggacgtacttcgttccatggtatacagcattttcaatcaatggctgcaagatcatttttaaaatagaaacaggaaaaagtgtttctggtatatcgatcttatagtcaagcatatggccgtatcttatttttaagatgactagataatcattgatatggctaatttctttttcaagaggaatccagtcttgtcctttgcttaaagacgtacgaaaaaagccggaaagtgcatgggtcatagtcagagcttcttcaaagcagtcttgttcgatcaaagaaataatggcatccaaactgttataaataaaatggggagtaatctgagcttgcaatacacgaacttcactttgtgctaaatggtattgtttcaaagcgttctcccgtaaagactggtttagatcttccgccattttattcatgctagcggtaagtgtttgtaattccagtgtttccggcagggttaaacgaaagccaaggttccctgaagaaagttgttctgacatctcgatcagctgattgatcggttcttggacctttctctctaaaaagcgacgattctttttcgcatagaaaaaaatggtactaagaactccaagttccactattgttaatagaatgagcgagcggacaagtgtcgtattttttttgcttgctaagtcgatctccacacgaacaaaatcttgtaagatatctgacagcagttgagtgacagaatctacctgattgatgatctcttcattggtatccataaaatcttttgccaagatattattgatcagctcgttttgataatcttccagtgtatcgatcgtacgtagcgatacatctaacgtactaatttctttaagtgtatttgtattatttttgatctctcgaatatcattcctaagttcttctaggatattttcctcattgaactcatctacggttacttggccagaaatcaagtcccacatactttccaaaactttttgatcaaccttcaaagcaattgcatctgctttttggatatttgcgatcgtctgttgataaatcaaaagctgttgcgaatataacagtatgctcagtagcaaagggataacagcaaatagaagcatggctttgtttgcttgggcaaaaatctgttttatgcttaaattttttgtcatgatacttctccagtcaataatttctggttgggatgttagctatattctgctgggaaaagacagtctcggaaataaaaatatctttaggtaatgtttttcctgtttgaatatttccaaaataacgagtaacggtattggctacataccagccgacatcaggtttacactcgactacacaattgacgattcctgagcgtagcttctcgatcatatcttcttgtccatcaatagttacaatgatcaaatcttctccaggtttgattgatgtttcttttatcgcagctaaagcaccgtgagtcatttcatcactatggctgtataatacatcgatttcggataaatcatttgtttctaaatatcgtttcatctggtcttttcctttcatccgaataaaatcaccgacaattcggtgaacaatagtcatcggaggtttatggtcgatggttccatctttttttagggttggtttacgattgattgattccaaaaatccttcggagcgtagcttggtcggtgtggagttctctgaaccagcaagttctaggattctgatttcctgtttctttgaatttgtgaagtgattgctgacaaataaacccgcccgatttccttctgctttgaaactggggccaatgtgggtgacgaaaagctcgggatcattcgtttgaatatgtctgtcgacaagtatgacagggatccctgctcgctttgcttcttttaatacagagtcccacccggattcttgcaaaggagtaaaaatgatcatatccactttataggcaatgaacgtccgtatatcttggatttgccgttcctgattcatgtagccatttcggtagagaacttggtaatcttctttttcaagcgcagtgataattgattcagtatgctttttccgccagctactctccgttcctgattgcgaaaaaccaacgactagtgggtcaggtgcttcctttgtattaggtgtacaccccatcatttggtaagcgattacaacaagggctaaaaaaaataaaacacgtttcactttaaatcactccatctggatttgttagtactatcttatcagataaaagggaaaatcaaagtcaaaaggaatcaatcgaaaaaaatccaagaaacttaaaaaaatccaagacaaaaaaagtacacctaaaaaatttaaagtaaatcccataaaaaaatcaatgttaacgctttctttattagctatactcggtgtatcaattgaaatgggggataaaaaatgaaaaacaaatttagaaagattgttgggactatcgctattttgaccgcaagcattctattaagtgcgtgtggcaattcaggatctgcagatgatagtacggggtatgtaggaatcgctatgccgaccaaatcagcagaaagatggatcgctgatgggaacaacatggtctcggaattagaaaaactgggttataaaacagatcttcaatatggagaagataaagtagaaaatcaagtagcacaaatagaaaatatgattacaaaaggggtagatacacttgtgattgcttctatcgatggttcggctttaactgatgtgttagctaaagcaaaagaagcagatatcaaggtgatcgcctatgatcgtttactgatgaattcagaaaatgtcgattattacgcgacttttgataattttggagtaggtgtatcgcaagcagcttatattgaagagcacttaggattgaaagaaggaaaaggaccattcacgattgaattatttggtggctcgcctgacgacaacaacgcactaatcaattacaacggagtgatgtctgttttacaaccatatatggacaacggtcagttggtcgtgccatctggacagacgagtttcagtcaaatcgctacgcttcgctgggatggttctacggcgcaagcaaggatggataatctgttaagcgcaaattatactgaccaaacattggatgctgttttgtcgccatatgatccaataagtttaggaatcatttcgtcattaaaaggcgtggggtatgggagtgaaagtaaacctttacctgtgattactggacaagatgcgacagttgctggcgttaaatcgatcattgccggggaacaaacacaaacgatctttaaagacacacgtatcttagcaaaaaatacgattgaaatgatcaaagcaatcagtgatggagaagaggttccggtcaatgatactgaaacttatgataatggggtgaaaactgtccctacgtatttagcaaatacagtatctgtcgataaagataattatcaagcagagctgatcgacaccgattattataaagaatccgatctgaaaaattaagaggaaccaaacaaggaactaaagagatctaagtcagagagaggataagaattatggcggattgtattttaaaaatggcagatatcaccaaaaaattttctggaatccgagcgttagattgcgtgaatctgatgattgaacgtggggaaatccatgcattgtgcggagaaaacggagcgggaaaatcaacattgatgaatgtcttgagcggcttgtatccatatggctcctatgacggggaaatcttttatgatggaaagctgtgtcaatttaaagatttgaaagatagtgaagaaaaaggcatcgtcatcattcatcaagaattagcactaagtccttatctttcaataaaagagaatatttttctcggaaatgaacaagcagaaagaggcgtgattgattgggaactgacagaaaagaaaacatatgaactgctgaataaagtcggtttgtctatcgacccgaatcttctagtatcccagattggcgtagggcaacagcaactagttgaaatagctaaagcattatcaaaatccgtccgtctgttgattttggatgagcctaccgctgcattgaatgaagaagaaagcgcgaatttgctgagattgatccgagagttgaaagagcaaggtgtaacctccatcattatttcacataagctgaatgaaatcgtggatatcgcagatcgaatcaccattttacgggatggacagacgattgagacactagaaaatgaaatgatcagcgaagagcatattattcgcggaatggtgggcagagatttagttgatcgttatcctgaaagaaaaccggatattggagaagtttattttaaagtagaagactggacggtctatcaccctcttgatcacgagcgaatcataaacgaccacatcaacttgcatttgaaaaaaggagagattgtaggaatagctggactgatgggagcgggcagaactgaattcgctatgagtctatttggacattcttatggaagcaagatatccggacgtatattaaaggaaggggcagagatatcagttaagaccgttccttcagccattgcaaacggactcgcttatgtctcggaggaccgaaaatctttaggactgaatctgctgatggatattcgggaaaacgtgacgctgagcagtttggataaaataagtcaaaaaggagtattagataaagaaaaagaagtaactgaggcagaaaatttccggaaaaagatgcgtataaaaacaaactccatccatcaaattgtcagtagtcttagtggtgggaatcaacaaaaagtcgttttatccaagtggctgatgacacaacccgatattctttttttggatgagccaacccgtgggatagatgttggggcaaaatatgagatctacacgattatcgaagaaatggcagcaaatggcaaagctgtctgtcttatctcttctgaacttcctgaaatattagggatgtgtgatcgaatctatacgatgaacgaaggacgtattacaggagaagtctcgcgagaagatgcagatcaggaagtcttgatgaaattaatgacgaaagaagaggtgggttaagttggaacaggcaaaaaatcttacggataaaaaagagaaaaaactaaatttgaaaagtagagcagctgatctttttggtcgctacagcatggtgatcattttagcgggactacttattgcgtttcaattgatgacggatggtattttctggcgtccattgaatataactaaccttgttctgcaaaatagccatatattagtactagctgcagggatgttattagttgtgctcttaggtcatgtggatttgtcggtagggtcagtgatggcgtttgttggtgcaattgcgggcatgatgatggtcaatcgccaaatgaacccgtggatgacagttatcgcatgtcttgcagtaggcgggctgatcggcgcatggcaaggtttttgggtagcttatgcagggataccggcgtttatcgtgactttagcaggattgctgatgtttcgtggactgacacaagttgttctaggaggccaatctctagcaccttttccagctgttttccaaaaaatgtctacgggttatttaccagacttaagcgaaggaagcagccttcacttcttgacattgattttaggaatgatcatcacgatcgtgttagttgttggtcaatggcgaacaagaaatcgtcggaaaaatcatttatttgaagtggaatctccaacagctttcttggtaaaggcggtatttacagcagtcgttgtactaggaataacttatatctttgcctcttatcaagggtatccgattattttgatcattcttggtttgatcgttgcagcatatgggtttttgacaaataaaacagtagcaggtcgacagatttatgcgacgggcggaaatcgaaaagcggctgaactatcagggatcaaaacaaagcgaatcacgttctgggtattcgtcaacatgggagtcatggcagctttagctggattagttttagctgctcgattgaatgcggcaacacctcaagcaggtacatcgatggaactggatgcaatggcggcagtatattttggtggtgcttcgacttccggcggcattggaacaatcatgggtgcgattgtcggtggcttggtcatgggtgtattgaacaatggcatgtcgattttaggcgtcggggtagactggcagcaggcaatcaaaggattgatcttgcttttagccgttgtgctagacttgtataataagaaaaaacgaacaacgtaggagaacgccggttattcagaaaaaagactgtgacaagacatttgtcacagtctttttttcgctaaaagcgaacattcattgtttcgtttgtatagactaaaaataatatatgtttttttaccattcgtataaattctctttttgctcttgatttttttgcttaattgagttaaattacatagggcgctaaaaaaagccttgattaaattaataatgttcgtgttttgctggatgtgaacatcaggaggataatgtaatgaaagtatttgattacgaagatattcaattaattcctaataaatgtatcgtaaatagccgttctgaatgtgatacaacggtcacattaggtaaacatacattcaaaatgccagtagtgcctgccaacatgcagacgattattgatgaaacaatcgcagaattcttagcggaaaatggttatttctatatcatgcatcggtttgatgaagcagctcgaattccgtttatcaaaaaaatgaaaaagcgtggattgattacctcgatcagtgttggcgtcaagaaagaggaatattcctttatagagaagttggcagaagaatcgctaaatcctgattatatcactatcgacatcgcgcatggacatgctaactcagttattgatatgattcagcatattaaaaaatatttgcctgaaacttttgtgattgccggtaatgttggtacaccggaagccgtccgtgaattggaaaatgcgggcgcagatgcaacaaaagtcgggattggtccaggaaaagtatgtattacaaaaatcaagacaggctttgggactggaggctggcaactggcagctcttagatggtgtgcgaaagcagctcgcaagccgatcatcgctgacggtgggatcagaacacatggcgatattgcaaaatctgtccgttttggtgcgacaatggtcatgattggttcattgtttgccggtcacgaggaatctcctggcgaaacaaaagtcgaaaatggaatcgtgtataaagaatactttggttctgcttcagaattccaaaaaggcgaaaaacgaaatgttgaaggaaagaaaatctggatccaacacaaaggatctttgaaagatacactagtggaaatgcaacaagaccttcaatcatctatttcttatgctggaggaagagatctggaagccattcgaaaagttgactatgtcatcgtgaaaaattcgatttttaatggagacacaatctaaaaaataaataaaatattaggatgttgtgaaaaagttgtcctgcattaagtaataagaacagccaaacaaaaatagttctttatatgttttgtttggctggaattattatcgcagatacaagcttttgaacatcattattcagaataagggactgtgataagatttttgtcacagtcccttatgttttgcaaaaaaagtttttcttttttctcgtaaattcggtaaaatcaaaagaaaaaatagacaatagaaaagagaagcttatgtgggaaaaagtagagaaaaaacaaggaccgatttatcgtcaaattatggaacagattatgagagaaatcgaaaacggaaggatcaatcctggaagtcaacttgaatcagaacgaaaactagggcaactttttggtgtgaatcgttccaccgttgtccatgcattggaagagcttagggagcttggggtactaacgagcaaacgtggcagcggatggtttgttaatcagactgaatgggggaaattcgctgttccaagaatcgattggcggcaaatgatctctcctcgttatgagcagacggactggtatgagcaaaaaataagtgaagcaaagcagatccaaaaaacatcgtttcttgatttatacaatagcgagatgccagatgagcttttgccgaattttgagtttccttcttattctcttgaagaaatcttagcggaagaaaaagaaatggatcttttaggctatactccgttacgtaacaaaatcaaacggtatttggaaagtaaatttgaattggcattttcccccaaccagcttcttgtgactggtggcggtcagcaagcaatctttttgattttacaaacgattctttcagctggagaggggatagctgtagagtcaccttcttttttttaccgattacctcttttcaaagcttcaggaacgcgtttatttgggataccgatggatgaagaagggatcgacttagaaaaactgaaagaatcgatccataaaaataaattgaaagcagtgcttatcaacccgaattttcaaaaccctacaggaaaagtgatgagtcaaaaacgacgagaaaagctagtagaattgtgtcgacagtatcggcttccaattattgaagacgatgtatttacggatctttcatttctaaaccaagaagaagtccttcctatacgaacgattgatccggataatgtgttatacgtcggttcgttatctagggttttaggaaaaacaacgaaaatcggttgggtgataggacctgagacttttatctcgcaactagctcaagcgcaagaaatgatggagttttcgatgaatatccttacacaaatcacagtggctaatgtatttaatgaagcaattgatttgaaaatgcaagatgtaagaaaaaagttgaaagaaaaaagccgactgataagcgcttggggagattcacaatcgtttttcaagcttcattcaattttaggtggttactatgcctggattacttgggatgggaaaaaactagaccccgaactagcagaaaaagtagtagatatgggtcttggaattgcaccaagtctactttttgggcaagatataaatggaatcagaatcaattacagtaggctggatgaaaaccaaataccgttgttttattcaaagatgaaaattctagaaaagtggttaacagaataatttcacaaagtaaatagattaaagaatataacagcttggatttaaatttcaagctgtttcttttttttcggaaaaagaatacgatataaagaaactaagaaaaaaccattatttgtacgtccgttcacgatgtgtaaataaaataaatgtttgcaacaaaactgtataacaccaacgtttttaaatagaaacagatggttgtaagtttgattagaaaatagaaaaaatgcagatgaaatataaaacgctttccttattgtgattttattcactaatgctgttaatatgcggattggcataatttcctttcatcgtgaaaatttgtgcttttagcttgtatttctcataaatccatgataatttattaatgaagacggttaaatagtgatacagttttattcactgtttcaatcgcagaatgaagagattttcttatagatgagagaggaatgtgtgacaaatggcaaacaaaaaagcaccgatcgacttccaagcactgctagatgaagtcaatgcagatttcccagtatatcaagcacttgatcaagatggaaacgtagttaacaaagatttagtacctgatttatccgatgatgaactcgttgaattaatgactcatatggtatggtctcgtgtattagaccaacgttcaacagcgctgaaccgccaaggacgcctaggcttttttgcaccaactgctggacaagaggcaagtcagctggctagtgcttacgcatttgataaagaagatgttcttcttccaggttatcgggatgtacctcaactagtaaaacatggtttacctttatctcaagcttttttatggtctcgaggacatgctgcaggtaattcttatccggaagaattgaaagctctaccaccacaaattatcatcggtgcacaatatgtacaagcagccggtgttgcattaggtttgaagaaacgaaacaagaaaaatgtcgtcttcacttatactggtgatggcggttcatcacaaggtgatttttacgaagcaatcaatttcgctggcgcttaccatgcaaatgccgtattttatatccaaaacaacgggtatgcgatctctacacctcgtgaaaaacaaactgcagcaaaaacacttgcacaaaaagctgtcgcagctgggattcctggtattcaagtcgatggaatggatccgcttgcagtatatactgtatctaaaatggcacgggaatgggcgatcagtggaaatggaccagtcctaatcgaaacactgacttatcgttatggaccacatacactatctggtgacgatccaacccgctaccgtacaaaagacacagatgacgattggcagaaaaaagatccattgatccgcttccgtaaatatttgacggaaaaaggactttggtctgaagaaaaagaagaacaagtcatcgaagcaactaaagaagaaatcaaagcagctattgctgaagccgacaaagtaccaaaacaaaaggtttcagatttcttgaaaaacatgttcgaagtatctccacaatcaatcaaagaacaaattgcaatttatgaagcgaaggagtcgaaataatcatggcacaaaaaacaatgatccaagcaatcacagatgccttagcacttgaactagaaaatgacgagaatgtcgttgtttttggtgaagatgttgggaaaaacggaggagttttccgggcaactgaaggattgcaggaaaagttcggagaagaccgagtattcgatactcctttagctgaatctggaatcgcaggattgagtttcggtcttgcgttagaaggatttcgtccagttcctgaaatccaattctttggttttattttcgaagcaatggacgaagtagtagctcaaatggctcgtacaagatatcgaatgagcggcactagaaatctacccatcacaattcgttcgccatttggtggcggtgttcatacaccagaattgcattcggataatttagaaggtttgatcgctcagtctcctggtattcgagtagtgattccttccaacccttatgatgcaaaaggactattgatttcttctattagaagtaacgatccggttgttttcctagaacacatgaaactatatcgctcattccgagaagaagtgccggatgaagcttacgaagttcctttggataaagcagcagttactcgtgagggaacagatgtatctattatcacatacggagcaatggtgcgtgaagcaatcaaagcagcagacaatcttgcaaaagaaaatatatctgttgaaatcattgatcttcgtacagttgcgccattagatgtagaaacgatcattcaatccgtggaaaaaactggtcgcgtagttgttgtccaagaagcacaacgacaagcgggcgttgccgcgcaagtagtttctgagatctcagaacgcgctatcctttcattagaagccccaatcggacgagtttctgcacctgatacagtcttcccatttggacaagcagaaaatgtctggttgccaaatgcaaaagatatcgaagacaaagtaaaagaaatcgcggaattttaagaaaagaagggacgaaacaaagtcatggcttatcaatttaaattgccggatatcggtgaaggaatcgcagaaggtgaaatcgtcaaatggttcgtcaaaccaggagatacgatcaatgaagatgatacattactagaagttcaaaatgacaaatcagtagaagaaatcccgtcacctgttacaggaacggttaaaaatgtgattgttccagaaggtaccgtagcaaatgttggggatgtattagtagaaatcgatgcaccaggacacgaagacaatgaaggggacagtggtgtagccgcagaatcccaaactccagctaaaccggctgctgaacccactgttgatacagaatcagctggatcgtcaagcgaaggagtcttccaatttaagttaccggatatcggtgaaggaatcgcagaaggtgaaatcgtcaaatggttcgtcaaaccaggagatacgatcaatgaagatgatacattactagaagttcaaaatgacaaatcagtagaagaaattccgtcacctgtcacagggacagttaaaaacgtgattgttccagaaggcactgtagcaaatgttggggatgtattagtagaaatcgatgctcctggacacaatagtgcaccgtcaactagtgcgccatcagctgaagcaccaaaagaaaaagtggaaacatcaggttcagcaagtgtcgttgaagctgccgatccaaataaacgtgtattggctatgccatctgttcgtcaatttgcccgtgaaaaagatgtagatatctcacaagtaactgcaactggaaaaggtggcagagtaacaaaagaggacatcgaaaacttcttggcaggtggtccaagcagtgcaccagcgaaatcagaagcgccagaagcggcagcaccgaaagaagcagctcctgcagcagaaagcaaaccagctgcaccagcaaaaccattcaagtccaacttaggagacttggaagaacgtgtagcaatgacgccaacacgtaaagctatcgctaaagcaatggtcaacagtaagcatacagctccacacgtgacattgcatgatgaagtagaagtgtctaaactatgggataatcggaaacgatttaaagaagttgctgctgcaaatggtacgaaacttactttcttgccatatgtcgtgaaagctttaacagcgactgttaagaaatacccagtattgaatgcatctatcgacgatgcaaaccaagaaatcgtttataaacattactacaatatcggtattgcaactgatacggatcacggactatatgtaccaaatgtgaaagatgcagaccgcaaaggaatgtttgctattgcagacgaaatcaatgagaaagcaaaattagctcatgacggcaaactatctgcagaagatatgcgcaatggaacaattacgatcagcaatatcggatctgtaggtggcggttggtttacaccagtcatcaactatccagaagtagctattttaggtgtaggaacgattgcacaacaaccaatcgtaaatgctgaaggcgaaatcgttgtcggtcgtgtgatgaaactgtcattaagtttcgatcaccgtatcgtagatggagcaactgcgcaacaagcaatgaataatatcaaacgtcttttagctgatccagagctattaatgatggaaggatgataaacaaatggtagttggagattttgctgtagaattagatacagttgtaattggtgcgggacctggtggctatgtagctgccatccgcgctgctgaaatgggacaaaaagtagcaatcattgaaagagagtatattggcggtgtttgtttgaatgtcggctgtattccttcaaaagcactgatagctgcaggacaccattatcaagagtcactagattctgaaatgtttggagtaactagtgaaaacgtcaaactagattttgcaaaaacacaagaatggaaagaaaacaaagttgtccatacgttgacttctggtgttggtttcctattaaaaaaacataaggttgaaacaatcgaaggagaagcgttcttcgtagatgatcacacactacgcgtcattcatccagattcagctcaaacttattcgttcaataacgcaatcatcgcaacaggttcccgtccaatcgagattccaggatttaaattcggaggacgtgtgttagattctactggcggattagcattgaaagaagtacctaagaaatttgtgatcatcggtggcggtgtgattggtgccgaattgggcggagcgtacgcaaacttaggagcagaagtaacgattcttgaaggctcaccacaaattttaccaacttacgaaaaagatctagtaaaattagtagaagatgatttcaagaaaaaaggcgtaacagtcgtaacgaatgcaatggcgaaagaagcagtcgataacggtgacagcgtgacagtgaaatatgcagtggacgggaaagaagaatccgttactgctgattatgtgatggtcactgtaggtcgtcgtccgaatacagatgatatgggcttagaacaagcgggtgtcgaagtaggagaacgaggattgatcacggtggataaacaaggacgtacgaacgtacctaacatctatgccatcggtgatatcgttccaggggcggcattagcacacaaagccagttatgaagcaaaaatcgctgctgaagcaatctctggcaaaaaagtagctgtagattataaagcaatgccggcagtagccttcactgatcctgaattggcttctgtaggtatgacgatcaaagaagcaaaagatgctggtatcgaagcaaaagcatataaattcccattttcagggaacggtcgggcattatcgcttggtaaaacagaaggattcatccgtctagttacgacgatcgaagataacgtgcttattggcgcgcaaatcggtggagtcggcgcaagtgatatggtctctgaattagctttagcaatcgaatcaggaatgaatgctgaagatatcgccttgacgattcatcctcatccatctcttggcgaaatcgtcatggatgcttcggaattagcattaggtttaccaatccatatttgatttgaataatacaggcgaaacgcaactgaaaaatcagttgcgttttgttttttagaattatcaataatattattatgtaaacttaaaaatatgacaacttcttggtttattaccacttcctatgctacactgaagaggaatatgaaataggagagttgaagatgcaagaatatcagtatccacttgatttagattggacaacagacgaaatggtcattgtaatgaagatgtgggaagatctggaacgtgcgaatgaaaaagggataaacaatgaagcttttttgaagacttatcagcagtttaaaactgttgtcaaatccattggtgaggaaaaacgattgggacgggaatttgaaaaagcttccggttattctttatatcgtacagtgcagcaagcaaaaaaaaatccaaacaaaactttgagaatgaacgggtgagataaatggaacagatgattgatcatatcaagtcctggcttgaagaagctggtgagaaaatcaaatcttctcaacaaacattaacaatctcgcaaaaatcaaatcgaacggatctagtaacaaatgtcgatcgaaacatccagaattttctaatcgaaaaaatccattcctttgatccagaggcgaaaatattggcagaagaagaagggtgtaatcaattatcggatctcgatggaagagtctttatcatcgatcctattgatggcaccttgaattttgtgattgaaggggaaaatttttgtattatgctcgctgtttatgaatccggcgttggaaagcttggtttcatttatgacgtgatgagaaatgaacttttttggggtggaaaaggaataggcgtgtataaaaatgatgagccattgcctagaccagcaaataaatccttatcggaaggcttacttggtgtgaatagttatcttttcggtcataataaatatggaatccgagaaattgcggaaagcagcatggggacacgtatgtacggatgcgctggtcttgaactagtggcaatcttgaaaggaaaccacattgcttatatttcaaaccttagcccttgggattatgcagcgggaaatgtcttattggaagagtttggtatggtaacaagcggtctttttggtactcctttgacatttgaaaaaagggaatactatttagcagggacttcttgtgcatatgcagaaatcgcagaccttttgaaaaaagaaggctgaaaaaaaggtagaaatcattcacaaaaatgataaaaacgagcaaaagattaattttctcgaaaaaatgaaaacattttactatatttcatgaaaaaagtctgctataattagcagtcgagtaaaatttgccctgtcataaagaaccaataaaaaaggagttagttacattgaattatagaaacgatatccgtaacgtcgcaattattgcccacgttgaccacggaaaaacaacattagttgatgaactattaaaacaatcagatacattagacgcacatacgcaattgcaagaacgtgcgatggactcaaatgcgctagaaaaagaacgtggtatcacgattttagccaaaaacacagctgtagactataaaggtattcgcgtaaacatcatggatactccaggacacgcggacttcggtggcgaagtagaacggatcatgaaaatggttgacggcgttgtgttggtcgtagatgcgtatgaaggaacaatgcctcaaacacgttttgtattgaaaaaagcactggaacaacatatcacaccaatcgttgtcgtaaacaagattgacaaaccttctgctcgtcctgagcatgtcgtagatgaagttcttgaactattcatcgaattaggagcagatgatgatcagttagactttcctgtgatttatgcatctgcactaaatggtacgtcaagcttgtcagatgatccagcagatcaagaaccaaccatggcacctatttttgatacaattattgaaaaaatccctgctcctgtcgataacagcgacgaaccattacaattccaagtttcattacttgactacaacgattatgtaggtcgtatcggaatcggacgtgtatttagaggaacaatcaaagtaggagaccaagtagcattaattaaattagacggaacagttaagaaattccgtgtaacgaaattatttggtttctttggactaaaacgtctagagattcaagaagcaaaagctggagacttgattgctgtctcaggtatggaagatatctttgtcggtgaaacagttactcctgtggatcatcaagatgcgttacctatccttcacattgacgaaccaacattgcaaatgactttcttagttaataattcaccatttgccggtcgagaaggtaaattcgtaaccgctcgtaagattgaagaacgtttgatggcagaacttcaaacagatgtatccttacgagttgaaccaacaaactctccagatgcatggacagtttctggtcgtggagaattgcatttgtctatcttgattgaaaacatgcgccgtgagggatacgaattgcaagtatctcgtccagaagttattgaaaaagaaatcgacggtgtaaaatgcgaaccgtttgaacgcgtgcaaatcgatacaccagaagaatatatgggtagtgttatcgagtccttgagcttacgtaaaggtgaaatgcaagatatggtccatacaggaaacggacaaatccgtttgacattcttaacacctgcccgcggtttgattggttattcaactgaattcctttcaatgacacgtggttacggaatcatgaaccatacttttgaccaatatctgccaatgcttcctggtcaaattggcggacgtcaccaaggggcgcttgtttcgatcgatacaggaaaagcaacgacttattctatcatgagtatcgaagaacgcggtacagtcttcgtagaaccaggtacagaagtatatgaaggaatgattatcggggaaaacagccgtgataatgatttgactgtcaacatcacgaaagcaaaacaaatgacaaacgtacggtctgctactaaagaccaaacatctgtcatcaaaaaaccaaaacaattgacgttggaagaatctttggaattcttgaatgatgatgaatattgcgaagtaacaccagaaagcattcgcttgagaaaacaaattttagagaaaaatgctcgtgaaaaagcatctaaaaagaaaaaataatctgtaaaaggatgaagagagaaaccagcttgttataaaaaatagctggtttctttttttgtccaactcttttctgtggagaagtcatctttgtcaatggacataaattcagaaaatacgccgaaagacgtttaaaagacttttaaaaaacttatttctagagagtttttgtttcataataagataatgtttcacgaaaggagatcaacttgtccttcgaagaaaatcgaagtaaaatggcaagagaaaggagcgggaagatgaacgacttattaaaacaatactttggctatgatgagtttagacctggtcaaaaagaaattatccagaaagtcattgatcaggaaaatgtattaggaatcatgcctaccggaagtgggaaatcaatctgttaccagcttccagctttactattagatgggcttactgtggttgtgtcccctttaatctctttgatgaaggatcaggtggacgcggcgaatcaattaggtatacccgccacttttatcaatagctcgttagatggttacgaaacagctagacgcttccaagaaatcgatagacagcagtaccgtttactttatatcgctcctgaacgttttatcatgccggattttatccaagcaatgaagcgatggaacgtccgtatgatcgctattgacgaggcacattgtatctctcagtgggggcatgatttccgcccaagttatttacagatggcgaaccagctagatcaactgccaaatcgtcctgtaattgttgctttgacagctacagcgactgtgcaagtagctgctgacataaaaagacttttaaaaattccagaaaacaaccatattcagactggttttgaacgagaaaatctacgatttcaagtaattaaagatcaaaaaaaagaacaatatctaatcgaatatttaaagatcaacaaaaatcaatctggtatcatttatgcagcaacgagaaaagaagtagaccgtctctatcatttgcttaaaaaattcgatttttccgtgggtagatatcatggtggtctaaatgagaatgagcgaacagaaatgcaagaagcctttttatacgatcgcttgcagctgattgtagcgacaaatgcatttggtatgggtataaataaaagcaatgtccgttttgttatccattatcaaattcctggctctctagaagcatactatcaggaagctggtcgggcgggaagagatggtctttccagtgaagccatcctgcttttctctcctcaagatatccaagtccaaaagttttttatccagcagtcccaaagagaagaagggcaaaagcaaaaagaatatgaaaaattaaaagcgatgacagaatacgtgtatattgagtcctgtcttcagcaatacatcctaaactattttggcgagacaagcagtccgtgcaaccgttgtggtaactgtttagatgacagagaaatagtagaagtaacgacagaagcacagatggttctttcttgcttaaaacgtatgggtgagaactatggtaaacaaatgctgatgaaagtcttagcaggatcgaaagaacaaaagctgcaagctttaggttttggacatttatctacctatggactgatgaaaaaccaatcgcaaaaagaaacgatgcagttaattgaatatttgatatcgaatggctatcttctgaccatcaatggtgagtatcctgttttgaaagtaacagaaagagggatacaagtattgaaaggacaagaatctgtttatcgaaaggaacccaagaaagtccagcagctatcggatgaagaaaccgatacactatttgaagtgctgcgggaactgcgaacggatctagcatcagaagcaggcgttcccccgtatgtcgtattttcagattccacattgaaagaaatgagccgaatacgtccatcaagcagattggagatgcttcagataaaaggagttggccaaagcaagcttgataaatatggcgaagcctttttatctcggataaaaaatgcggactctaacgttctggataagtagaaagaacgaatacgtaaaaatgaataaaaacaactggttaaatctgttttttttgctccttatgaaaatcaaatatgttataattaaggaattagaatgggaggtaagcacagatggattctttgtcgaaaaaacttgcgatccaagtattaaatgatgaagcagaacggatcaaacgattaatccgaaatcaaaacaacagtctctgtatctcacaatgcaaagccttcgaagaagtggtagatacacagatgtacggcttttcccggcaagtcggttttgctgtccgtataggagtaatcggaaagaacgagggccagctgatgttaagtgagctagaacgagaattgaatcagttatatagtgaggtttaccaagaaatttatgataaaaaagaagttggcaaggaggaatagacttgcctaagaaagtgaaaaaaaggcatctattagactatagcatcttgattccctatttaattttatgtgtattgggattgatcatggtatatagttctacgtcgtatctattattagaaaacggacaaaatccgtccgcatcagtcattaaccagagtattttttgggtgcttagcttgattgctatcgcactactttataaaatgaaaacagatgttttgaaaaaccagcgtttgatcatggcagccatcgcagttttgacgattttgctgctgattgttgtgttttttggtaaggagatcaatggggcgaaaggttggctgcaaattgcaggattctcgatccaacctgccgaatacctaaaaatcatttctatctggtacctgtctctgactttatctaaaagacaaaacagtgtacaaaaagattttcttgggactgtgaaacgtccacttgcaatggttatcggacttactgcattagtcgctattcttcccgattttggtaatgcggcagttatctttttgattattttggttctgcttttagccagcggagtcaattatgtgtatactttgattgtaggagtaggaggcttttgtctaagtacttttacgatctggctgatcaatatcacaaacggaaagatcttacccggacgtttacagtatatctataatcgatttgctatttaccaaaatcctttctcagacgaattaaataaagggcatcaactagtcaacggctactatgccatgttcaacggaggactatttggcaggggattaggtaacagtatccagaaaaaaggatttttacaagaagcacaaaccgattttatttatgcaatcgtagtggaagaactgggagtgattatggggattttgatattagcgttgctattctttatgattgtgcgcattgtccttgtaggtatccgttcaaaagatccgttcaattcgcttttgtgcattgggatcggcgcaatgtttttgatccaagtatttgtcaatcttggaggaattactggcgttattcctttgacagggatcacgttcccatttttaagtcaaggaggctccagtttgctgatgctttcgatttgtgtcggctttgtcctcaacatcagtgcggatgaaaaacgcaagagcttaggtttataataaaaaaagatgtaggagtggttcgatgaaaaaagttttagttgctaacaggggtgaaatcgctgtacgtgtatttcgtgcttgtacagaattaggaattaaaactgttggaatctatgcagaagaagatgaatattccgtacaccgtttcaaagcggatgaagcatatttagtaggacaaggaaaaaaaccgattgatgcgtatctagatattgaagggatcatttctatcgcgaaagaatgcggagctgacgctattcatccgggttacggtcttttgtcggaaaacttgaattttgcgcaacggtgcgaagaagaaggcatcatttttgttggacccaaactgcatcatttagatatttttggagataaaatcaaagcaaaagctgcagctatcgaagcggggattgcttcgattccaggcacagatggaccaatcgcttctatagacgatgccttggagtttgcgaaacaatacggttatccgattatgatcaaggcagctctaggcggcggcggacgcggcatgcgtgtagctcacgatgaaaagagtgcaagagagggctacgaacgtgcgaaaagcgaagcaaaagcagcctttggtagtgatgaagtgtatgttgaaaaatacatcgctaatcctaagcatatcgaagtacagattctcggggatacgcatggaaacgtcatccatctttttgaaagagattgttctgttcagcgccgtcaccaaaaagtagtagaagtagcgccttgtgtctctatgaatgaacagcaacgtcaaaaaatctgccaggcagctgtccaattgatgaaatatgtcgggtatgtcaacgcaggtacagtagaatttcttgttgaaggagatgatttttactttatcgaagtcaaccctcgcgtccaagtggaacatacgatcacagaaatgattacagatattgatatcgtaacaacgcaactgttgattgctcaaggtttggatctgcataaagaaatcggattgcctcagcaagaaggaattaaattaaatggttcagccattcaatgccgaatcactacagaagacccgttgaataactttttaccagacacagggaaaatcgatacgtatcgttcacctggtggttttggcgtacgtctggatgtcggaaatgcttacgcgggctatgtagtgacaccgtattttgattcattgctagtaaaagtatgtacgcatggtgctacctttgaaacagccattcagaaaatggaacgttgcttgaaagaatttagaatccgtggagtgaaaacaaacattccatttatgctcaatgtcatcacacatcctgaattccaatcaggaaatgcaaaaacaaccttcattgatagtacagcaacattatttgaatttcctcgactacgagaccgcggaaacaaaacgatgaaatatatcggtgaaattactgtgaatggttttccaggtatcgaaagtggcgaaaaaccattttatgaagaaccacgtatgcctaaagatctaatcacaagaactgattacgtaacggctaagaatgtattagatgcgaagggtgccgatgctttggtcgaatggatcaaaggacaggaaaatttgttgttgacggatacgacatttagagacgcccatcaaagtctgctagcaactcgtgttcggacaaaggatttcaagcagattgcacgtttgactggagaaggtcttcctgaactcttttcaagtgagatgtgggggggagcaacatttgatgtggcttaccgctttttgaatgaagatccttggcaacggttgagaaaaattcgttctttaatgcctaatacgttgctgcaaatgcttttcagaggttcaaatgccgttgggtattctaattatcctgacaatgtattggtggaatttgtcaaagaagcagcagcgcaaggaatcgatgtatttcgaatctttgatagtttgaactggactccacaaatggaaaaaagtatccaagctgtacgggatactggtaaaatcgcagaggcagctatttgctatactggcgatatcaacgatccaagtcgggcaaaatacaatgttcagtattataaagacatggcaaaggaactagaacaactgggtgcgcatatcattgcaatcaaagatatggctgggctgcttaaaccgcaggcagcttatcgtttgattagtgaattgaaagaaacgacagatctgccaatccatctgcatactcatgataccagcgggaatggaatcatcacttattctgctgcttcaaaagcaggagtagacatcgttgacgtggcaatgagtgcaatgagtgggaatactagtcagcctagcatgagcagcttgtattatgcactggtcaatggtccacggctgccagaaatcacgattgaaaatgcacagaaattaaaccattattgggaagatgtgcgcatgtattacaaaccgtttgaaaacggcttgaatgctcctgaaacagaagtatatatgcatgaaatgccaggaggacagtattcgaatctacagcaacaggcaaaagctgtcggattaggtcatcgctgggatgaaatcaaacaaatgtatcatactgtcaacttgatgtttggcgatatcgttaaagtaactccatcatctaaagtagttggagatatggcactatttatggtccaaaatgatcttacagaagaagatatttatgaaaaaggcgaaacactaagtttccctgaatctgttgtgactttcttccaaggagaactagggcaacccgttggcggatttcctaaaaaattgcaaaagattattcttaaaggcagacctgcattgaatgaacgtccaggtcttttggctgaatcagtcgacttcaacgaagtaaaaaaagaattggcagaaaaaattggctatgaaccaaaacaagacgaagtattaagctatttgatgtatccgcaagtctttttggactatcaaaaagcatataatcaatttggcgatgttacattactggacacaccaacatttttccaaggtatacgtttgggtgaaacaatcaatgtacaaatcgaacgcggaaaaacgcttatcattcgtttagatgaaatcggagaacccgatatcgaagggaatcgcgtactgttcttcaatttgaatggacaaagacgtgaaatcactatcaaagataattcgatcatcagtacggtccaaacccgattgaaagctgaaccgacaaaccgagaacaaattggagcaacgatgtctggttctgttttggatgtattagtgaaaaaaggcgataacgttaaaaaaggtgatacgttgatgattactgaagcgatgaaaatggaaacggccatcgaagcacgttttgacggagaagtcgcacatgtatatgtgtcttcaggagacactatttcgtctggtgaccttttgattgaagtgactgagaaataataagcgaaaggtggggaaacatgaaaagactgggtttgttttggctgattctgctattagttattgtggcattctacatggaaccagtcttgtttccgccaaaacttgaagtgaaggaaaactctgatcaacaaatatcaaaccaaatgacaacgtggaaataccaggagcttaaagcaactggtttttctacttatatcggaaaaccgatcgatcagctggaaaaggattttggccaagcctatgatcgattaactagcggatttggttttgaaacaagatattatgaaaataaagctagtcatctcacatttgaagcgaacatccaagacagcagagtcacaactgttaaagtactgcaaacagggcctgctgatatcgcgccgttttatttagggatgacgatgcaagatcttacgaaaatcactactatctatactaatttcacttttgagtaccatgatacagaagttggaatcgaactaatggaagaggatatgaattatcgtccgctaattgcttttgataacgacacttttgctattttattttttgatcaaacaacaaacggcctattttcagttgtgtatttagataaagatagtcttttgaaactattgccatatcaagtgtttggtgaaggccttccacattatcaagcagataaatcggctgattgggaatcaatcaatcgcgttaaagaacgaaaaagtacgactttattaaatatgcttagaagagaagacgaacttcccatatacaatcaaacacttgcctttcaaaaccacagtcagctgctactacatgattttttgacaaggcctgaggaaatattgtcagaggaacgtatggctgattggcaaaaatcgctaggcagtgctcaaacgacagtgaaattctcactgacgaatgatgaattggagaagttaatcagtaaacaaaaattagaaaatactagtgggctatttattcatccggcgattgacgctactttttcgtttttatattggtacagcgatccttacaaccatgaccgtttcatggacccgggaacggattctgtaggcattgctttttctaaagaaaatatgttagtcttattgcaagaagaaaacggagaaagtagtgatagcagtgatcgttaacgaagagctgtttcaactggaggatcaatgcctccaagtcgctgaaatgataaaaaagagtaaaacgatggcttcttatcttgaacataaacagtcaatggaagaatctgcaaaagtttgccagttgaaagaagcgttcttgtctaagaaagaagcatttgaaaatgtagcggcatatggtgagtatgcacctgattatcgtgaaaaaaaacgagctgttcgaaaagcaaaaagacagcttgatatggatgagcatgttgcagctttccgatatagtgaaacacagctgcaaagtctgttggatcaaattgtccaagtacttgccgaagaagtttctaatgaaatcaaagtagatgcaggtagcccgttttttgaaacgaaaaaacactttggatgcggaggtaattgtcatgcaattagacaatagtgaatttgaaataacaaaacgacgcgggctgatcgtatgggtctacagcttaaaacaattaaagaatctgaaaaagttcggcttgttgcattatgtctcaagaagaatgaaatatgtcgtgctttacttaaatgaagagacattggaagaaacagaagaacgaatccgtaaattacattttgttcgaaacgtagaacgttcttaccgaccggatatcgaaatgaattttgccgaaaaaataggaaacaaaacagtattaaaagacgaaggtttcgaaattgaagagctaaatacagaaatccgattagctgaacatctttaaaaatctcttatgagcagtttttaaataaaaaataacttggataacgatcgatttttgatcattgtccaagtatttttttggtatactagtaccagtaccatttctaaggagtgagtagatgcggataatatcaggaaattatggcgggcgccgtttaaaaagtttagcaggggcgaacaccagaccaactacagataaagtaaaagaatccatattcaatatgattggaccatattttgatggagagacagtattggatctgtttgcaggaagcggtggtttagctatcgaagcagtatctagaggctgcagtcatgcggtatgcgtagacaaaaattaccaagcgctaaaaatcatcaaagaaaacatcgaaattacgaaagaaccagagaaatttaccacaataaaacttgatgcggacaaagcaatcgaacggctagcagcggagaaacaacaattcgactacttgtttcttgatccgccatatgcaaaacaaaaaataatcgatcaaatccataaaatggaagaactgggacttttttctaaaaccgcagttatcgtatgcgaaacggataaaacagtcgaattgccagaaactgtggctggattccatcaaataagaaaacagatttatggcataacggccgtaactatctatagaaaagagggaaatcaatgaaacgtgcattattcccaggaagttttgatccttttacaaaaggtcacttagatacggtggaacgtgcggctaaattattcgatgaggtagtaattggtgtttttatcaatacttcaaagaaaagtttgtttcccccagaagaaagaatgacattgatcacaaaagctgtttctcatcttcctaatgtaaaagtcatgcatcaagaaaatcaattgacggtagaaacagcaaaagagattggtgcagatgcgttgatcagaggcatacgaagtatcaaagactttgaatatgaacgagagattgctcagatgaatcatcatctatatgatgaattggaaactgtcttcttattagcaaaaccagaatatagtcacgtgagttccagtattttaaaagaagtactgcactttggcggagatgtgagcagctacttaccgccagtgatcaacgaagctttagctggaaagcgtgaatcaaatgaaagctaaacaatggttgaaaacagtactgattatcatatttggaatgttgatcattggatttgtagtagttcccttgccgtattatgtagaatcaccgggagccacgatcgatctgaaagaactaattacggtcaatgataaggaagataaaggttctgggtctttctctcttacctctgttggtatcaggcaagctacaggtttcttagctttaaaagctaaaatgaccccttttgaagaattgatcagtgaagaagaattgactggtggggcgacaaatgaagaatataatcaaatgcaacagtattatatggattcttcccaaaatgcagcaatcgaacaagcgttaaaacttgcagacaagccttataaaatggaattcaaaggcgtatatgtcatgagtgtagagaaaacatcgaatttctttggcaagctttcagttggagatacagtaacaaaagtagacgggaaaagctttcaaagtacagaagcatttatggattatgtaaaaagccaaaaagttggacaaacaatcgaaatcagttatttgcataatggtgaagaaaaaacagcttctggtgatctgatcgagttaccaacagataaaaaggcaggaataggtatcacgcttactgaccataccgagatcgaatcagatacagatgttcgtattaattctggctctatcggtgggccatcagcgggattgatgttcactttagaaatctatgaacaagtcactggtaaaaacttgcgacatggtaagcaaattgcaggaactggaacgatcaacagtgaaggagaagttggccgaatcggaggaatcgataaaaaagtggcaagtgcggataaagctggcgtagagattttctttgcaccagatgatacgatttcagacgatgttaagaaagaatatcctgaaataaaaaccaactacgaagaagcaaaagctgccgctaaaaaattgaattcctcaatgaaaatcgtaccagtaaaaacagtacaagaagcgcttgactatctagagaaaatgaaatgaaactaaataattaaagaggggttgtgacacgagttctgtcacaacccctctttttcgtcaaaaatcttcacgataaaaataaaaacaaaagaaaaaattgacgtaattagatgttgaagggacgattttgccagagctcactgtttcttcaattttaaatgaaaggagtaatgaatgatttttactggtcattctttgaaaaaagaacaatgatagaaaaaatcagcaagaaaatactagcttcacccaaattgatcatttggatgtctatgatagttcttatcttttgtatcgcaagtggttttttattatcaaatttgctattttatagagaaacagaagagactgctgcaaaagaaatactttcttcgtttagttccagtggagaagatccatcagctgaaggaaacgatgtagaagaggatgctcgtccaaaggtcatgtacaccgatatcaaaggaagtgtgaaggagcctggtatctattccttttcttcagaagaacgggtctatgatgtactaaagcgtgcaggtggattattagaagaagcggatagcgatcgaatcaacttttctgcgaagatagaagatcagcaagtcctatatatccctgctgtaggtgaagagctgccagaacatcttgatcagttggcatcctcggaaggaaaacagcctacagcagattccgagcctcccaaaataaatatcaatacagccactccatcagaacttcagcagattcctgggatcggatcagtcaaagcgcaagaaatcattcgatttagagaagaaaacggatccttccagaaagtggaagacctgcaggagatttctggtatcggtgaaaagacagttgaaaaactaaaaaacttcgttacaattaaatagaatgattcaaaatcgactggcacgagcaataaatggacgctaatggatactaagaataatccaattctaagagcttggcaggacgaggaggtagtatttttggataggaaatagcttgattgttcgcaaagaaacattaaaaaaaccaatgctgaatgtctatctccaaaataaaatatctgggattcatattatgaatacggctgtcagcggcaataacagtcaagctctacgagaacgctttgccaaagatgtacttagctatacagcagataaagtatttattctcattgggacgaatgatctagcagagcataaacaactttctaaagaaacgtaccaaaaaatctgcagtggatgatagttcagctgaaaaaagactatagttctgatcatgctttctttatcacgccaccagcagtcgatgagacaaaacaaaaatatcggaataacaagttgatcaaagaatatatctctgttctcacagaagtagcaaaacgccatgattgtgaagtatcgatttttatacggaatttcttgaacaaatggattcgaagaatttttataatgggctaatggatgacggacttcatttcggcagtgaagggtaggatcttttgtcagacaggatgattcgttatatttaaagaatattttgtttaagcaatgagtactttttaatcaacttgaaaaaacggaggaatataaaacatgttagaaaaatcttcaaaagcatgcgatacgaataaagaaaaagttactgataagtcacataatgaacgcattccttgggaccagtactttatggctcaggcagtactgttatctttacgtagtacgtgtacacgtttagaagtaggagcgacactcgttcgagaaaaaaggatcattgctggcggctataatggagcagtcagtggagatgtccactgcatagatgaagggtgttacgtcgtggatggacactgcttgcgaacgatccatgcagagatgaatgcactcctacagtgtgcaaaacttggtatcccgacggaaggttcagaaatctatgtcacacattttccatgtttggcctgtacaaaggctttgttgcaagctggtgtgaaagggatcaattatctccatgactatcgaaatgatccttatgcccaagcgttgatcgaacaattaggtgtatctgtacaccaagttgctttagactcacagcatttttcaaaacttcaaaatgaattaacaggaaaacatgtctagcgttttagaaaggcatgttcgaaatcggttgatttttccggcaattacgtcgatgattatctgtttgttgtattacactgacaattggggttatcgtttgcttcttgccggaatttttttatggttttcgctaaaagaaggacgttttatcgcgtacttgtgtattttgtgtagcataacggtatccatttcttataggctacaagagtattcatttttagaggaaaaaacaacatctgcgcaaattactgtatttacagatacgattcgtgcaaatggtaattttttgacaatggaaggaaggttatcagagaataaacaaaagctccagctttcttatcaagtaaacacagaagcagaattgaaaacatggcttaacttccgaggaaagggaatagaattgactgctgaaggcgagttcatctctccagcaaaaaagcggaatctttataattttgaccaagaagcttacttcaggaaccatagaatttctggacggttccaaattcaaaagattgaacagatcaccatgcaaaatcactggcgaaactggcttcagagaaaaagaggatcttttatctcctttgtccaatctgaatttccgcaaaaaacaagtgtatatattaattctttattatggggctataaagatgcaggattcagagaaccagaagaaatttttagggagagtggtttgctgcatctgttcagtctatcgggtctacacatccaattttatttagggtggctgtattatttatttcgacgtatcggatggccactacacgtcagtattattccgttgagtctactaactatctgttatgtttctattgcaggaagttctatttctgttttgcgtgctagtttgctgtttttattgcgattgctagtcaaattgctgaataagcattattccaccatggacttatttgcagttgtcttttggcttcttttactatttgatcctcgatttctttttcatgcgggtggacagcttagttttttcatgagttttttgtttatcctgatttcttttgatggagattggttgaaaaaaacggcctctcacgtcctgtttactatgatcacgatgccgttgattgtatggcatttttatgagtggcctattttaggtagtctttttacattactgattgcaccggtattcaagtttctttttcttcctggtgtgttatttctcacactcttcaatcgctggctgccggaaactttacttttgctgatagaagagggattaatcttatttgagcgaataatcgatttttcttcagggtcgtctctcattataggacgtttgccccttgtgctatctgggatgtatattttcggattactgatttgtatggataggttgaaagaacaacctgtgaaacacttgttttatgttggtcttttttcttttatttttttgactttgccatttttacgcttttcttcaacgatcgcttttatcgatgtcggtcaaggagacagtatctttttgcaaagtccttttcgaaaagaaacgattttgatcgatactggaggtcagttacactttgaaagagaaaagtgggcgcaaggtatgatacgtcctcctgctgaaagaaatatcgttccatatctaaaaggtcaggggataagtgtaatcgataaactcatcttgacacacgacgatacggatcatgtgggagaattacccacgttatctcagcattttactatcaaaaaaatttatatcggttggggcgctggacgaaatgagccattacaaaggcatttatctgaagctcaaaaaaatggtactgagatcattgaaatcaaacatggggacaggatcagcggttattatgatctttatgtattgactccttttgaaaagggagagggaagaaatgaagattcgattggtctatggatggaatataacaataggcgctttttatttttaggagatttgaatcaagcaatggaaaaacaattgcttttgatttatcctaatctgaaagccgatgtagtcaaattaggtcatcacggtagccgtacgtcaagtaacacagattttctttcccatattgaagcaaaacatgggattatatcctgcggcgtaaataatcgttatggtcacccgcacagcgaagtattggagacactagaagaaaatcagataaaaacatggcgaacggatcaacaaggaatgatcacctatcgctggcatccagtttttcatcctcatgggctagtggaaacaatgatagactagtaattctcatctgctcatggtaggataatttttgaaagtggtgagtaatttgagtatacaagcagagttacaaaaaatacgtaaagaaaaacttgcatcttgttacttgattttaggaacagaaaagtttctccaagatcaagttcggacagaaattgtcaaaaaaatccaattagagggcgaagatgacttaaattttttaagttttgacatggaaaatgcaagtttagatgaggtagtagctgaagcagagacgttgccgtttttcggagatcaacggttagtattcgtagagaatccttattttttaacaggtgaaaaagtaaacaatggaatcgaacaaaatactgatttattgacggcttatttgaaagaaccattagaatcgactgtattagtattctttgcgccatatgaaaagttggatgaacggaaaaaagtaacgaaacaattgaaaaaaacagcaattatcatcaatgtccaacagttgaatgaaaaagaagtacgtcaatatctgatgaataccttagagaattcctcaatcaaaatggaacgaagtgcaattgatttattcttgaggttgaccgacttagatttatccaaaatgatgagagagttacagaaattggtcctttatggacaaaatcaacagcaaatcacggtaagagaagtagaagaattagttcctaaaacgttagaacataatatttttgacatgacccaatatattttaaaagggaagacggaacaagctttgcgtttatacgaagatttagttatgcaaggggaagaaacaatcaaaattaatgcgattttgctttctcaattacgtttatttttacagacaaaatttcttgtaaagattggttatcagcaggcaaatattgctgaaacattgaaaatccatccatatcgtgtaaaacttgccatgcaggaagtaaaaaaattcgatgaacatttgctggtacagttgtttgatcaattagttgagatggattatcaaatcaaaacgggacaaatcgaaaaagaattaagttttcaactattcgttttgcgcacagggcagttgttaagaaatcgataagaagaaagacgagggcaaagcatgcgggaaggtcgtttgtttttgtcctttttttgacaaataaaaaaatcggccgaagccgattcttttatttagcgatttttttgcttaaacgagatttgtcgcggttagctttgtttttgtggattagaccttttgattcagccatatcaatagctttaacagcttctttatataacgcatctacgttgtcagcacctgaagctacagcatcttcaaattttttgattgcagtacgcatagcgcttgtttgagatgaatttttcacattagcgttttcgcttgtacgaacacgtttgattgcagattcaatgtttggcattagtttcacctccgataacttaagttcttacgcgtgttaccgcataattcaacattcattattatacctaaaggcagcgtgctttgcaatatgaacatgacaagtttttttccttaacagtcttttattaggattttttttcagtaaaaacggatagtacaagctgaaaaaaatcaaaaagacgctattgtgggaggcaatagcgtcaaaccaaactagatttttatttatctatttaaacaaagtttgaatgggaatgtttggtactaagttattatataacaaagagaaccgtttgcaaagttttttttgaaaagggatacgattccctgttgttctttgtttttctattaagaaactgcagttattttataaccagtatcctttgatcagtaaaggctattctggtgtaccgattattttaatgtattcatcgatattttttatcaacattttttttatgaccaactggttccgacggttccatttgccacttacttccagcacatatttatttaggggcaaacgtaagatatattttgccaaatagcgatctttaagcaggccattgatcacacggtcctcaagctgcaagttgatcccagtcagcatcattggctgttcttgtaaaacgtacgtatcaattaaaagaccttcaaaagtttccacaagcgtcttcctttcttttcaaagtaacctgaaaacaggcactaattcttccattttgatattcgttgaagtggatgcgatcattctttcttttgtccactgtaatctagtataacaaaaaagagcagaagagccaaaaagaaaaaagagcatcgaattctataggaagtctcattggcacggcctaaattattacaaaacattgattaaaaaaagcccctgcatcgcaggagcatcccctatatcgttttaataggtcaatcaaaaagcagtatcaaacacattttgtatcaaatcaggaaataatagataagctaagcccagaatcaaaagtaccgctagaagaaaccagccgattgttcctatgaaatactttaatttttcgaacattgtatcacctcgttgtcagtatatcacggatcagtaaattgggggtgttaagaatctcctaaaatagacaaaatttgttctattttcctaaagcaaatacttgtaagatacagtaagtgataccagaagcaatgaccggtccggcggcgattcctcttaagaagacaacacctaaaatcgtgccgaaaacaagtgcaacagtgatttgtggatcagaagcaatcaatcctacacccttggaagataagacagccactagcccaccgcaaaaaacagctacccagccaataggggatttaaaggcttctaatagatcacgtagaccgatttctcctgttgcgatagggattagaatagccgctgtgatgatcgtcaccccaatattgattcctttgccttgaagccaagggaaaaaggaacgggaggctggtatgagcttcataatcaaaacaaaagctgccgctatcatcagactttgatttttagctaaaattgctacaagtaaaataattcctaaaaaaagccaactttccatgaaatatattcctcactttcttcgaaacaatcataacatgtttttagaaagttacaaaagtaggaattcatccttcaagacctattcataagctgtttttttcataaaataaacaaaatcataaaaaaacactttgcttatttgacagaagacagccgcgctttgtatagtggacaagacttacatttttttgaagaatcagaaagatcaggtaaaggtcttagtaaacgcaagccattcagaataaccaatattgtgcttccttcgtgtcctacaactccaagaggtagatttaaaaattgcaggaagttagaagcaatcaacaagagaataacaagaatcgaaaaaataatattttgtttgatgatccgccgcatttttaaagatagccgatgactgtagacaaatttatttaagtcgcttttcattaagacgatgtctgcgatatccatagcggcatctgtcccttgccccatagcgacacctaaagaagcggctgctaaagcaggcgcatcattgactccatcaccaaccatcgcatttacttggtaaagttcattctcttttttgactagttgtgttttttcttccggagtacagcttgcatagtaatgttcaatccctacttgttcagcaatggcctttgctgtgccagaatggtcgccggttatcatacttgtatggatgttttgggatttaaagtaggaaattacttgttgggtatttgcttttggaatatctagcagacctaaaacagcgattaactgctgatctttagaaagataaatcacggttttgccttgattttccaaacgttcgatcatttccgcaatctctttgctgattatcatcgtctcaggatcatatgcgtgcttgccaactttccattgcgcacctaaataggtagtttgtaatccaaaaccagtaatttcttctattggtaagtattggatttcttcaggtattgtgcaatcgaaatattgcaaaatcgcatgagcaagtggatgcgtcgttttttgttccatagcaacaagaagttgttgtgccaaatccttttcatcaaagaaaaagctgtcagttacaactggttttcctttagtgagcgttcctgttttatcaaaggcaatcgcttttaattcagaaagcttttctaaatggataccgcctttgattaaaatcccattttttgcagaatttgaaagagcagctagagaagctggtgtagcagatgcgacaagcgcacaaggagaagccacaactaataataccattcctcgataaaagctttcatcccaactccaacctaggaaaaagtgggggagaaggatcattagaggaacagcaagcaaaatcaattttacataattattttcgattcgttcgataaatgaagctgtttgagttggcgtattctgcgcttcttctactaattggataatcttagcaaagacagtttcggaactcgtttttgttactcgaatcgtgatgggatttccttgattcagcgttcctgcatacatctcatcgcctaaatatttttctacaggcacagattcaccgcttaatgcagactcatcgatcgttgcctgtgtgctttctaaaaagccatctatcggaacagctgctcctttagcgacaaataccaagttatccacctttagttgagaaacatctacttcttgcatttgtccattttcttttaataattgggctttttgtggttgaagattcatcaaagcagtaatttctttttgacttttattagttgtgtattcctctaatgcaccgcttaaacaaaagatgaatgtcaacattgctccttcaaagtaattaccgatcaaacaggcaccaatagcagctaaagccatcaataaatccacattcagtgtccgatcattccacaattctttcaagccttccgatgtttgtttatatccaccgatgataatggcactgatataaaaaagtggggtgatggtaagagagaatcggtcgaagataaaaccgaagatcataaataaaaggcagccgattgttgctgcaaaagcttttttctgattagtcatcgttattagacctccttgtcaaaacaaggatagcataataaaaatgtaattgataataataacaactaaatgagaacgataatggttatcatttggtgattaagcttgatgttgtttttattatttataatgattattattaaagaaaataaaaaaccagaacatttctcaaataagagaagtgttctggttttttctacattgcaataaaccaataaccaatcaaaatgataccaaggataatacgataccagccaaaagcggtaaagtcgtttttcttcaaatagcttagtaagaatttgatagctaagacggaaaccacaaaagatacgaatgttcctacaagaagaacaacagtttcttccattttgaatgaattcccttcagctaaatatttgacgatcttcaagccgcttgcgccaaacatgacaggaatccctaagaaaaatgaaaactctgtagcgacaaaacgcgaagcaccaatcaagatagatcctaggatcgttgcgccagaacgggatgttccgggaacaagtgccaagacttggaataacccaacaagaagagctgcttggtacgtaaagtcattcagagaagtccaacgaggtgttttgtttttgttgcgtttttcgacaataataaaggcaataccgtaaacgatcaaaacaatggcaactggtaagaacttgtggaaatttgcttctaaccaatcatccaaaggcaaaccaatgatgatggctggtatgcaagcaacgatcactttaaaccaaagtgtccacgtatcttttttttctaccgttgatttacttggagaaaatgggtttaacttgtgaaaataaagaacgacgacagccaagatcgcccctaattggataacgacattgaacatcgacataaattgtgaactggcatccagtttgatgaattcatctgctaggatcaaatgaccagtactactgatgggcagccattccgttattccttcaataataccgagaatcactgctttgataatatttgcaaaaaacataaattccttccttcccaattaagatacatcttatagtataccgttattttttgagaaacccaatctgttttttaatattaagaaaaacttgagaaataaagcagataagtacacgaagagaaaaaagaagacaaagccctcgttcagactttgccttttatgattctctggtaaaaattaaaatatccccattatagaaacgagtcgcgactatgtgttttcccgttatcgatataagacgtatcattgatgccgtggatagaaaatcgaccgtttgcataagtgacctttgttacgctgccatttaaaagcccagcacgaacaggctgtttaggatcgatcagattaagcaaaaaggcgatcgtcaaaccatgagatacgactaaaacatttccaccaccatttttttcgcagtgatgggcgatatcttcaaatcctgtccatacacggtctcgcaatgtttcataagtttccgcccacccagcggtatctaagttgtatacagcattagcaatttgttcaaaagaaacttctgtggtaaacatttcatcatatgttttaaaattcaatacacgagggatcacaccccacatttccatgtcatatccaccttcaagagacccgaaacaccattctctaatccttttttcaataaaataaggaatttcttttcccttagaatgttctcctagaataatacgggcagtttcgattgcacgaccactgtcactagaataagcaaatgaaaagtcgacattttttaacccgcgacctaaataatgaatgccttcttgtccttgctttgtgaggggtgtatcacaccagccttgtactcgttcaattgtattgaacatcgtttttccgtgtcgtacgatataaagtgtagtttctgtcattttattctcctcctaagtcgttttaacgattgaaaaaaggatttgtccttttttcctgttcaatcgtcgttgcatcgccatgtcctggatagactgcaaattcatcaggtaatacaaacagctgggtccgaatactatgaagtaattgttctaaattccctgtatacagatcggttctaccgatacttcctctaaacagggcgtcgccagaaacgacaaaatcatcaaaaataaagctgacgcttcctatagaatgccctggggtagggacgacgcgaaaagacatgtttcctaaagtataagttttcatttcaaattcatattctgcaggcgagacaataacatcagcaatatcatcatgtctaccgagtccagaaagattcaaaatcggatcacctagccatttttgctctagtgggctgacataaactgggatttgataatacgcgcgtaaaggttccactgcaccgatatgatcgtagtgagtatgggtaagcaaaatcgctaccggctgttggtttgtttttttgatttcttgtttgattcgttccgcatcttctccagggtcaatgatcaaaagtgcttcttcgttgtagaccaaataacagttttcttcaatcattcctgtttttaatctttcgatatgcatgtgcattcctccttgatagccaaaacttctttcatccattagtataacgcattcattgctaggaaacaaaaacaggtacttatttctctttacttatctgaattatcagactatatgaaaagtatttggatattctaaagagaaggaaagtaagttttcatagcattttaatatgtccttgttacattagattcatccaaaaatccaaattctatatcctatatccctgcctaatcagcagggtgtttttttatgtttggaaagagagctctttttgctaaactaggttttttcaggtaatcttagagagaaagaggtggtggaaatgatcaaacagtcaaaaatatctgtgcggcacttagtagaatttattttgcgacgtggaagtatcgacaatcgtaaaaaaagtaaccatactgcattagaaggagcgagaatccaccgcaagctccaaaaagatgcgggagaaaactatgaaaaagaagtctttttaaaaacaacagttcaattagatgaatattacctgatcgttgaaggccgtgcagacggtattttcaaaagagacggtatttattatatagatgaaatcaaaacctccgaaccacgatttgaagatttagaaccagaacaagtggaacttttctttcatcaagcaagggtgtatgcctatatctatagtcaagaacatgatttacaagaaataaatctgcaattgacttacttccagacggcagaagaagtgatcacgagaaaggttgaacatcagacaagagagcagttagaaactttttttaaaaagctgactgaagattataaagaatggcttgtttttcaagaaaactggcgcactgtacgcaatgcctctttgatggctttgaaattcccccatgatgagtataggaaaggtcagcgtgaactagcggtagctgcttataaaacgatccgtacgaaacagaaattgtttgtagaagcacctaccggaacaggaaaaacaatctctacgttattccccgctttgaaagctgtaggggaagaagagggagaaaagatcttttatctaacggctaaaacaataactagacaagtagctgaagatgctatgacagcattaaaagatacaggagctgaagtaaaaagtgtcactttgacggcgaaagacaagatctgctttttagatgagacgacctgtaatccagatcagtgcccatatgccaatggttattacaatcggattaatgaaggtttatgggatcttttgaatcatgagaatcagatcactcgtgaagtcatcgaaacttatgcaagaaagcatacactttgtcctttcgaactatcattagatgtcagtatctggtgtgacgtaatcattggggattacaattatttatttgatccaactgtttatttaagacgtttttttgaagatgaaaaaaacgaggactatctgtttttgattgacgaagcacataatttggtgaatcgttcccgagagatgtattcggcagaactatcttatgaaaaaacgaaacgaagtaaggaagctataccaaaggaattcaaaaaacttcatcgccgtttcaacaaactattaaaagaatttgattcgatccgagaaatagcaaaagaagatcattgggattatcatcatcaaaaagcaccggctgaatctttagtaaaggcaggttatcaattaagcgaaaaaattaaagaatggctggcagaatttcctgagcacccatcacaagaacaattgcttccttattattttgatttgcttcattttttgaaggtcagtgaattttatgatgatcactacgaaacaacagtcgaaaaaacgtatcgcgatctgatagtaaaagagttttgtattgatccaagcttgtttcttgagcagtcgttggataaaggaaaaagcagtattcttttttctgctagtttttcaccactctcttattatcaggaaacactggggggacaaaaaagtctggcttacaaactgccgagtcctttcccagaaggaaaccagcaagttttcatcgcaaattacctagagacgacttatcgaaaaagggaacacagtctggcaaaattagtagagacgattcatgcttttgctgatggaaaggtcgggaattatttcgttttctttccttcttatcaatatttagatcttgcggtggaagcattcagacagcaatatcccgacagcaatgtgctaatccaagaaacggacatgaatgaggaagaacgcgaacgatttttaacaaaatttcaaacaaatcccgctgaaacattgattggattttgcgtacttggcgggattttttcagaaggaatcgatttgagaggggaccgattgatcggcagtatgatcgtaggtgtaggtttgccgcagatgaatcatgagcaggaactgatcaaatcatattatgatgagaaggaacaccttggatttgcttacgcttatcagcttcctggaatgaacaaagtcttgcaagctggtggtcgagtgattcgtggcatggcggatcaaggaatcgttgtattggcagatcaacgattttctagtttttcttatcgacgtttattcccacaacattggcaaacagcaagagaagtacgaagtgttggggaattggaagaaggaatacagcgtttttggttatcaaaagaagcagtaaatcaaaaaaacgaggaatgacagacgtcagcctcgttttttgattaacgatagttagtgaattgcaactcgattggtaagtcaagtttacgtaataaagcaatcacagcttgtagatcatcacggttcttacctgtcactctaatctgatcttcttggatttgtgcttttactttcagtttttcatttttgatagctgtagtgattttcttcgcgttttcacgatcgattccgttgaccaaatcggcagtttgtcgagctttgccacctagagcgtgttctgattcggaaaaatggatatttttgattggcacatttcttttgatcagcttaccaaataatacatctttgatctgttcgattttgaaatcatcatcgctcaatacaactagattgctgttctctaatttgatttctactgtagaatccttgaagtcaaagcgattggacaattcttttgttgtttgctgaatcgcattttttacttcttctgtattgacttctgatacaatgtcgaagctagcatcttttgccataggaaccctcctgatatacatataaatatttaccatacatctatcttatcataggattagggcagattcttacctgtttgctaaaattcttctcatttgagttcgaagtattttattttaatagataaactgttattcttacatttggaataccaaagtaggggagaggtgcttgtgagtaaaattatgactgcgtatcataaaaatgaaagattaaagaaaatagtggttattttgataaccggattgaccgctgcggtcgctttaaattattttttgattccagccaatgtcttttctgcagggatgaatgggatcgctcaaatcatttcctcgcttttatatgaatggtttcatatcaagatagacacaggaacatttatttttcttttgaatatccctgtgtttgtattagggtttctcaaagtaggaaaacgagcaacgatccttagttttgtgaatgttgtatgtgtatcggtgatgacgatgctgcttccagtcggacagatcactgataatattttgatgaatgccctagtaggcggtgttttattaggtcttggcgtaggattatctttaaaaatgggctttacaactggtgggatggatatcatctctcttgtactttcacaaacaactggaaaaacagtcggaaactacatgctgattctaaatggtatcattgtagtcatcgcaggcttcttctttaactgggaaagtgccttgtatacgattatttccatttatgcaatgactcaagtaattgatgccatccacacgagtcatcaaaaagtaacagcaatgatcgttaccgtcaagccagaagaggtaacagaagaactagcaaaacggatggtacgtggaatgacattactgccgtctgtcggtggctattcaaaaaaacaagggaacatgatcatgatggtcatcacccgctacgaaatgtatgatcttgatcagatcgttcatgaaatcgacgacgatgcatttatcaatattttaccaactcattcagtatttggccggtttgcaaatgaaaacgaacaaaaaatgtatcgaacaactggcgtattgccagaaataaaaaatcgttcacaaaaaaaatgaggaatcaggtttattttagaataaatttaatctattacatctaataagaacatttttataaatttaaacgagaatcttacttctaaattctcatttacaagcagctaaaaaaagagtatgataaataaaaatcgtgttaaggagtgtcgtacgatgagcgaagcaaaccaagaacggtctggacaagaaatagaactaatcaaagaacgtattcttgctgccttggaaatggtgattgatcctgaattaggaatcgacatcgtcaatttaggcttgatttatgatatagaattcaatcctgaaaatggagaaacagtcattaagatgactctaacaactatgggctgtccattagcagatattttaacagaatctatccatgacgcattaaaagaagtgccagaagtaacgaaagcagaagtcaaactagtctggtatccagcatggacgacagataagatgagccgttatgcacggattgcgttggggatacgatagaaatcttggctgactagctatgagaagcaaataggaaaaacaaaaaagccttttatcctttctagaagaaaagagataaaaggtttctttgtttataaaattttgtctgctatattataagttaattaaataaatgtgttctattgataaaggacattcaaatccctttccttttggaatccttcttttttacatcagtttgattttcgtatagtattctttctcatcttcacgataaatcgcagccccatttttttgttgtgctttaagactgccaagattttttttatttacagacaaaagtgcctcatcaatgccgattttttttgcctcttgtagtactaatgctaatccttgtgtggcatatccttttttacgataattaggggagatgccgtaaccaatatggccagcgccgtttcttaatgtttcgttcagtttatggcgcaaattaaaaattcctacatactcatgttcatcactttctaaaataaagacggttgcgggaacgtaactctcaggaagatcgattcctaaagacgttttttcgcatttttttacataatctaaaaattcagcaaatgtatagccataagcattgttgataaatccactctcatttggtccaaagctagtttgtagctgataagctttctttaaatctgcttcccgtagtttgatcagtttcatcgtattcacctctttaagtaaccttattcatttgttttctactatagcactattgttgtaaatagccatgcctatttttatttattgtgtcatatcgtattaagaatcatcgaacaatacaaatatgaattacaataaaaaaattatttgaagttcgttcattcgttacttatgatctctagaagaaagaaaacgtgaattacttcagcgtctagaattccagaaggatagtaatcaacagaagaaataatcaatatccaaatgaaagaagatagctgaatcgagaaaaagaggaaaaaagaaatgaagaaaaaataaaatagttactaatcccagagtcgttcgtttaacattgaaatcgatcatatggataaaacagattttttcaccaaccctcaatagatgatggagttgctcggatgaattatttgtgtagatggcataagggagggcgtacagaaatgaaaaagaacaaaaatatgttcttgacaaaaaacacatgtaatcctaaactaaaagatgtgatgcggctatggcggaattggcagacgcgctagcttcaggcgctagtgagggtgacctcgtggaagttcgagtcttcttagccgcataatttgtttttttgagaaggaaaaaagatatcgacggagtttctctgttgatatctttttttataaagagaaggtacacctggagcgatgagaaagaaaataacatattatctaaaagaatataggaaaaattttaaacaacggaaccagattcaaataaatcaaaaaaaatttgtgtgaaggtgggacagtttaaaacctaatagattgattcaaatagtagatttatagattctgatacaagaaatactggcaaacgatagttaaggaataaagactaaacttaaactcaaaaagaggtcatgcgaaagaataaatcgcatgacctcttactatattttgaatgtgtttaaacgttcaaataatgaatcttagtaccaaccgtttgcttcccagaatgctttcgccgcttcccaagaaccataacgtgaagtaacatattgttctgctactctttcttggtttgcagcagagtagtcaccatttaagtaagaagaatctaattggtaacggccgatgtaacgtccgttcgttgctgtgtaagaaccgcttgattctttttgtgcgatccattcttttgcagagcttgtacttgctggagtagcagcagtttctgttacagcaggagcaggttgtgtttcagcaacaggcgctgcttgtgtttccgtttgaaccgtttcttgtacaacaggttgttcagcttgaacaggttcagcttggactggtgcttcttgaacggctgcttgaggttcagcagctgcttgtgcagagccttctgttgggattgttaattgttgtcctgagtagatcaggttaatatcagaaattgaatttgattctgcaatggcattgatcaaggagttatcaccaacgtatttttgagaaatcgttgatagagtatcacctgattgaacggtataagcttcgtccgcatgagcagtcgttcccatgaagaatgcagcgccggcagccaaagttgttccaaaaagtaaagttttaagtgatgtcatgaaaaatctcctttattcgttaaaaagttttatttgttgtgttcaacgaggaatactttaacacgtgaaaatatttcataggtaaaagaagcatgacaatttatgacaaatccacgttttttgtaacagaatgatgttcgctcgatgtgaaaaatgatgaggaatttcacataatgcagaaataatgggattagaacaggtgttctgatgagaaaagaaatgtataaataacttgaaagaaattgcttttgttcatcattttatttacatattgcgtatattttttgtatttttgcttgagatgttacaataaaagaaaaaggaggcggttccaatgagtaaaagagggcagaacatcatggtagcagttgacggatcaagacaatcgatcaaagcgttcgctgaagcccttgacttagcaaaggacaatgaagcccacttatttatcgtgtcaatcatcaacaaagttgagctgacccatagtgcctatgccttttcaaaaatctatgcagatgaaaaacaaagaacagaagtagccatgctgaaaaaaatcaatgatgccaaagagtacggcattgctgagatccacgcaatagttgaaactggagatccaagaaatttgattgccaatgtcatccctggacaagaaaatattgatttgatcgttatgggagcgacaggaaaaggtgctatacaacaagcattagttggatcgaccgcttcttatgtcgtatcacatgccccttgcagtgtgttggtcgtgaagtaatgagataagggaggaatagaaaatggttcgtcctcaagaagtccgtgcgccaaaagaaaaaatagaaattttagcaattattgaagacggcacacaaacaaagaagggatactcgatcgctttagtaaagtggaaaggaaaaaaaggtgttgctctgagatgggatggagataaccaacaagataaaggattccctgtcacagctaacggttatcatccagcgtggtttgttctgcctgataaatttatggaattatacagctatgattatgcaagagccgcagcatcaatcaaagcattagataaattaacagaagagcagaatgaaatggaggaaaaataaaaaagacgaaccaatcagcctttagaaaactgattagttcgaggagtaaaaatgaaaaaaggttatttgggatgaaactagaataatgcgtataacttaaataaaacttaaagcaataaaatggcaagagggtgaggcaaatggaagcaggaaaagtattacaggaagtaaaagcactatgtgcagataaaaaatatgaagaagcgaaaagcctgatcgaaaagaacaaagaaaatttggaagaaaagtacccgatcgcacaagaatttatagaattaaaacaaggaacgatccttcaccgattcaaacatttttttggtataacagaatagaaaaaacgattaaagatcggcagaaatttgctgcatctttaatcgttttctttttaaacatgcgagggattcaattctgattcttatataaaaaatagatccaaataataagaaaaattactgaaagcgtcaattcgatgatgtgtgttattaatacagacgttgtttcccaatgcctaaaagaaaaaatttgataagtaaaatatacagcaggtaaagaggccagtaaaactgaaaacttcttttttgtccattttatgtaatagaaaagaatgcttatcataataaaaaaaggaatataaaaaacaaattgaccgatcgcgatcatactattgcctccgataaataaagtccatgatacaaaataacactttgtgcgaaatggcgcaagcagttttgtggatttatccggtaaaatctgtatcgattttgaaattagaggagaaacttgctataatcaaagtgaaagaaggagtgggattttcatggatcatgtagtgttagaaatcgatttgcatttaatcaataatattcgggtgatttactatgttgtaagtaacagtgtcgaacaacgtgtactgacgaataaaataaatggtattttagcaaagaaagacgttcaccgattcaataatggtgaaggaagttattatagtatcccagtagaaaaaattatttatacgacagtcaaagtcagagaagatctagataccaaaaaagcatatgaacctatttttacaacttattgattgacagcagatggaggaaaaaaatgaatccatatgaacaacttattcaagatttgatcgatggaaaaatcgaaaagattgatgtaaaaagagaagaattaatggcttttcgagaagcgtggctgaagttggagaatcgtaaatatgtggtgggaaaagcctcactgaacggcaatgtgacttatcattacgatccgacacgtttattttagtatgaagtattcagaaaagaaccaaaggaggacgatgcagcagcattgtcctcctttgattttacaaaagtgaaagttttacttatttgaatagatttttaaatttgtttttgacactgtcgatatttacatcttttaaaagattttgggctttctctttataaggtcctaattgttctttatgttcttcgataaatcgttttgcgccatcgaaattgccgttcttaatcatttccttgactttttgaaataattcttcttgattcattttgaacacatcctttgctatcaacatgattttttacatggacaaaacgagaaaaactgatttatccacacgtcaataatatcaaataacgatcatttttactaaaaaaacactcgattctcgcttctaaagtaggagaaaaatctccaacttgggacggatggaatttctttaactgacccatatactgaatatataacaaggaggtagaaagatgaaagtgattaaatatttgattggactggcggcgattagtggtattttgctatttggactgaaatattatactgaaggaagttatggagaaatccctggtatacttgatcagctaaatccattagttgaaaaaggagaggtctatgtaaagacacaaaaaccagaggaagtaaatgaatatggtacagcaaggtatgtgcagaaagctgctgatgccaatgggaaagaacgaacggttgaatttaatggtctttctgtgttaaaagaaaatcattatttgaaaattagcaataaaggagcacacatagaaacgtatgaggaagttcctagagaaaaagttccggagaaagcattagcaattattgggtaaatcagtttttgtattaagaatacgcccgattttattattcataatttaattatgtaaactaaatacaagtagtaaaaataatacaataatccccctgcaaaaagattgttcttttacagggggttcattttttcagcaagcacatcaaattgggatggcagggttcgaacctacaattgcttgattcagagtcaagtgccttaccagtttggctacatcccatttattcaacaaaataatcatagcactttcctaaaaaaacgcaagttatttttcttgatcggatagttgttgctttactcgtaaaaggcggcgtactagtttcttttctaatccagcaggaagggcaatcagttctgctactgacaagacggtgtccaataactgatattctttgacaggttcattcataatatgatagatgtttgctaaacgttcaatatattcaaagcgagtatactctgttcgagcaattagaaatttcaataaatcggtggctttctcgtactcttgatctgcgtaataaacaagagattgacgatacaatttgatttccagttcattgagggtagcaggtctgcgacgctcgttccactcattaatagagactttaccttgaacatttcccttgcagtcacggacaaaaataatcggaatttcatttggatccatttttttatgtgtgaatttttccattatctacgctcccttcaaaggtttggtatcttgagtataagggatttttgtttgaattactagcttttctccaaagttagcatctgtccacccattgcagtgaaaatcgccgaaaaatcgttgatcggtactgctcgattttttacaccatagggatcgttgacataaatattttctttgtcatatccagtgactacacaagcatgaacaagaggagtgactcttacttctccattatttgtggtccaagtcataaaatcagtttcatctgggacttcaaaattgatagtcacagaagtccagacaggatttcctttagatagtgcttttttgatatcatcgagttgagcatcggtttttggaaaagtgtgataatccgtttggacgatttgctgagcaagggaggcaattgggggaacatagacgcccatagcccagtctccgccactgatatcaccaacaaatccttcattaggatcgccatgagtcccatctgcattgaaaacagggacgtaatccaattgctcagctaactggtttttagttgtttcataaccataaaaagataaaagcatagaaagcgaagtgacttcacagccattttctaaagaaggagaatcaaactggctctctaatggaacatctagtaaaacttctgctttctcttttgtctttttcgttttttgtgttgaacttttttgtgcagtgttcattgtatgttctggagaatggatatgtaggtaataacttgtaccgcttaataaaagagcagctgtgccccctagaaacaatagttttttgaacgtttttttcttcatttgaaatctcccttttcagctgtttatctttcctattataaatgtatttttattggaaatggaagtattatattttaatatgtaggaaataattagtttttaaggaatatgttttaattttttgaaaaaaattcttctaaatacaacagctgttttaattgtgaaaacgaaaacagtacgctataatgcctgtaaggttgatttttaactgtaaataaaaatcaatgagttaaatctccaaagaaatagcagtggtaatgtggagaaaagttccagcagtttaggaggattttgatgacggaagaaatgattaatttaggagaacaatatgcatgcaaaccaattggttttacaaaaacggtcattggtgaagttgtatcaaaaatgacaaactgcgccgtggtcaaagttgcccaatgtgctgcagaggaccaagaattattagatgaaaaagcaagcatggttgttgcaaaatatgatacatttgaataaagaaaacaattggacgtgcggcgtgctgcaagtccaatttctttgagaaggtaaatcagtattcttttcctattttctggagaagaaaaagcgaggcgagttgtcatggtaacattctttacggttctattgtttttattcgttgttgtgatgtttttatttctttggctggttcgaaaagaaattatttatcggactgtgcgaaatcgatgggtctacttggtgatacccttcttagtgtcactagtcatttggtatacactcatcagtcatcctacagcagatgaattggcaaaagggatcttgtcagcaatgatttttattagttttttgttggacagtagaggaatcacagaagaaggacttgttttgaatagctttgacaaaaaaggtgttcctttttctgagatcaataaaattgtattatatcagccaaaaggttctaaaatcgtaaaaatgaattttttccgaaacggatggcgaggaccgatgctgaaattttctgcatcattagaagaattagttccatttttgtcccaacgcttaaacgatgaggcagagattgatattatgattgatccagaataaaaacagaggttgcgacaagatgtttgtcacaacctctgttttttatttcaaataaaattatccaaatacgcggaagcgatcggcatcgttcatgtattctttttccccagccggtgtttctggtgaaccgaatactaattgcgaacgtagtttccagtttgaagggatattccattcttttgcaactgcttcgtcaataactgggttgtaatgttgcaagtttgcgcccaatcctttatcaactaatgctacccaagtattagctgttgcgattccgtttgattgttctgaccaatctgggaagttgtctgcatataattcaaattgttcttgtagaccttttaccacgtcagtatctttgaagaataatactgtaccataaccatttttgaaaccagctaatttgttttgtgtatttgggaaagcttctgctggagtcaatgggcgaagtgcttcttcagtgatttcccaaagtttttcatgtgcatctccgaaaaggataactgcgcgtgttgattgagcattgaaagcagttgggctttctttaattgcttctttgatcaaagttgttaattcttcattagaaagtgaaacattacgtcctagatgatagattgaacggcggtttttcaaagtgtcagtaaaagttgtcataataaaatttctcctttgatttgcgttttgcatttttttaattgattacgaaatgaagtatagcaccttacaaaaagtaagtaaacagatatgctcacaaaaaataagcgaagttcaaaaaacaattttaataagaaaaatcgttatgtaaggattttcttggttatcgctttcattgttgtgttttaggaatttttgcttatttgaaaaaacagctgatatataattattaaatctctatcttctttttttatgatattgccattaaaaattacttgtttttatagaaaattagtttatatttcttaaataagttttttagttaaatttttcggtaaagatgtataatattttctgaaaatttaaagaattggggtatagattatggaaaaacagcaagacaagggcttcttcgggcagccgaagggattgtcaactttgttcttcactgagatgtgggaacgatttagttattacggtatgcgtgcattacttatctattatatgtacgatacagttgccaacgggggacttggattaccacgagcaacagcattagctatcatgtcgatctacggatctttgatctacatgtctagtatcgtcggcggatgggtatctgaccgagtgttaggagcaaaacgcactgtattcttcggtggagttttcattatgcttggccacatcgtcttggctttaccatttggtgtaagtacattgtttgtttcgatggcattgattattatcggaaccgcctttttgaaaccaaatgtttctggcatggtcggacatctttattcaaagactgacttgcgaagagatgcaggattttcgattttttacatgggtgtcaacttaggggcattattagcaccactaatcgttggtacaatcggtcaagaatataactatcatttagggttctctttagctgctattgggatgttctttggattattacaatacatcatccaaggacgcaagacattagacggagtgggtacaacaccgccgaatcctttgacaactgaagaacgtaaaggattcatccgtaacttgatcatcgcacttgttgttatcgctgcagtattcggcggggcacaactaactggtcatctgacaattgacttttttgtcaatacaatcagtgtattggggattatcttaccgttgtattactttatcaaaatgctgacttcaaaagatgtaactgctgaagaaaaaccaagagtatgggcttatatcccattattccttgcagcaatcattttctggtcattacaagaacaaggttcatctatcttagctttatttgctagtgaacgtacacaatctacgctatttggtgtaacgatccaagcaagctggtatcaatcattgaatccaattttcatctttattctgacaccagtattcgtaacgatgtggacgaaacttggtgaacgtcaaccatctacagtagtgaaattctctcttggacttttatttgcaggattatcgtacttgctattgatgttgccgggtatgctttatggtacaagtggaaaagtaagtccattgtggttgttgggaagtttcttcatcgtggttattgctgaattgtgtctttcaccagttggtttgtctgtgacaacaaaattagcaccacgagcatttgaatcacaaacaatcgctatttggttcttagctgatgcttcttcacaagcaatcaatgcacaaattgcacgcttctacacaccgggaacagaatctgcctacttcggtattatcggtgcagtagcaatcgtcggtggtatcttgctatttactgtgaaagaaccaatcaaaaaactaatgggatctattcattaatcaatgaacataaagacaggaattgcttatttgcagcagttcctgttttttgcgtatacttaaaaaagtagaaatgtcagaaccttaaaaggatataatttgaagaatatagaacaaatgttcagtattttttgatataataaaggagcaccgtatcatgtgttgaaggaggaaaagcatgtctttacaatttattcttggaaacgggaaaaaagatcaccgtcaagtcttgatcgacgaagcatccgcttggctcgaccaggatgcaagtaaccaagtatttttccttgttcccaactacagcaaattcgaacaggaacaagaaattttagcggagatgcgaagaagaagcggaaaaaaagctttcagcacaacaaacgttcaagtatttagtttttatcgtctggcttggtatttgctgcaacagacaactcttcttacaggaaatgaattatcagaatcaggatctgcaatgatcttgcgacagattttagaaaaaaatgaggaagaattaacaatctttcgcggagaaatcaataaaagagggtttattcgtcaattacaagaactctacagtgaattgcgtacaggaaatattcaaccagaagacctgatgcttttatttggtgattcacctaatgcagaagaccagcaacttaaaatgaaagacttgaagctgattttttcagcttatgacagcgaattgactcaacgtgcactaacaaatgaagatgcactatctatactagcaaattatatgcagacacaagatttcaacaacgtcaaatttattgtcagtggtttttctcgaatcaatggtcaagagtatcaattactgcaggcaatgatggaaaaggggcaattggttgtcgatttattgctggatcgtccttatacagcggatcttccagaagtacttacgctctttcatgagactggaaagctttatttccgtctttttcaaagtgcaagagaacggaaagtccctatattagtggaccgatttgcaccagagcagactcgtccgacagagcttcaactgctgcaaacaatgtgggaagagacatctagccaaaagaaagcggcagtacacaaattagggggacaagagcatctccatttgtgggaagctgaaaatccaactgaagaagtccgacaattagctgttgaaatcagacgactagtcagtgaagaaaactaccgttatcgtgatatccaagtgctgacaaaaaatatgtctttatatggaaatatccttcggccgatctttcaagaaatggcaattcctttttatatcgatgaagaacaaatgatggaaaatcatccgctgatcgaatggatcaacagtctgttcgctcttgaccgctattcttatcggctaagtgatattatgcgttttttcaaaactgaattatttctgtcgacggaagcagaaaccgaacttgatgaatggaaacaagagcgagatgaattcaggaaaaaactggacatcactgaaaatgtagcacttgcttacaattatcagggaacttattggactcgtgaaaaagactggcagtttgtggcgtatgattttgaagcagaacagattgaagacgtacagtatttggaagaacagtcaaatacgattagacgattatttcagaaagctgtaccagtatttttgaaaaaaataaagaaaagcaaaacaggacaagaggccgcaaatgttttttatcaatttttgatccaaagtggcgtacagcaacaattattgttttggcgtaatcaggaagtagacagaggaaacttagaagcggcaagaaaccatgagcagacatggggagcgctgattgatctgttggatgaatatgtagtaatttatggtgaatcggcttttgactggtcactgttccaagaaatcattacgagtggtctagaaaatctaagttatggtaaaatccctaccgcaatcgaccaagtgcgaatcaatcgtttggaattagttcgaccaaatcaagctgccgtcacttttgcattagggttgaatgatcaagtgtttccagaccgaaaagagacaaaaggattgttgtccagtgaagaacgagaagtattaaatcaggccttgccagatggacagtttttattcgacccatcaaaggaaagtatctcttttgagcctttccaagcctatcttgtttttctttccggaacagatcgattatatcttagttatgcacaaagctatgacacagatggctcgctgaagatgtctccttatttgcgtagaatcacagaatatttatctgttcccgtcgagagaaaagagcatttgacgatcgaaagcgaccctaattgttatgtagggacttacagaagcggaatcaatacagtcaataggatttatcgattagctttagatgaaaaaaaacctgtaccaaagcactggcaaaagctcaaagaattagtactgaattcgtcatggcgaaattttgctttacagatttttgaaagtcaggaacatttaaatgttcctgtttcgatgccagaaaaaatggcggaagagctttatggaaaagaaatttatacttcaatttcacgtatggagaatttttataattgtgaatacaaatacttcatgcaatttggtttgaaattgaaagaacgaactgtttatggtctaactccagcagcaactggtgatttttatcatgaatcattggatcgtttcttcaagctactgttttcaaaccaattatccttagtgaatatgtccgatacgcagcgtagagactttactgaaaaagtgctgcaggaagtattcggagaacttcggtttgagatattggatagttctgcaagaatgaactatatccgctaccagttaggacagacgattcaaaaagtggcatgggctttgcaaaaacagagcaaaaatacaggcatgcatcctcttcagacagagattctatttggtcagattgctggagcaaaaggtatcacaggtctggaattaccgttgagtaatggtggaaaactccatgttcgagggaaaatcgatcgaatcgatgtagcttctgaacaagaagatacttggctaagcgtcgttgattataaatctagcggacgttcattcgatgtcacagaagcttattatggcatggctatgcaattattgacgtacctggacgtagcattgatggatgcggtacgtttgactggaaaggcggctgttaaaccagcaggatcatattatttacatgttcataatcctgtattgacggagacagatgatgtagagaagaatacattgaaaaaatttagttatgatggcgtttttgtcgatgatcccgctcttttagaagtactagatcattcactggaagcaaaagaacaatcactgatctatccagtgaaaaaaaatgcgaaagatgaataccaaaaaggtagtttcagtaaagacaaatttttcacggaagaagaactgcaactattcatggcgcataatcgggaaaatatgcggttagctggagatgcgattacttccggagaaatcaaactaaatccagcttataaagataaacagcggattgcctgcgaattttgtccattcagaagcatctgtacgtttgatgtgatgctgaaagaaaataattaccaccgtctggagaaaatagataaggaagaagcactgcgtagaatattgaaaaggagtgaagaagagtgaatcaaattcctttaaaaccgcaaaatgaacgattcacagatgatcagtggcaagcgatttttgatcaaggagataatctattagtctctgcgtctgccggatcaggtaaaactacagtgcttgttcgaagagtgattgaaaaactaaaaatgggttttgatatcgatgaattattgattgtgacatttactgaagctgccgcaagagaaatgaaagaaagaattcaagaggcattacaagaagccgtcaatagcgaaagtgaccctgtacgtagacagcattttactaagcagttagttttattgcccacagcgaatatctcaaccttacatgctttttgcctgacagttattcgacgttattattacttaattgatattgatccagtctttcgtatgttaacagatgaaacagaaacgatcttgatgaaggaggatgtgtgggatgagctgagagaagcactttatgcagaaaatgatgaacgatttttccaattaacaatgaatttttctaatgatcgttcagatgacggcttgacgaatctggtgttttctctttatgagtttgcccgtgccaaccctgaccccaaaaaatggctagaacagttaagcgataattatcgtttgcctgaggggctagcgaaatctcgattatatcaagaacaaatccgtcctttagttttggcagatatataccaatgtgtacaattatatgaacagatgactcagttagcacaaggtgaaggattagaaaaaatgcatgagcaagtagctggagaacaacagcagatcaagaatatctatgaagcgttctcgcaagatcggttagaagaagcttatgctggtttggaacaactaactttttcaacttttaagagcagtcggaaagcagaattgaaagaaatttccaatgaagtcaagggcatgagggataaagcaaaaaaactgattcagcagataagtaaaagttattttcctgtttccccaagccaaatggaagaattaacggacaaagcactaccgttagtcgaagaaatgacaaaagtcacgcaaagcttcatggacggtttcagtatgcgtaaacgggaaaaaggtgtgctggatttcaatgatctggaacatttagcgttgcagattctcacagaaaaaacgaaagatgcatggctgccaagtgaagcttcaaaacattatcgaaaaaaattcaaagaagtaatggtagatgaatatcaagacgtgaaccaattacaagaagccattttatactggctaagagaacctgatgatacaaaaggaaatatgttcatggttggggatgtcaaacaatccatctattctttccgtttagcagatcctagtttatttatcgggaaatacgagaatttctcaaagaaagaaggcggacgtcgaatcgttttggctgagaacttccgctctagaaaagaagtcctttcttttacgaatcttatttttgaacaactaatggatccagcagtgggtcaaatcaattatgacgaagcagccaaactgatccaaggattttcagactttccagagaatgaacagtttgagccggaaatcatgatctatgaaaaagaacaggaagaatcagagattgagattccgacggatgatatactggaagacaaaacagaaggcgaactttttatgacaggactaaaaattcgtcaattaattgattcctcctttatgatttatgataaaaaatcaaaaaaaagtcgtccgatagagtacaaagacattgttctcttgacacctacaaagaagaacaacttaacgattttagagattttcaaaacattggatattccattagagatgaaagatgctcaaaactattttcaagcgacagaaattcgcacgatgatctcgctgctacaattaatcgataatccctatcaagatattccgcttgcggctgtattgcgctcaccgatcgtgggtctgattgaaccagaattagccagcattcgattagctgaccgtgcacatacttactatgatgctgtgcttgcttatcaagcatcaaacgaagatgaattagcagctaagctggaacattttggcaagcaactagagcattggcgagaacttgctcgccgttcttcgatcactgacttgttatgggatatctattatgagacgggatatctagagtatgtggtcggtctgccagcaggggcacagagacaagccaatctttatgcattggttgatcgtgccaaagcttacgagcaaagttctttcagaggattataccagttcgtgcgtttcattgaaaaaatgcaagaaaaagataaagacttagcagaaccagtcatttcaatagaagataatgctgttcgcgttatgacgatccatgcaagtaaaggcttggaattcccagttgtatttttgttagatatgacaaaggagttcaacttacaagacttgcgcaatcggtatgcttttgaagaaaaacttggagcaggaattcgctatatggatcctgaaacacgagtgttatatgatacgttaccgtttcaagccatcaaattggtaaagcaaaacaaattgttgtcggaagaaatgcgtaaattgtatgtaggattgactcgggcagaacaaaagcttttcattgtcggttcctataaaaataaagagcaaatgatccaaacgtggtctgaagcagctgatcatgaggagttggtttttgatcctgcgctacgtttgaagggcagaagcagcttgatgaattggattggttacggattgatccgtcatcctgaaatgcagaaatacttagaggaagaaatttcgacttctcttcttcaacattcaaatgcacagttttctatttcatggatgaatcagcaatcgatcattgaacaaagacagttgcttgctgaaaaagaactggttaacttagatcagcagatgaaagaagatgaaactttattagcagattcgttacaaaaacgtctggcatatgaatatccttatcaagcttcttcacaaaccacaagttatcaatctgtatctgaaatcaaacgattattcgaagatccagatgatacacaagaatcacgtttgactctggaaagcagtcagaacaaagcagcatcccgtcaatttcgttatacgcaagaacaactagcagaaccaaaatttttgcaaaaagatcggcaagtgtcagcagctgctgttggaactgctacgcatgctttgttacaattactgccattagagatgccaactacagagagtatccatcaaaaattacaggaattggtaaggaaacggttagtagacgaaaaagtcgcgaaaaaagtagatgtttcttctattatatggttctttcaaacagaacttggtcaacagctgattgccaacaaagaaaacgtaaaacgagaacaacctttttccatgctgcttcctgctgacgaagtatttcaagactatccaaatcaagaagatgaactattaatccacggaatcgtcgatggatacctagaagaaaaagatcatctcaatatctatgattttaaaacagattttattttacatccggatgatccagcagaaatagatgcaatcgtccaaaaatatcaaggacagctaagactttaccaacaagcaatgtcagaagctttgaataagccagtagaaaatgttttcctaattttgcttcgagtgaaacaaattataaacattaacaaataattataattgagcaaacttgacttatgttttgtaaggattatgctatactctgggaagaggtgagtatgatggagctaacacagacagaattcgttttatgccctaaatttgaaaaaacattctctattttaggaaaaaaatggaacggattgattatcgatgtactactcgaaaacggtccgcaacgctttgttgagcttgcggcaaaaatcccgatggtcagtgatcgagtattagtcgaacgcttgaaggaattagaaaaagaaggaatagtcactcgaaactttgcctgtagcgaaaagagccgttcagaatatctcttgactgaaaaaggagcagacttgcaaaaagcgatgcgtcaaatacaagtttggagcgaaaaatgggtcacagaggaagaatgcggttgattttgtaaaaaaaatcttgtaaactatagtccatacgaataagtaaagaacgatgacgaaaaagagtagtttggctaaaccagttcagggagatctgtcgcagactgaaagcagatcctgtgtttgaaaaatgaagttcactttccgagttcgtctgataaaatcagaccggcaattgtcgttaacgaagtaagagtgcggtgtaagtcatttatccgcaaattaggatggtaacgcgaagacctcgttccttaacaggaatgaggtctttttgttttgtatttggaatttaaaggaggaacaagcacatgtctctacaagcacaattacagagcttgaaagaagcaacgctcgtcaaaatcacagcggcacaagatttaaatgaattaaatcaaatacgtgttgaaacgttaggaaaaaaaggaccgatcacagaagtattacgtgggatgaaagatctaagtccagaagagcgaccaaaagtcggaagtttcgcaaatgagatccgagatcttttgacagaagagatcgagcgaaaaaaacaagtattagaagaagaagcgttaaatgcagctttggcaaaagaaacaatagacgtgacactacctggtagaaaagtaaaacatggtacacgtcatatcgtgacacaaatcatggaagaaattgaagatatttttgtgggtatgggctatcagatcgtagaaggatatgaagtagaatctgatcattacaatttcgaacggatgaatctgccaaaagatcatccagcaagggacatgcaagatactttctatatttcagacgagatattgattcggacacatacttcaccagtccaagcacggacaatggaaaaacatgatttctctaagggtgctctacgaatgatctcgccagggaaagtcttccgcagagatacagatgatgcgacccacagtcatcagttccatcaaattgaagggctagttgttgataaaaacatcacaatgggcgaccttaaaggaacattagaagtcgtaatgaaaaaaatgtttgggaaagatcgtgaaattcgtttgcgtccaagttatttcccatttacggaaccatcagtagaagtagatgtcagctgtttcaaatgtggtggtgccggttgtaacgtatgtaaatacactggatggatcgaaattttaggagctggcatggtacacccgaatgtgttgaagatgtcaggaatcgatccagaagaatattcaggctttgctttcggccttggaccagaccgcgtagctatgttgcggtatggagtgaatgatatccgtaatttctatcaaaatgacttacgtttcttaagtcagttcaagggggagtaagaaaatgttagtttcatataaatggctcaatcgttatgtagatttatcgaatgtaacaccaaaagaattagcggataagatgtctgtgacaggaatcgaagtagagggagtaacggttccagaagaaggcttgaaaaaaatcgttgtcggtgaagtcaaggaatgcgtaccacatccagattctgatcacctttctatttgtcaagtcgatattggcgaagacgaactgtctcaaatcgtttgtggagcgcctaatgtgaaggttggaatcaaagtgattgttgcacttcctaactcacgtatcgctggtaatgtaaaaatcaaaaaaggaaaaatgcgtggccaagtatcaaatggcatgatttgctcattacaagaaattggctattcagatagtgttataccgaaagaatacgctgaaggtatctattatatgccacaagaagctgtaaatggcgatccagtttttccttatttggatatggatgattcgattattgaattatctatcacaccgaatcgtgcggatgcattgtcaatgcgtggcgtagcttatgaagttggggcaatttatcgtcagactcctacattcgatgacgaaaagctggtagaatcctcacgtcctgctagcgataaaattcaagtggaagttgaagataaagaagcagttcctgcttatcaaatcagaatcattgaaggagtaagaatccagccaagtcctcaatggctgcaaaatcttttgatgaacgaaggcattcgtccaatcaacaatgtagtagatgtgacgaactatattttgcttttattcggacaaccactacatgcatttgactacgacaagttgaaatcaaaagagatctttgtccgccgtgcaaaagaaaatgaaacattagtaacactagatggagaatctcgggaattgacaactgacaatctcgtcattactaacggcaaagaaccagttgctttagctggtgtcatgggagggttagactcagagatcacgaatgaaacaacaacagttgcactagaatctgctttatttgatccaatttcgattcgtcgtacagcaaaacaatttaatttgcgtagtgaatcctctgcacgttttgaaaaaggaatcaaccatgcgactgttggagaagccagtgaggttgctgcagcaatgatcgtttctcttgcgggtggggaagttctacaaggcgcggtcaaaggctcagagatcaaagcagaagacgtatcagtgaagatttcacttgaacgcatcaatcaatatttaggaacatctcttgtcgttaaagaagtaaatgagatttttgaagcacttggatttagctatgaagaaaaggagcatgtttattccgtagtagtaccaccaagacgctgggatatccaaatcgaagcagatattatcgaagaagttgctcgtatttatggatacgaccagttgccatctacacttccaagtggagaaacggttgctggaagcttgtcaaaagaacaagaaactactcgtaaaattcgtacaatctttgaaggaagcggattgagcgaagcaatcagttatgcattgacaacagaagaaaaatcaagacagtttgttataaatgaaagtaatattacacgtttggactggccaatgagtgaagagcgttctgtattgcgaatgaatttgatcagcggactattagatgatatcagttataacactgctcgaaaaaatacagagattgctttatatgaaattgggcgggtattcttccaagaaaatgatccgtgcacacatctgccgcaagaagtaaaacatgcagcaatcgctgtttctggtatttgggaagaaaaagattggcagacgaaagctcaaaatgtagactttttcaccatcaagggtcttttagaaaacttatttgaacaactaggcatcactgaagatgtccattatcaaacagtgacagaaatgaaggaaatgcatcctggaagaactgctgcgatttaccttggcgaaaaatttattggttttgtcggtcaagtgcatccaacgattgcaaaaagttatgatattccagaaacatatgttgctgagtttgatttatctgctgtagtggaagctgctcaaaaagggatcgttttcgaagcagtgacaaaattcccagcagtcagccgggacatcgctttgcttgtaaaagaaactgtgacaaatcaggaattaacagaagttatccgttctgctgccggaagatttttaacagatatccaattatttgatgtctatcaaggagaaaacattgaaaaaggacataaatccatggcgtatagcctgacattcgtcaacccagaagcaacattgacagatgaagaaatcaataaaggaatggaaaaagtcgaaaaagcgttggtagaaaacctagaggcaagtattcgctaagagggaaaatatagtaagtaacgatcaagtagcttttgaagaccatatatttgaaaaagagatgtgacacaacttcgtcacatctctttttttgattttaaaaaaggaatagcacagagacgagataaaaaaacaggcctttacagcctgtttttttagagtaaatgaattaatggaagtaattgattcccattgctgattttacttcagaaagtgtttgtgcagctactttagcagcttcttcactacctttacgtaagatttccataacagctgaaggatctttttccaattcttctcggcgcgcacggatcggtgcaaattcagcttccaatacatcaatgaggtatcgtttgatctttacatcaccaagtccgccgcggcggtaatgagctttcatttcttcaattgcttctttatctgttccgaatacatccaagtaggtgaagaccatattcccttctacttgtccaggatcttgtacatggatgtggtttggatcagtatacatactcatgacttttttctgtaagacatcggcaggatcggagatataaataccgtttcctaacgatttactcattttgccatttccatctattccaggtaatctacccattccttttggtgggaatacgccttttggttctaccaagacttcaccatatgtatgattgaagctttgtacgatttcctgtgtctgctctagcattggtttttgatcctcgccaacaggtacaagattcgctttgaatgcagtgatatctgctgcttgagaaacaggatagataaagaatcctgtaggcacgctttcaccgaattttttttgttcgatttctgttttgacagtcggattgcgccgaacgcgtcctacgctgactaagttcaaataatacatggttaattcagctaattccggaatttgtgattggataaataaagtagattttgcaggatctaatcccacggctaaatagtctaaagcaacttgcaagacatttgatgaaaccttctcaggatttttagcattatctgtcagtgcttgcatgtcagcaatcatgacaaacagttggttgtcttcatctgcctgcatagccactcgggtttttagagaaccgacgtaatgccctaaatgcagcttaccagttggtcgatctcccgttaaaataatatttttcaaaaaagacacctctttacgatttgtaagtctgagcacttaatatcttaccgtttttcctgaaaagaaacaacagttcctaatgaaaaaacaaggaaagaggataaaataactaatagattagaaatggaagaaatatttatgggagaataaacgttctaagaaactttacaaattactaaactatcagatataatgtattttattatacatctttaaaagaaatcttactaaataataatgggagtgtaattctatggcaatgattaaatttgatcacgtggataaatattatggcaagttccacgcattaaaaaatatcaatctcgaattcgagaaaggagaagttgtcgttgtcattggtccttctggttcaggaaagagcacgatgcttcgctgtatcaatggattagagacgatttcttcaggcaagctactaattaatgatactgacttgcatgataaaaagacaaagttgacagaagtccgaaagaatatcggcatggttttccagcatttcaatttgtatcctaataaaaccgttctggaaaatattacattagcaccaatcaaagtgttaaagcaagaccaggcaactgcagtcaaaaacgctgagaaatttctgaaaactgtcaatatgttagataagaaagattcttatccttccatgttatccgggggacaacagcaacgggtggcaatcgccagaggtttagcgatgaatcctgagatgctgctgtttgatgaacctacttctgctttggatccggaaatgattggtgatgtattagacgttatgaaaaaattggctcatgacggtatgtcaatgattgtcgtgacacatgaaatgggctttgccaaagaagtggcggatcgtgttatcttcatggctgatggagaagtattggaagacagcagaaatgtgagagactttttcgaaaatccaaatgaagtccgagcacagcaatttatcagtaaagttatcaatcattgataggaggaaaaagatgcgcaggttaaaaaaaatacgcctgattttccttttaggcattgcttttcttgcactagccggatgtaaaggaaatgggttggcaaatgaagatattttagagcgaagcaaatctaccaatgaaatcatctggggtgtcaagtatgatactcgattatttggaatgatggatattgagagcagaactgtacaaggatttgatgtagatattgcaaaagcaatcactaaaaagatccttggtgacaatggaaaaacagaatttgttgaagtcacttctaaaactcggattccattattgaaaaacggaaatatcgatgcaattattgcaacgatgacgatcacagatgaacgaaaaaaacaggtcgacttttcagatgtctatttcgatgctggccaagctttgttggtaaagaaaggaagccaaatcaaaagtgtagatgatttgaatgcttctacaacggttctagcagtcaaaggttctacatcggctgcgaatatccgacagcatgcaccagatgcaaaaattttagaattagaaaactatgcagaagcatttactgctttacaatctggtcagggagacgcgatgactacggataatgcgattttgttagggattgcagatgaaaatccagagtatgagttagttggtggaacatttactaatgagccttacgggattgcgatcaacaaagggcaagaaaacttcttgaaagctgttaatcaagcgctagaggaaatgcatgcagatggcacatacgataaaatctatcaaaaatggtttccaaatgaaactgaaggaaaagtagagtaagggggagaggcaatgagcgaattgatacagacttatggaccaatctttgtcgacgggttcaagatcacattgttttcgagtgtcttagcacttgtgtttagtttgattatcggaacgttaatggcaatcttccaattatcaaagaataaagtagtgagcgccttagcaaaggcatatgtagaattttttagaaacattccattattaatcatcgtgatgtttttttatgttgttgtaccgatttattggtttaatctagatggattccaagcaggtacgattggattaacgatctatacatctgcttttattgctgaaacagtacgttcagggattcaaaccgtaccaaaaggtcaaacagaagcaggactatcttctggttttacctattcagaaatcatgcgttatattgttttaccgcaagcattcaaaatcgttattccgccattaggcaaccaatttatcaacctcgtaaaaaattcatctattttagcaatcgtagctggtttagatttgatgtatcaaggagacttgatcgccagtgaaacattcaataccttcgatacgtatatcatcgttgggttattttacttagttatcacgctaccgttatcttacttaatggtttatcttgagaaaaaatgggcggttcgttcatagaaggaggggaaatacatggattttagcggcgctttttcatggatgaatatccgttttttattggaaggattaaaggttactgttgaagtttcattgttttcgatcatttttagtttcttgatcggtggtctggcaggtgtgattcgttttgcgaatatccctttcttttccaaaatccttggtgtagtgattgatattatacggaatcttccattattattgatcattttcttcacttactttgccttacctcaaatcggcattcagatgaacatcttctggtccgctgttgcagcattaacgatttttgagtcagctatgttgtcggaaattttccgagctggactcaatgctgttccaaaaggacagatggaagcaggattatcaacgggactgacttatgtagaaacgatgcgaacgatcgtgttaccgcaagcatttaaatcaatgatcccggcaattgtgagccaattgatttcactgatcaaagatacttcattagcagtaatcatttctttacctgaactttctcatcaggcacgtattatttatggacagaacaccaattatgtgcttccgatgttcatcatcatgacacttatgtacttcgtggtatgttacgcgctttctctgctttccggttacttggaaaagagacggtacagttattaatagatgattcttttagcggttgtggcaaactaaagtcacaaccgcttttcctctttccattcgaaaaaaagagatttcgattgttttaagcaagtaagagcacttgaaaattcacgctaaaaagtacacaatagggaggatagaatttattgaaaaaaaggatgatacgattgacagataatcgccctatcggatttattgattcaggtgtcggcggcttgactgtagtaaaagaagccctgaaacaattaccgaatgaaaatattttatttgtaggagacacagcacgctgcccatatggccctagacccgcggaacaggtaatccagtatacttgggaaatgacggattatctggtggagcaaggaatcaagatgctggtgatcgcctgcaataccgcaactgcggtggctttagaagaaatcaaagctgctctttctattccagtcatcggtgtgatccttcccggtactagagcggcagtaaaaaaaacacaaaataaacaagttggcattatcggtacgattggtacggtaaaaagtcaagcttatgaaaaagcactgaaagagaaagtaccagaattgactgtgacaagtcttgcttgtccaaaatttgtttcagttgtcgaaagtaatgaataccattcatcggtggcgaaaaaaattgtggcagaaacattagctcctttaaccactaaaaaaatcgatacattgattttgggatgcacccattatccattattacgccccatcattcaaaatgtaatgggagaaaatgttcaactgatcgattctggagcagaaacagtaggtgaagtatctatgctgttagattatttcaatctgagcaattcaccgcaaaatggtcggacattatgccagttttatacaactggctctgccaaacttttcgaggaaatagctgaagactggcttggaatcggacacttaaatgtagaacatatcgaattgggaggaaaataaggatgcgtcatgacgggagaaaagctcaagagcttcgcaaactggagcttcaaacaaatgttttcaaatatccagaaggatcggtagtgatccgttttggtgatacaacagttatttgttctgcaacaatagaagattctgtacctccctttttgagagaaacaggaacagggtgggtgacagcagaatatagtatgctgcctcgagcaacgagtacgagaaatcgtagagaaagcagcaaaggaaaactttctggtagaacaatggaaatccagcgtcttattggtcgttccttgcgtgcagtagtagacttggaaaaattaggagaacgtagtatcatcgtagactgcgatgtgatccaagcggatggcggtactagaacagcaagtatcactggggcattcgtggcattgaaattagccattgaaaaacttttaagagaaaaagaattgtcagaagatccaatcaaagaacatcttgctgcagttagcgtaggaatcttaccagatgggacttgcgtcacagatttggattaccaagaagattccgcagcacttgtagacatgaatcttgtaatgacagaatctggaaaattcgtggagattcaaggaactggagaagaagcaacgtttgatggtgaacagttgaatgaaatgctcttttttggaaaaaacgcgattgaagatttgatcaaagagcaaaaacatgctttgctaacagagtttgctcaaaatgatgagcggatagaagaaacaaaaacaatcatcattgcgacaagaaatccaggaaaagcagaagagtttcgaaatatgttcaaagaagcgggatatcatgtaaaaacattacttgactatcctgaattgccagatgtggaagaaactggcagcacatttgaagaaaatgcccgattaaaagcagaaacgattgcacaattgcttgatcagccagtcttagcagatgattcaggtttgaaagtggatgctttaggcggtatgccaggaatctattctgcacgttttgcaggggaacaaaaaagtgatgcggggaataacgccaaattattatatgaattgacagatgtgccggatgaaagaagaacagcacaattccattgtacgttagtattcgcggcacccaaaaaagacagccttgtagtagaagcggaatggcccggtcgagtagcccgtataccatctggcgaaaatggctttgggtatgatcctttatttatcccagaaggtaagaaacaaacagcagcagaattatcgagcgaagaaaaaaacaagatcagtcatcgggctcaagcaatgaaaaaattgagtgccgagtggaaacaatggctggaaggagagagatagatgcggtatttagtagtaagtgataatcatggagacagagatatcctcgttgacttagtagatcgttatcgttctgaagtggatatctttttccattgtggtgattcggaattagaagcttctgacccattatgggatacattccaagtggttcaaggtaattgtgattatggaccaggattcgaacagaaaaaagtgatccaaactggtcaggatacagtattcatgactcacggtcatttatcgaatgtccgatttggtttgacacagttagcaatcgaagctcgagctgcaactgccgatatggtgttttttggtcatacccatcaaataggctgtgagatggatcagaaaatcctgtttttgaatcctggtagcatttctcagcctagaggcccgatccaaataccatcatatgctcttatcgaaagtttagatgaccaaatttctgttcaatactataaccgtgcccatcaggcagttgaagagttggccttttctttttcgagagagcgctgaataaaaaaactctaatttttaataaaaataagctttattttatgaattttgcatccggtttcggtaaaatagtagtgttgaatgaaatagaaatggaggccatcagatgattggacctatagtaagagaaatgctgctggaaaatcaggaaacgtttttgattcctgcagaaaatgtggcaaatgttatgtatcatcatccattgtcccatggtttacttgtgttatcgaaggtcggttattccaaaattcctgtattaggaaaagatgatcactttgtaggactagtaagtttatcagatgtggtcaataaaatgattgacttgcaaacaatcagcatggacccgttagaaggactaacggttgctgatgtgacagaaacagatgttccgacaattgatgaaaattgggaactagaagaagtactccatttgttagtcgattcgccttttttaccggttgtcacagaagatcggattttcaaaggaatcattacaagaaaagagctgcttaaagccgtaaacttcatggtgcatgaattagaacgtcgtaatatattgtctccgaaaatcgaagaattaaaagaacaaatcgatatcgtgagctaaagaacgagaaactaaaagataatcaaaaaataagtagaaaaaacagcgtaccagttttgactttatcttgaaaaagaggctgggacaaaagcgtttaactccaagaaataagaaggaattcacgaaaattgcttttcaaatttttgtgaatttcagcttatttccgaaggagttgcttctgcttccgccgtttatacgtgtttagagcgtgggacaaaagtgttctttacttttgtcccacgctctttttagtgagattcgttgcatcgtttgtccaaattattttccgacagcaattggactgttcggaatcgtgaaaccagaagctgtcaattctttgacataggagctcaagaactcttcttttaaggcatattgttttccgttcaatgcgtagcagaccgtacgaatcgcaaaattgctgtttccaagatccactaatccaaagatagaaggttcagtttggagctcttcttggtatttttcagctaatgtacgatttactcgatcaatgatctcatagattttgtcatatccttcttcaggaacaatccgaatatctaaaagtacttgcatatttgcacgagagagattgctgatcgtggtgatgtttcgattcgggatgaaatggacagtaccatccgttgctttcagctgaagggtacggataccaacagatacgacggttccttcaatcgttaagtttgctagcttgatgtagtccccaacatccatctgttgttccatgataataaaaaatccggtaataacatcactcatgaacccttgggcaccaagaccgattgccacacctgcaattccggcaccagccaaaagtgatccgatcggcacaccgatagcagataaaattgcatagataaaaaagaaaccaagggtataatgaaaaatagtatttaaaagactatgtaaagtctttaagcggctctcgtttagaatggcttttttagaatactgattaaaagacttatcaatcagatattttcccacacggtgaagaatccaaaaaaggacgatcaaaaaaatcagatataaacttttttggataaaggcagccaaaatggcgtcccaatcaatcccgtcccaaaaccgctgaaacgcatttactttgctgacagcttgatctgtcaatgtctcgccagaagagtctgtcgtaccggcagttgctaataatgaaaacataaaatcctcttttctaaaatttgattctttctgtattgtaccaagaagttttcaaaaaaggaaatagcaaaaataactataatgaaggaaaaaagctgaaaataaaatgacaaataatatggataatgataaaatgtggagaaaataacgaaggtggtaagtatatgcaaatcgattggaacaatctaggtttttcttatatcaaaactccttggcgttttattgccaaatggaaagacggacaatgggaagaaggagaattgacagaagataattacctgacgattcatgaaggctctccagcgcttcattatggtcagcaatgttttgaaggtctaaaagcttatcgtcgaaaagacggcaaggtcaatctctttcgacctgaacaaaatagtcgacggatgaatcaaagtgctagacgattgctgatgccaatggtccctgaaaagatgttcgttgatgctgtcaagcaagtggtaaaagcaaatgaagattttgtgccgccctatggaacaggcgctacattatacttgcgccctttactgattggggtcggtgaaaacattggtgtccatccagctccagaatatttatttgtcgtcttctgtacgccagtaggagcgtatttcaaaggtggactaaaaccaacgaattttattgtatctgattacgatcgtgctgctcctaaggggactggtgcagcaaaagtcggcggaaattacgcagcgagtttacttccaggaacagaagcaaaagaactggattactcagattgtgtttatcttgatccagccacacatacgaaaatcgaagaagtaggtgcagcaaatttctttggaattacaaaagacggaaaattcatcactccgcaatcgccctctatcttaccaagtatcacgaaatattccttgttgcagttagctgaagaacgactaggactgcaagcaattgaaggagatattttcattgatgatctagatcaatttgcagaagctggtgcatgtggtacagcggctgttatttctccaatcggtgggatttatcacaataacaatcttcatgtattttatagtgaaacggaagtaggaccagtaacaaaacggttgtatgatgaattgacaggtattcaatttggagacatagaagcaccagaaggctggattgaggtcgtggaataatttcaaagtaatgagttgaaaaaaacgtaaaaagaaaaaatcaggaagagactttaaaaagttttttcctgatttttatatgttttactttaaagaatgcaacaaaagtttatgaaagatggacacctttgtcaacgtagataatatcaccgatgattccgctggaaagtgggctgattaagaaagcacaagcattaccgacttcttcgatcgtcacaccttgctgatcaggcgtacgagattcagataactggatcagtttttgatagtctttaacacctgtgacagctaatgttttgattgccccagctgagattccattgacccgaattcctttaggcgagaactcagctgccaaataacggatagcagcttcaagagaagctttcgcaatacccatcatgttataattcgggattgcgcgttctgaacctagataagtcatgctaacgatcccgctgtttggtgcaagaaacggttgtgcgtattttgatacagcaattaaagagtagctgctgatatcttgagctaattgatagccgtctctggaaatatcagacacatttccggacaattcttctttgttggcgtaagcaactgcatggacaaggccgtggatctccccagcatattcaccgatggcattcattgctttttcgatgctttcgtcgctagaaacatcacattctacagtgaatgcttcttcgccgaccaatttgactaatgattttttcattcgttcattttggtaagtatagataatttctgccccttgtttcaacattgcttcagcacaaccccaagcaatgctttttttgttagcgacgcccataatgacgattttttttccttctagaaatgacataatgactctcctttgtttctgataaaaatttgatagtcgtaaaaaaatagagaataatagctaaaataacttcttgatttcttaattattagtcaaaatgttttgattgtcaaactattttttcttaaattaaaaaagattgctaaatatttaggaatatgatactttgatagtcaaagtaatgaaaatggcaattgcctgaaagaaggagtttaattatgtcttacgtattatctgctactgaagtaatggaattgattcctaatcgttatcctatttgttatattgattatgtagatactttagaaccaggaaaaaagatcgttgcgacaaaaaatgtaacaatcaatgaagattttttccaaggtcactttcctgacaatccagtgatgccgggtgcgttgattctagaaacactggcacaagcaggttcgatacttatcctaaaatcagaagagtttctaggaaaaagagcttatatcggtgggatcaataaggccaaattccgtcaaaaagttgttccaggagatgtgctgaaatgtcattttgaaatcaccaaaatgaagggatcagtcggtacagcgttatctgcagcatatgtagatgataaaaaagtctgtgagtgcgagttcacgttcatcgtcaaccaaaatgcttgactataaaacctgatatagcaaaacaaaaggaagcttacttgctttttatgtaaaaagaagacgcctgaatcctagcatacgttgtcatctatgcaggattcagacgttatttttttatttttgttttgcttcttgcagtatattgattttatcgatttttacttcttcttttggtttgtctgaactatctgtttcgatatttgcaatagcatccacgacatccattccttcaatcacttggccgaagacagtataatggccatctagtgaaggataaccgccgtttttataagcgtcgatgattgcttgaggatagtcgtcttttaaaagaccatcatgcatatcatctgtattttgaacgataaagaactggctgccgttactgttaggatcttgtgagcgagccatagataacgcacctcttatattataaaggtggttgttgatctctgtttcaaatccttctccccaaatgctttcccctccagtgccatcgcctttaggatcgccaccttggatcatgaaatctttgatgacgcgatggaaagtcagtccgttgtagtaaccgtcttttgcatgtgtcataaagttttcaaccgcttttggtgcgtattcgggaaataatttgattttgattgtgcctttattcgtcaccatttcgaccagatcttcattttcggcgacatctttcgtcaattgtggtaattccaatgcgttcaaatcgacgctactggcagtcgtgctttccgcagtagatgtactttttgaactttctgtagacgaactagaagaagtcgtgttgtttgcagaacaaccagcagcaaacagcaatgctgctgctaaactaatacttaaaataactttatttttcttcataactgttcctttccaatttactattttgttatctttaatgataacaaaatagagggaaaatacctacttaaattattggaatttatcatttattttaaaagaaaaagaaaaggtgtagaccatttactttgtgtttgctataatgtaagtggatacaaaaacgaaaagatgcaggaggaaatggtaatatgggaaaattaggaatctcgatttatccagaacggtcaacatttgaaaaggacaaagcgtacttggatttagctcataagtatgggtataaacgggtttttaccagtttgctgcagatcaatgatgataaagaaaaagttctttcagaatttaaagaagtagttgattacgcgaatagcctaggcatggaagtaatggttgatatcaatccagcgttatttgaacagttggagatttcttacgatgacttatcttttttccataagatgggtgcctacggggtccgcttagatatcggattcacaggagcagaagaagcaaaaatgacgcgcaatccttttggtatcaaaatcgagatcaatatgagttcgggcacgaattacgttgacaacatcatgagttattcgccaaacacggataatttattaggttctcataatttttatcctcatcgatactctggtttaggatacgaacactttgttttttgttcagaaaaattcagaaaatataatttgaatacgatggcattcgtcaattcgcaatctgctgagtttggcccttggcctacgcaagatggcttgtgcacgctggaagaccaccgagatcttgaaattgcgacacaagtgaagcatttaatccttacaggattgattgatgatatttctattggaaatgcgtacgcaagtgaagaagaattgaaagaaatggcagaagcatttaacgcggattatccaacattgaaagtagatacggaagaaggtattacagaaaacgaacgaatctgcttgtttgataaccttcatagttatcgaggggatcgctcagaatatatccttcgttcaacgatgactcgtgtatactacaaagataaagatttcccgcctcataatacgcgagatatgcatcatggggatgtactgattgacaatgaagggtacggtcaatacaaaggagaaacacaaatcgccttgaaggatatgaaaaacgacggacgtgtcaatgttgtaggaagaatctccgatgacgaattattcctccttgactttttgaaaccatggtcaagctttaaattaattgaaaataaaaaatagataattagttattgcagaaataatccgctagaaatagccagttatttctgcttttttattttgtttttttataggttataaaaatgaacattgcatagtagagattctttgattatactaattcaaggttatatgaaaaaaagagaaatgagatggatgatttatgaaactttggatgaaaatccttttaggcgtcgctttagctctgattgttgcgttagtgtttgcagggaattatttttataattatgctgttgtgccttctgagaaagactttttagacgaagatacacctggtacaacacagacatccaaagaaacggatgcacataaatggtttagttcaaaagaaaaccgaagcgattggaccatcacttcaaaagacggtctgaaattatcagcgatttatcttcctgctgaaacgaaaagtgaaaaaacagctcttgtggctcatggctatatgggaaacgctgaaacgatgaccaattacgcaaagatgtttcatgatatgggttacaatgtccttgttcctgatgcaagaggacatggaaaaagcgaaggggattacattggatttggatggccagagcgtaaagactatgtacagtggataaacaaagtgctagaaaacaatggaaaatcgcaagaaatcgttctatacggtgtcagcatgggagcagcaacagttatgatgactagcggagaaaaactaccagataatgtgaaagcaatcattgaagattgcggttattcttccgttcatgatgagcttgcttatcagctagacgatatgtttagtcttccagcatttccgcttatgcaagtaacgagtctagtgacaaaagtccgtgctggctactttttcggtgaagcaaatgcagtggaacaattgaagaaaaaccagcgcccaatgctctttatacatggagacgaagatacatttgtaccatttgaaatgttagataaggtctatcgtgcaacgaagggaccaaaagaaaagtatgttgtaaaaggagccgagcatgcggaagcatacaagacagatcctgaaaaatatcagcaagtagtccaacaatttttaagccaatatgttcattgaacgagtttaaaagtaggggatgaaaagaaagaagcctttgactggatccagtcaaaggcttcttttatcgattgatctatcaaattacaagttagcgaatttttctagtaagcgaatcatttggcaagtaaatccatactcattgtcataccatgcaacagttttaacaagttggaaatcaccagcagttgttacttctgtttgcgttgggtcaaagatcgaaccttgagttgttccaatgacatcgctagaaacgatttgacggtcatcatacccgaatgaaggattgtcaactgtgtgttttttgattgcttcgtttacttgatcagcagttacttttgttttcaatactgaaaccaattcagttaatgaaccatcaacgactggaacacgttgtgcgtgtccttgtaattttccttgtagctcagggataactaagccgattgctttcgcagcaccagtagaatgtgggatagtattgtcagcagctgaacgagcagcacgcaaattgccgccttttacaggtccatctaagagcatttgtgtggaagtgtaggcatgaactgttgtcattgtaccaacttcgatcccaaattcattatttaagaaataagccataggtgctaaacagtttgttgtacatgaacctgctgagatgattttgtcgttttcatctaatgtatcatcattgacgttatagacgatggttttcatagcaccagctggggcagaaataactactcgtttgacaccagcatctaaatgcgcttttgctttttcttcagatgtataaaaaccagtacattctagtacgatatctacaccgttttcttttgcccaagggattttgcttgcgtcgggttctgcataaacacgagttgcttcgccatccactacgattgagtcttctgttgcagtaactgtgccaggataagtaccatgagtagagtcaaattgcaataattgtgctaacatagttggacttgttaagtcgttgattgctactacttcaatatcatctgagacttctttgatgcggcggaaagccagacggccaatacgcccaaatccgttaatacctacttttactgtcatatcaaaagttcctcctttattaggggtgctgtgaaacggcatcctcaattaatacaattaatacactgttattctgctacgcaaagaatattttgtcaaaaaattatacttggtagcagaaaaaaggttggaaaccttaccaaatgataaaaaaagaagaaggtaacaatctttttgctgaaatgatagacaaaatcagatttcaccgataaaataagtaagacttttgtttattgtggaaattcaggcagtcaaataaataaatgaataataggaggacttaattatgtccatgtttttagatcaagtaacgatcgatgtgaaagctggcaagggcggagacggaatggttgcatttcgtcgcgaaaaatacgttcctgacggcggaccggctggcggagacggtggtcgtggcggcgatgtcatcttgatcgtcgatgaagggttacgtacattgatggattttcggttcaatcgccatttcaaagcgcagccaggtgaaaatgggatgagtaaagggatgcacggtcgtggttcagaagatacctatgttaaagtaccacaaggaaccactgtccgagatgcggagactggtgctcttttaggagatttaattgaaaatggtcaaacactagttgtggcaaaaggtggacgcggtggacgagggaatatccgttttgcctctcctcggaatcctgcaccggaaattgctgaaaacggtgaaccaggacaagagcgaaaaatcgaactagaattgaaagtattggcagacgttggacttgtaggttttccatctgtcgggaaatcgactttactatccgttatttcatctgctcgtccaaaaatcggcgcttatcatttcacgacgctcgtccctaatctaggaatggttactacaagtgatggcagaagttttgccgcagcagacttgccaggcttgattgaaggagcttcgcaaggtgttgggctgggtacacaattccttcgtcatatcgaaagaacacgagtaattttacatgtgatcgatatgagtgggatggaaggacgagatccttatgaagactatcttgccatcaacaaagaattatctacttataacttacgcttgctagagcgtccgcaaatcatcgtggcaaacaaaatggatatgccggatgcacaggaaaatctagtgaaattcaaagaacagctgaacaaggaaaaagaagatgaatttgctgatgacatcccagtatttccaatttctggagtgactcgacaaggattggacgcgttattgaatgctacagcagatttgttagaagtaacgccagaattcccattgtacgaagaagaactggaagaacgaaactgtacactatggattcaatccagaaggtcctgagttccaaattgatcgtgattcagatgcaacgtggatcttatctggtgagaagatcgaaaaattattccaaatgacaaatttcgatcatgatgaaagcagtgatgcgttttgctcgtcaattacgtggtatgggtgtggatgaagctcttcgggcacgcggtgcgataagatggcgaccttgtacgtatcggtgagtttgaatttgaatttgtcgaataggcaagcaaataaaaacaaataccaaaaaatatagattcagatttaagggaggttgtgacagaagtggtcagcttcaagaacgccgtttattcggaaaaaggagctgtgatacgacttttgtcacagccctattttattggaaaaaaagagtgcttttcttttcttattttacaattaaaggtaaaataaataacaagaaggtatgaaaggggcgtttttaatgagcaaacgagtaatcattttaaattttcaagtagaaagccaggcatatcaggcattttcagaaatcaaaaagttacatgctgttcgttcgattaaaggagaacagatggcagttgtcagccatgatcctaatgggacacatcaattcaaaatagaagattttatcgactttaccggtaataacaaatcttctacgggtggattaatcggaatgttggttggtgtattaggtggtccgctagggattttattaggatggtttgccggaggaatgatcggtgcgacacaagatgccaaagaaataaaagatgcccagaccgtgttcgattttgtaggaaataaaatcggtgaaggagctacaggactgatcttgattgctgatgaagaggacaatcgcccactgaatcaattggtaatgatggaattaggcggagaaattacccgcttggattatgaagatgtcgaaaaagatgtgcatgatgcgaaagaagctgaaaatcatgcgaaagaagctgcacaaaagacttggaaggacaaacatccgcaaacttccaacgacaatgaaagttctggatcttcaaattaataaaaaacagcagaggatctcaaacgggttcgctgctgtttttatagtaattttcaaagaaaacgctatcgctttagaacgttatttttaatttgaacccattctcgacttacggttgattatcccttctttttaccctaaaattaaagaggaacttaaagaaagtcaggtagattatggaattacaatttttaggaacaggtgcaggtgttcctgcaaaacatagaaatgtgacaagtatagcattgaaacttttagacgagcgcaatgaagtttggttgttcgactgtggcgaaggcacgcaaatgcagattttgcgaacgactattcgtccgagaaaaatcggtaaaattttcattacacatttacacggcgatcatatttttggacttcccgggctcatcagcagccggtcatttcaaggtggggatacgccattagagatttacgggccaaaagggatagaggaatacataaaagtctctttaggtatttcgcaaacgcgtttaagttatccgctgaaattcattgagctaaatgaaacagccccgatttttactgatcagcaattttctgtttatacaaaaaaactaaatcatgggatcgacagttttggttatcgtgtggttgaacatgatcataaaggagaattgcaggtggatcgtctaaaagaattaggtattccagctggaccactgtacggcaaactgaagcaaggtgaaacgatccaactagaagatgggcggacgatcaatggaaaagatttcgtaggtccagataaaaaaggacgaatcgtgactattttaggcgatacgagaaaaacacataattccgttgtgcttgcggaaaatagcgatattctggtacatgaaagcacatttaataaagatgaagcaagaatggcgcacaactatttccattccacgactcatcaagctgctgaagttgcaaaagaagcgcaggcaaaacggctgctacttactcatattagtgcgagatatttaggaaaagcagctttagagcttgaaaaagaagcacaagaagtgtttgaaaacacgacgatcatgaaagattttgatagcattgagattccatttcgcgaggaggaagaggcatgaatttagaagataaagttgttttagtaacaggtagttcaggcggtctgggcgcacaaatctgttatgaagcagcaaagcaaggagcaatcgttataagttgcgcacgaagaatggcatttgtagaaggtgtcagagacgagtgcagacgcttgagcggcaaagaggcttatgctttcaaggtagacgtcagcaatcctgaaagcgtggacgaattatatgaaaaggtgatggaagaagtcgggcgcgtcgatattctggtaaacaatgcgggttttgggattttcgaagacttccttacattcgaccttggaaaagcatgcgatatgtttgaagtcaacatcttaggaatgatggttttgacacaaaaatttgcgatcgatatggcagaaagaagacaaggtcatatcattaatatcgcgtctatggctggaaaaatggcaactgcaaaatcaacggtttattctgccacgaaatttgcagtccttggcttctccaacgctttgcgattagaattgaaaccacttggcgtagctgttacgacagtgaatccaggtccaatcgagacagatttcttcgataaggctgatccaagcggaagctatttggaaaaagtcggacaaatcgttttagaacctgccaagttggcaaaaatgatcgtccgcaatatgagacatccaaaacgggaaatcaatcaaccgtttattttagaagttgcatcaaaattttatacgctgtttccaacgattggtgattatttagccagcggaatttttaacaaaaagtaggtgaaggaattgaaaaagcaaagcaatgtgattcttggatttgttttagttttgattattgttctttttgctgtattgaacaataaaaatgttcctgtaagttttggcttcacttccttttctgcgccattgatcttagtgatcatcggttctgcgctgattggtgcactgattgtatttttgactgcttcggcaacactatggcagcaaaaaaagcaaatcaaacagctgactcaggaaatgtcagaatatcaaacagaacttcaaaagaaaattgaagaagcaaaagaagaacagcaacgcgagtttagaaacgaacgtgcggagttggaagctgcttatcaggcggagttacaagcgaaaaccgcacaaatcagtcaattgaaagcgccggaagaacaaaaaactcaatcgcccaaacaaagcttcaattattttgactaatagggatatttcataaatggtcgtacaaaagatcaggtcctgctgaacatctgtctagcggatctgatctgtttttattctttctttctgcttttttttgctgatttcctttgctataataactaagttaggagtgagaaagtgagacaagcaaattttgattggaagttaagcgagacagagccttctgaatcctttctccaaatgatccgtgaactgaaattatctccatttgtcggtaagttactgtggcaaagaggttaccatgaggaaaaggatatcaaccgatttttacatccaaaggaacaagaattacatgatccgtatctgatgcacgatatggataaagcaatcagccgaatccaagaagctgtaatcagtggagaaaaaatcctcgtttacggtgattatgacgcagatgggatcaccagtgcaacggtaatgaaagaaacactggaattacttggtgcagaagtagaagtattcctgccaaatcgatttgagcatgggtatggaccaaaccaatctgtataccaagaaaagatcgaagaaggaatccagttgatcatcactgttgataacggggtagcaggaaatgatgcggtagcatacgctcagcaagctggtgtagacgtgatcattacagatcatcacgaactacctgagaatttaccagacgcttatgcgattgttcaccctcgtcatccagcggggcactatccatttccagatttggcaggagtcggagtagcattcaaagtagcttctgcattattggaagaaccgcctgtagaatttttggatttagtagcgataggaacgatcgccgatttagtttcattgactgatgagaatcgaattcttgtttcattaggaatcgatgccattcatcattcagaacggataggacttcaggcgctatttgaagaaagcggcgtaaaaatgagggacgcagacgaaacaacgatcggtttttcgattgctcccagactaaatgcaatcggtcggatgggcgatccacgtcctgccgtctcgttacttgcgacgtttgatgaagaggaagcatccgttcaagcaaaaaaattgaatgagatcaatgaagaaagaaaagcaatcgtagagcagataacacaagaagcattagcgatggtcaataaggagaatcatatccatctattggtaaaccgaggatggcatgaaggcgttttgggcattgttgctgggaaaataatgaatgaaacgggtaaaccaacgcttgtccttactttaaaagaagatggatcagctaaaggatctggacgtagtattgaagccttgaatctttttgaaatgcttgaccagatgcgagatttatttacttacttcggaggacatcatgcagcagtcggtttaacgatgccaagtgaaaatgtcactatactacaggagaagatgaaccaatatatagtcgatcatcaaattgacttgatgagagggcctgagttgagaattgatgaagtattgctgccaaatgaagtaacagtagagcgaattgatgagctgaaactattggcgccatttggtacggataatcctttgcctcagtttttatttcgacaagtccaagcagaaaatatcaaaagaatcggagcaaaccaacagcatctgaaatttgtcctttccgatgcatcgagtcagcttgatgcggtcgcttttggttttggtactcaagaagaagaactgctgaataatcaggtagatgtggtaggaaagctttcgatcaatgaatggaacgggcgtaagaaaccgcagctgatggtatctgatttttctgtgggtggtctgcaagtatttgattggcgggcaaaacgtttccgtgaacagagccgaacgtcggaaggtagcctttatttagcatttgattcttctacgttgaaattcgtgcctgagattatccaggaagctgcgattgttttcgaaggactagattctgtaaaggcaataattgaaaaaagaaaaccgaactctctagttattatggattgtccagatgatttagcggatctgaaagaagtttttcggtcttattcattcaatcgtgtttatctgatggggatttcgcctgatgaggcctatttgaatggggtaggcacaagagaacagtacgcaaaattgtttaaactgatccattctcaagaacgaattgatatacgtcataaaataaaagcaatagctcaatatttgcgtatccctgaaaaattattaatttttatgatacaggtgttttttgaattgaaatttgttacaatagagaacggtgttttacaaaaagtcgctagcccagaaagtcatcctttgactgagagcagattataccagcggcggctcaataaaatcaaagttgaggaatttttgcttttgagcgatattcctaccataaagaaatggttaacaacctaggaggaaacaaagagtggatttaaaagattatattgccagtattcccgactatccgtcaaaaggaattgtgtttcgagatatttccccactgatggcagatggtgacgcttatcgggaagctacgaagcaaatcgtaaattatgcaaaagaaaaacgaattgatatggtagttgggccagaagcccgtggattcatcgtaggatgtcctgttgcttatgagttaggagtcggttttgccccagtccgcaaaaaagggaagttacctcgagaaaccatcgaagtgacttatggattagaatatggaacagatacattgacattgcataaggatgccattaaaccaggtcaacgtgtgctgatttgtgacgatttgctagctactggaggaacaatcaaagcgacgatcgaactgatcgaacaattaggcggtgtagtcgtaggctgcgcatttttgatcgaattgatggatctccatggacgcgacaaaatcaaaggatatgacatcattacattaatggaatattaagcagaaaaaagaagctattcttgatgttattcttaaagaagcgattttaaagcgaccctcaaaagtcagattctctatctgacttttgagggtcgctatttttttataaatggaaacaagcaaagaccagtagaagtttaaaaaatcactttttccgcaatttgacttaataccgaaaaactggctttagaacaccgtttattcgaaaaaaggatgtgaccgagttttgtcacacccccgtaaaagtttaacttcttgtcttttgaataattagcagtcaatccttattatgattgcctggatctgtagtagggctcatgatagaaatgatcttcatgaattctgcgccgctcagattgacggtacttcttttcatcccacaacatgaaccacaaagtaaataacggaacaaacacaagtaaagctggacgtatgccgaaattaccaataataatacctaaaaacaaaacagttaatactaagccaagacgtctcattgatttcatgaattctcacctcgttaatttatgcgaacaattgttcgtatatttagtatacgaatatttgttcggtttgtaaagagggaagtgataaaaatttgaaagaagaagaacctgggcgaaaaaagagtttgagaccatcgtctcaaactctttttaaaaagttttcttttattagtagcaattaatagatatgactacgataaagtcctactactcgtcctaatatagatacttgatctaagatgattggttcgagcaagtcgttttcaggctgcagacggaaaaagtttttttctttatagaatcgtttgcaagtcgcttcgtcctcggcagtcattgcaatgacaatatcgccattttgagcagtttcttgcttccgaacgatcacgttgtcaccatccaagatcccagcattgatcatactatccccacgaattgtcagcataaagagactgccttcttcggaagaaagattaggagggattggaaagaagtctgaagcatcctctactgctaaaatgggttctccagctgttacgacgccaagtactggaatagttgttggacgaatcccaatcttttctaaaccttgttttgtcaactcgattgcacgaggtttcgtcggatctctttggataaacccttttttttcaagccgtgcaagatgaccgtgaacagtagaagtagaagaaagctgaacagcttccccgatttcacggacagtcggcgggtatcctttttgggttacttgttcatggatatatcgtaagacttcgatttgtcttgattcagtttgtcgggccacaaggtacaccttctttcacttgataaataaatagtaccatataaaaagcgctaaatcaaacgaatgttcgtattttatttagtttatctagttgttttttttcagtttttatataatatgaaggagagtaaaaggagggctgagcatgctgtcacctgaaaaaatagagcggatcaatgaacttgcacgtaaaaagaaggaaaatggtctctcaaaagccgaagaacaagaacaaatcaacttgcgcaaagagtatttggaagcttttcgttccggtatgcgtcatcatatcgaaggaatgaaagtcgtcgatcctgagggaaatgacgtgaccccggaaaaattaaaagaaatccaaaagaaaaaaggcttacacaaccgaaatgacaacttttagtaaaaaatactgaaaaagattgctttttcgtgtgacatcttatagaatgaaagtgtaagaaataaaggtaaaaaaacctaaattaataggaggggttattttgtttgacaaaattgaccaacttggcgttaacacaattcgtacattaagtattgaagcagtccaaaaagcaaactcaggacatcctggattgccgatgggcgcagcacctatggcatatgcgttatggacaaaacacctgaaagtaaatccaacgacatcaaaaaactgggctgaccgcgaccgtttcgttctttcggcaggacatgggtcagcaatgttgtatagcttgcttcatttagctggctatcaagtgacaatcgatgatttgaaacaattccgtcaatgggattctaaaacaccaggacatcctgaagtacatcatacagatggtgtagaagccactacagggccattaggacaagggattgcaatggctgtcggtatggcaatggcagaagcgcaccttgcagcaacgtataacaaagaaaactttaatgtgatggatcactatacgtatgcaatatgcggtgacggagacttgatggaaggggtatctcaagaagcaagttcgatggcaggtcatatgaaactagggaaattgatcgttttatacgattcaaacgatatttcactagacggtccaacttcaaaagctttcacagaaaacgttggtgctcgctatgaagcatatggctggcaacatatcttagtgaaagacggaaatgacctagaagcaatctctaaagcgattgaagaagcaaaagctgaaacagacaaaccaacattgatcgaagtaaaaacagtcatcggctatggtgctcctaaagaaggaacatctgctgttcatggtgctcctcttggtgaagatggcatcaagatggctaaagaagtttatggttgggagtatccagatttcactgttccagaagaagtagctgcccgcttccatcaaacgatgatagaagaaggacaaaaagctgaagatgcatggaatgaaatgtttgccaattataaaaaagcttatcctgaattagcacaacaatttgaagatgcttttgatggcaaactaccagaaaactgggatgcagaattgccaacttatgaagttggaagcagtcaagcaagccgtgtttcaagtaaagaagtcatccaagaattatcgaaagctataccaagcttctggggtggttcagcggacttgtcaggttccaataatacaatggtggctgcagataaagatttcactcctgaacattatgaaggacgcaacatctggttcggtgtccgcgaatttgcaatggcttcggctatgaatggtatccaacttcatggcggaactcgtatctacggtggaacattctttgtctttgtcgattatctaagaccagcagttcgtttagcagcaatccaacatactcctgttgtttacgtcttaacacatgactcggttgctgtcggagaagacggaccaacgcacgaaccgattgaacaactagcatctgttcgctgcatgcctggtgttcaagtgattcgtccggcagacggaaatgaaacacgtgctgcttggaaagtagcgatggagacaacagatgcgcctactatccttgtattgagtcgtcaaaaccttccagtattgccttctacaaaagaagtagcagatgaaatggtgaaaaaaggcgcgtatgttctttctccatcacaaggagaaacaccagaaggtattttgattgcaacaggttctgaagttgatttggctgtgaaagctcaaaaagaattggctgaaaaaggcaaagatgtttctgttgtttctatgccaagctttgacctctttgaaaaacaatcttctgaatataaagaaagtgtacttcctaaatcagtgaagaaacgtgtggctatcgaagctgctgcatcatttggatgggaacgctacgtaggaacagagggcgcaacgattacaatcgatcatttcggtgcatctgcccctggcactaaaattttagaagaatttggatttacagtagaaaatgtcgtgaatacgtacaatcaactatcatagatccaagcaattgtttgactgataagaacagctgtctgcaagttggagacagctgttctttatgtgttagaagaataaatcaatattacttttcgttttcggctatgttacatttaaatgacaaaacaaagaattcttcggattagtttgtgtttcttgagaattaaaagtataatttaattaattaagtttgttttaagaagagaactttttattaagtttttttattttgaggaggaatttgaatgcaagagctgaagacccgcagtgcccgacaccatagacctaaaagaaaaatggtgatcaataaaaaagcgattgctcctttaattggaacgagtcttttagttgggccgatgatggttacagcggtaccgcaacatgttcatgcagatgaacaaggatctcaaacagtcgctgatcctcaagcgtttatcgatcaaatcggctggtctgcgtcagaagttgctgcaagtaatgacttgtatgcttcagtcatgatcgctcaagcgttgttggaaagtgcatatggcacttccggattagctagtgcgccaaattataatctattcggtgtgaaaggaagctataacggacaggtcgtttatatggcaaccaaagaatatgtaaacggacaatgggtaacgatgaatgaaccattccgaaaatattcttcttattgggaatccttccaagaccatgcgaatgttcttcgttcaaccagtttttccacgggcgattatcattatgctggcgtgtggaaaagcaatacaacaagtttttatgatgcaacagcgtacttgacaggtcgttatgctaccgatccaaattatggggccaaattgaactcattgattaatacttataatttaacccgttttgatacgccatcaacaggttcggctacaacaatcacaagtacaacaacaacgactactacgacgacttcaacgtcatcatcttcaacaacagatgtaaatacaaataatggtcagacatatacagtcgtgtcaggtgatacgctatgggatattgcacaaaaatttggcatgtctgttgatgatctaatggcgaaaaatggcatgtctatgtccagttattctttattagttggtcaagaactaaacgtttgatttagataaaaaggcaaagaaactaccatatatggtatatctttgtcttttttttgctagtcaaagacgaatcactcgccataaatgaacagattgtattatgataagtaagaagagcaaagacaaggaggaattgaagatgacagctatctataactcagtcaccgaattgattggcaaaacgccaatcgtcaaattaaataaaatcgtaccagaagattcagcagatgtttttgtaaagcttgagttttttaatccaggaggaagtgtaaaagatcgtattgctttaagtatgatagaaaaagcagaacacgatggtctactgaaaccaggtgatactatcattgaacctacttctggaaatacaggaatcggattgtcgatggtaggagttgcaaaaggatataaagtaatcatcgtgatgcctgagacgatgagtatcgaaagacgtttattgatgaaagggtacggcgcagagttgattttgactcctggtgcggatggtatttctggatcaatcagagaagcagaacgtttggcaaaagaaaacggctactttttaccattacaatttgaaaatgaagcaaatcctcttgtgcatgagaagacgactggtcctgagatacatcaagcatttggagtaaatggcttggacgcgtttgttgcaggtatcggtacaggaggaacgatcactggcgctggccgagaattaaaacgtgtgtatccgaaaagtcgaattaatcggggtagaaccagcagaatctgctattttagaagggaaagaagcgggacctcacaaaatccaaggaatcggtacaggttttgttcctaaaacactggatacttctgtgtatgataaagtcctttctattagtggagacgaagcgatggaaacagctagagaagttgggcgaaaagaagggattttagtaggcatctcatctggcgctgcaattgctgccgcgctaaaagtcgcaaaagaattaagaaaaggcaagaaggtattagctgtggttcccgacaatggtgaacgttatttatctacagccctttaccaagagatataaggcacttggtttttctccagataggtttatgtaaaaaacttttaaagatgaaaagaacacacaaaaatttatgatgaaaaaaattatttgaatagagacgtagaatagtgaacgcgactgttttacgtcttttttcattaaaatacaataaaattgaattttcttttcatgttaagtggattttaaaatgtaaaaatagtatgataagacgagaataacaacgtggggtgtttacatggaaaataagttagtcgaagaggttatcgaaaagttaaaaaaagagaacattcgaatcacacctcaacggtacgcggttttagaatatttgattgaacatcattcccatccaacggctgatgagatttataaagcacttgaacatcggtttccaaatatgagtgttgcgactgtttacaataaccttcgcttatttacttcgattggatttgttcaagaaatgaagtacggcgatgcttctagccgatttgatttcagttcaaagcgtcattatcatgtaatttgtgaaaactgcggtaagattgttgattttcattacccagggcttgaagatatagaaatggctgcgagcagactgactgattttgagattaatgaacatcggttggaattgtatggactctgtccggattgtaaagagtcagcaaaaaaggcgcaaatgtaaaaacagtttctacaagtgttatacctaaaaaaagctagctgtgtaaaaaaaacgctagcttttttatttttttgtcttttattcacaatcttagatatcaaagtgaatattatcacaataagaatcttgtagatattgggttcttatgcttgaaaaggaatgaaactacaaacaaacctttgtgaattcacaagcattaaactgttgtatccgttttatttctgttatagtagttttgtcgaaggacaaaatgttaatcggagggaccataaatgaaagtagtagtaattggctgtacacatgcaggtactgcagctgtaaaaagtattttaaaaaatcatccagaagcagaagtgacagtatatgaaagaaatgacaatatttctttcttatcttgcggtatcgcactttatgtcggcggagtagtaaaggacccagcaggcttgttctactcaaatcctgaagaattatcttcattaggagcaacagttaaaatggaacacgatgtaacagacgtcgatacagaaaataaaacagtaacggcaaaagatctgaaaacaggagaaacagaaacggtttcttatgataaattagtgatgacaactggttcatggcctattatcccaccgattagtggaatcgatgcgaaaaatgtactcctatgcaaaaactacaatcaagcaaatgaaatcattgcacaagcgaaagaagcaaaacgtgtagtaattgttggtggtggatatatcggtattgaattagtagaagcttttgtcgaatctggaaaacaagtgacattgattgatggattagatcgcatcttgaataaatatctagataaaccattcacagatatcttagaaaaagaattgacagaccgtggtgttactcttgcgctaggcgaaaatgttactgaatttatcacagatgaagaaggaaaagtgaaacaagtagctacaccaacagatacatttgatacagatatggtcattttatgtgtgggcttccgtccaaatacaaaactgatcgaaggaaaagtagatacactgccaaacggggcaatcaaagtgaatgaatacatgcagacaagtaatccagacatttttgcagctggagactctgcagtagtcaactacaatccaagtggcacgcaaaactatattcctttggcaacaaatgccgttcgtcaaggtttgcttgtgggaaataacttgacagatcataaaatggcgtatcgtggtactcaaggaacttcaggactttacctatttggctggacgatcggttcgacaggtgtgaccaaagaaagcgcaactttgaacgatctagaagtccaagcgactgtatttgaagataattatcgtccagagttcatgccaactactgaaaaagtaatgatggagctagtctatgaaaaaggaacgaatcgtatcgtaggtgctcagttcatgtccaaatacgacattacacaatcagcaaataccatgtctttagctgttcaaaataaaatgactgtagaagatctcgcactttcagatttcttcttccaaccacattttgaccgcccatggaattacttgaacctacttgcacaagcagcgctaggcgaaatcgaaactgcacaataaagaaaaagggttgtgacacaattttgtcacgaccctctgtctttttttgtgaaaagtacaattagttgtctttcttcgaattttttgtcacaataagcagcaaagataaagctgttacataaaagaacaagcagctttatttgattttgaaaagaaaggtgagaaagaagatgaataaagaatattttgtccaacaagatgcatttttagaagattataaaagtgcttcgaagaaatcaacgatcaatattgatgagttggcagatcaagtactctctcagttgaatgaaacgcaagaggaatattacacgatgccagcaaaagacgccaaagataatgtttctcatcgttttcctttcagtagacgcatctactcagatgaaaatgacggcacattgaatacagagtacacatatgaaggtcagccatatgtgctagaaactgatgatgatctttaaagacagtttttgaaaaggccgctcatccttaagtgatgacaaaaaatcatcacaattaccgatgactgtctctttactatcttttaatcagaaaaaggggttatgacaagctttgtcaacccctttttttcttggtttcagattgggttttcctacaaaatatttttatctttgttgaataggaaacaaaaaaacaatataatgaaagaaaaagaaggtgtagaaatggataaaagacaactgctaatagaagaatatctggatttagctaatgagattattcatcgtaataaaccagaaatggaaaaagaatttgcaggatttactctaaatgaactagaagtgattgaacatatcgggaaaatccctgatcctaacgtgacaaaattagcgaatgctagttacatgactagaggagccatcagtaagctaacaaaaaaactgatagctagagggatcataaacacttatcaaagcgaagagaataaaaaagaaatctattttcaattgacgccaatcggacaaaaaataaggaatagacacgagcaactccatcaaaaatgggtacagcgagatgctactgtatttgaaaatatgtcaaaagaagaatttgacacagtatttcgttttatcggtcgatacagagaatttatacgaagtagcaaatgaagctactattttttattgtagtgataataggcaaaaatcataagcaaaaatccgaataccgtcggaagaaatggtgctgcagcataaagctgtcctgcgattagcgggccgatgacgcgcgatagagattgtatactttgggtaccgcccattacaagaccttgctggttatctgagacagaattggatagttggccattgaatacagtagtaaaaatagaatcaccgaaaccataacagataatcccaaataaaaacaaaatcggcagtagaagaattccagataatgtgatgaatagataggcgaggatttcactgaacatccctattcttgtgatctgctgttctgaaaattttttgagcaatcgaggcataatgaacaattgcgagacagtatccaagattccaatcaaagagaagcttaaaccaaccaacccagccttccactgaaaggcgtcaatcgaaaattgataaaagatagattgaagagagccagctgccaaccaaacagcaaaacctgctgtcaataaaggaataacggatgaaatcttgaataattgttgtaattggtgaaaaggtcttacatgggagaaacttaaatctactgaacgtttttttattggaaggctttctagcataaatgtgtagccataaacggcatttaagaaagtaaagagtgctccaataaatataggaacagaattccccaactcagctaatagaccccctataataggacccagcgttgttcctataccgactaaagcacccatccatccaaaaactttggttctttcattaggttccgtgatgtcggcaaagtaagcatataaggtggagatttctcctgccgtcaatccttcaatgatacgaccaaggaacaacatccatatcgaatttcctaaaccaaaaagcaaatatccgatacttgatcctaataaactgataataaggatcggacgacgcccaaaatgatcacttaagctaccgagaatgggggcagataagaaggcagctagagcataaacagacatgagcaaagtgatatagaaagcttgctgatgtatggagtgagaataaggcagctgttaataaacggatagtactaggactgacgatagtaaatcctaatccagtgaataagacagagactgtatctcaaaaaactttagaatgtttatttgtgaaactgtacatgtaaaaactcctttatgcaataatgttaacttggaaacaaaaatagtgtatagtaattttgtttccttgtcaacattctaaggaacagcgaaatctacttaatttatttattccgaaaagtgaagatacgcatcaaaaacatgaacaaacaaaaatcaagtagacgacattgtaaatctgaccgatcagtgaagtaaatagaaaagaaacctgttcttgcttcccatgttttttttacgtatactgtgattgagcggaggagaaatcatgttgaatttagaaaattacttaagcgctggacaaacagtcatatctaatcttttacttaaaaattatcataggatcggtctacaatctgaagaatttttatttgttctacagttgcatatggcacagcttgaaggagatactttccctgatttgcagatgattgctatggatatgggaatcaaacaagatcagatttttcaaatactggatcgtctcgtaacaaatggatttatcaagatagaaacgacgattgtcaacggtaaaaaagcagatcgatataatctttaccccatctatgatctattaggtgagtatttaaaaacacaagaaaaaaaatacgaagaaaaaacacaagaaaaagaaatccagtcagtgtatcaattatttgaacaagaatttggacgcccgctttcttcgatcgagttccagcggatcggacaatggctagaagaagaccattatcagccggaaattttgaagctagcactgcgggaagccgtattaaatcaggcttatagttttaattacgttgaccgcattttgctatcgtgggaaagaaaaaatctacgtacaaaacaacaagtggaagaagaccaaaaacgaagaaaacagcagcttcttcaaagagaagtagaacagtcagctcaacaagaagaattgccgaaagtctcactgaaaaattggttggaggagtagcggaatatgttaagaaaacaaaaaacaatggaagctctagaaacgatgtatggaatgtttcccgaagcacatggagaactcaagcacaataatccatttgagttattgattgcagtgatcttaagtgcccaggcgacagatgtatcagtgaataaagcaacgccagatttgtttgcctcttttccgacacccgatgcgttagcagaagcttcaatcgatgaaatcattcttaaaataaaaacgattggtttgtatcgaaataaagcaaaaaacatcaaagcgtgtgcacagcagctgattgaacgtttcgatgggcaagtgccaacgtcaagagaagaattgatgtctcttcctggtgtaggcagaaagacagcaaatgtcgtattgggggatgcattcgggataccagcaatcgcagtagatacccacgtggaacgtgtctcaaaacgcctgaggatctgcaaactagatgctacggtcatggaagtagaagaaacactgatgcggaaagtaccacaagaattatgggtaaagacacatcatacactgattttttttggtagatatcattgcacggcaagaaatcccaagtgcgaggtatgtcctttgctatcaatatgtcaagatgggaaaaatcggatgcgtctaaaagaaaaggcgctaaaaaagaaaccacgcctgtagacgtggtttctttaattgcaaataaatgtatgaattatcttgttattatggagaaaagctgtttcgtttatcttttttgcatgaaaaagtaaatgtacatactcagtagctaggatggtaacttattacaatttattgcgataaaaataaaagttgttatttttattgggaaaatacccgatgtagaaaataatgccttccaatatacctataaaataagtccagtattccaaaggattatataaataagtgacgtatctatctaaaggtgtaataaaaatgataagtgataataaaaaaataccatttataactaaacataaactaatggatttgggcggtttcaggctcatcagaaaaatatagattctggtgaacaacaaccataaaaaagtgagaatcattgcatgagagcttctttccataaattttcctttaagagtagtgcttaaaagtacagaaaaaataataaatgcaaggataggagcaattaaagtaaatttatttaataataaacaaaatttttcagcttttttattcttggaataacgaggtattgttttcgataaaaaaagatggtgcagacaaattatgataattaagcatactatcagataactcaaaatgaagccttctttcaaaaaattattcaaaaccatatattgtattttttatttgataataacaatgggattattaagaagtggcactaaataaaagactagtgtgtatttagccgatttaattataaacaagtaaatggataaagtatatgtaatgataaaagaaaaatggattttctaatttttaagctaaatgttagatcacacatgtatatgctggatagtcttataaaaaatcatgtaatacagcttggtacatgatttttatttgtagctgttttttacatagacacaaaaaagaaaccacgcttgtagacgtggtttcttttttactatctgtttccagaagctgaggtgctgctggatggtgtatggtcatttgcagcatccgctccgctagttgctggctcactggaagaagcaggaggagcagatgaagacggtgtcgagctttcttcggatgaagaagaaggaaccgttgttgaagacgctggctcgcttgtttctgctgtcgtgctttcttttgaggactcagcagttgattcgctttgactagtagagctagagctttgagtcgttgtctctgttgttgagcttccaggagtctggacatagctggaagatggaatagttgttgatggtgtaattgcattcgatctagctgtatattgatctttgtagtacagttcaccgcccacacgaattaatccgcttggcatctcccagtctgtatttgtcacgttagctgaaacatactgcataagctcgcgataaacatcagaggctacgtgtgacgattctgaagtgacaggtgtcatttttttattgtaacctgtccacacggaaatcgaataatttggcgtatagcccgcaaataggatatctggatacaccccagaagaaataccaagttttgcatactcgtcatctgtgtaattggatgttccggtcttaccggcttgatataacccagcgatttgcgcattcgtaccagttccttcagtgatcgtatcttttaaaatgtctgtgatcatataagctgtttctggagacatggctgtttttccatctggctcataagtttcttctgttccgtcttggaagacgattttattaacatattgaggtttgtaataagtccctccattggcgaaagccgcataggctgctgccatttttaaggaagaagctccgtattttgtcccatcttgttcttccgtattactagagatcgcattcgattgatggatcgtactgtattcgatcccaagattttttaagaaagaagccactttatctgaaccgacttcattgaataatttgactgctggaacattacgggataagtaaagtgcttggcgtaaagtaatggtgcccatatattgattatcccagtttcctacaggagtcgaagtcccttcatagttatacggtgcgtcagtaatagtttttccagtagaatatttcaaatattcaaaagctggtccgtaatctgtgacaggtttcatcgtagaaccaaaatcacgggaagtattcactgctaagttgttgcctaaagttacgtcttctgcgatgtgacgtccgccaatctgggcttttactttcccggtattggtgtcgataagggtggaggcaacttgcatctcgtcgtctgggtaagagacatactgatccgtgttgacgatatcatatagtttcttttgggcgtccagatccaaattcgtataaatctctaaaccgtctgtgtagacattcttatctgttttttcttgtacttcattgatgacttctttgacataattatcgacgatcttagtattgtcatcggattgagttagttcttgcagaccatccgttaccggtacattaacagcttgatcatattctgtttgagagattttttcgttttgaagcatcgtatacaaaacagtatctcgtcttttcttcgcctgatctggataaacataaggatcataggcggaaggggcttgaggcatcccagcaagcaatgctgtttgcggtaaagaaagttctgataatttcttaccaaagtacatctcagaagctgtctccatcccgtacaagccgtttgacatatacactttatttacgtagtaggtcaagatctcttgtttcgattttttttgttccaatcttacagccatccacgcttcttgggccttgcgtttcagagtctgatcctcggcactggtggagaagaaggaaagtttgatcaattgctgtgtcaaagtacttccgccttgcagtccgccagaggtaaagttagagagggcagaaccgatgatccgaatagggtcaaccccgatgtgtttataaaaacggcgatcttctaccgacacgatcgcatcttctaatgttttcggtaattcattcgcagaaattttttcacgcttttctgcgcctaaatcttcgaatagttcgccatcttgtgtatatagtttggaagatacggtagcgtctaattttttatccgtcaattcgggcgcatcttttgcgtaataccagaaaagtcctacacctgctaaaaagaggatacagaaaaatgagagtattcctaaaaggatcttgataaataatccttttttatgtgttccagaggactttccagaacctttgccagaattcttcttcacactctttttaggagtaggctgtttctgtcgtctagagcttctagtttgttcatttgccattcttgctttctccttcaatagataatgttgataaatagaagtcaaccgcgtccaaataaggaatccgcggagaaataccagttttgatctctattcctagttcttcgatcaaagataaaggtagtgatttgcgtcctttttccttttgggcgtcccagtaagcaatcaaatgaacactattcaaataaaaacagcgcttcaaagacgaaaaccataacaagacaaagcagaccccattttgttcgaggcatgctttcatatgttcgatttgatgggcatggaagtttttaaagggaaaagatgttttgttcttggtttcttttgcttcaaagtccaagtaaaagcctcgatagacgccattatagtctgtagttgaggcttgggtaaagtaggcttccttgatcacagcagcacttctcttaggatagtctactttcacgatttggataggggtaggctttttatggataaccgccaacccgcgggaaagataatatttattactttcattgattgcttcttcaaagcgcatcccccgattgccgaattcagtgatctgatttcttttttcttgaattttttcgacgggagaggcattcttataataaggttggccatttggatagcgcaataccatctttaatcacactcctaggccacattatagcaaaaaagcggatagaaagaaaaggaatctgagatggataagtcaaaagtaatctatgtgtctgggtatcgaagtttcgaactcggtgtttttaaagaaaatgatcctaaaatccaagttgttaaaaatgtttaaaaaaagaactccatcagttagcagaagaagggctggaatgggtacttgtcagtgggaatttgggcgtcgaactatgggctgtgcaaatagtagcggaattgaaagaagaatatccggaactatctcttggtattttgtatcctttttctgattttggtaataactggaatgaagggaaccaagaaaaaaaacattagcagaacaattagcagattatgtcgaagctgttagccatcaaccctaccaatcacctagtcagctaaagaatcacactcgttttatacttgaacatacagtgggctgtctgctgatctatgatgaagaattccctggaaaaacgaagtatttttttgaagatgcacagaattaccaagcagatcatccctacgaaattcggctgatcagtatggacgatcttcaaaattttagtgaataatcgatattgtgtttgatttatcaacttttttcctatacaatgaaaaaggtagaaatgttattacgtaaatgaaaactagaggtgtaaatatggcgaatttggtttatagtcctaaagacattttacaacaagaattcaaaacaaaaatgcgcggctatgatcccgttgaagttgatgaattcttagacaatatcatcaaagattatgaaacttacagcaaagaactccttgctttacaagaagaaaacgatcgattgagtgcaaaagtagctcaattatctaaaactcaaggagcagctcaaacacgcgtgcaacaaacagaggcaccaaagagcgcagcagtgaccaattttgatatcttaaaacgcttgtcaaatcttgaacgtgaagtatttggtaaaaagcttgatcaacaagcaagtgcagtcaaaccagcacaacctaatccaaataactacacaaatgcagacacaagcttagatgataatgaaaaaacacgtcaattttaatttttgattaatgaatttgcggttttcgggtaatcgcggtctgacttgatcaggctgaggaaagtccatgctcgcacaggctgtgatgcctgtagtgttcgtgcttagcgaaaccataagctaaggtactctttggagtaacggcaggaaaacaagctaaggcttcggctatgcttaagtatccttgaaagtgccacagtgacgaagcggctggggaaacccatccggtggaacgcggtaaacccctcgagcgagcaacccaaacaatggtaggggcgctttttgtctggaagaagaacaggacaaaaaggcagtataactgcagatagatggttaccgctttgttttttctccctggaaaagcaaagtacagaacatggcttatagaaaaccgcaaacatcagggaattaggtcgtgacaaaagtaatgcgttataagaaacaagaaaaacatttgaaagctatttttcaatacttcagatgagtcgttcttattacaaaacaaacttttgtatcaccggttattcggaatttgagtaaaagtgtggggtaggactgatgtcccacctcctttttttataaataaggagattgtgtatggaaaaaaacaggaagttcaacctcgtcgcaactgcggcaagcgggctagaagcactggttggtaaagaattaagagatcttggaatcgaatgccaagttgagaacggacgtgcacgttttgaaggaacaatggaaacgatcgctacagctaatttatggttacgtacagcagatcgagtaaaaatcgtggttggggaattcgatgcgtatacgtttgatgaattgtttgaaaacgtaaaagcattaccttgggaagattttcttccactagatgcagcttttcctgtagctggaaaatcgatcaagtcgaaactatatagcacacctgattgccaagcgatcacaaaaaaagcaatcgttgaacgtctccgtacctattatcaccgtccagcttctgtaccactgacggaaactggcgcacattttcagttggaagtagctttgctgaaagaccatgtgatggtaactctggatacgacaggaccaagtttattcaaacgtggttatcgcttagaaaaaggtggagcaccattgaaagaaaacatggcagcagcacttattatgttgacaaattggcgaaaagaccgtccattttatgatcctgtatgtggttcaggtacgctttgtattgaagcagccttaataggccataatatcgcaccaggattcaatcgtgagtttgcttgcgaatcttgggattggttcagtcaagaaatcatggaaaatgttcgatcagcagccgaagaaaaagcagattatgatattgaattagatattactggttcagatatcaatggacggatgattgaaattgccaaagccaatgcagaagaaatcggattaggctcttcgattacctttaagcaacaagcagtcaaagacttcaaaacggataaagaatacggggtcatcgtggctaatccgccttacggagaacgtctaggagaagaagaaactgttcggaaattatataaagaaatgggcgatgtattccgtccattaaaaacatggagtaaatatatcttgactagcgacttagcgtttgaggaattttacggacaaaaagcaaccaaaaaaagaaaattgtacaatggtgcattgcgtacggatctattccagtattggggaactcgtccgcctagaaaaaaagagaaagacgaataatcttactaattgattcattcaattggatgtttggaggaatagggaatgaaagaaaaagagtttttacaagaagtaaaagaaatcaatcttctacaacaagctttaggaatcctcgattgggatacacaaacaggtatgcctgaaaaagctagtgcataccgaagtgaagtagacagctatctttacagcatttatttttcaaaaaaaatcggtccaaaaatcaaagaagccattcgctatttttctgaacatccggaagaattgtcggaagttggaactgccgtttttgccaaagtaaaagaagagtatgatttggaacatcgcgtaccggaagatcttatgagaaaatatacagctgccgtttcttcagcacacggacaatggcaaaaagctagagaaacacaacaattttctgattttcaacacgcattgaatcaaaatattgaattaacaaaacagttgataccttactggagaaaagatgaaaagacgaattatgatgttttgctgaatcaatacgaacccgggatgactgtcgaaatccttgataaggtatttgatcagcttaaagaaggaattctttcgatccgccgtacgctccaagaaaaagggactgaacctgaaacagactttttaaatcggagaatgacgaaaaaacaacagaagagatttgtagtgaaagtaatcgaacaacttggttatgattttagtcgtggtcgtttagatgacactgtccacccatttatgactggaattaatccgaatgatgcacgaatcacgacacgatggaacgaaacagatttcaaaatggctgtttttggagtgatccacgaggctggtcatggtatgtatgaacaagacatcgatgataaatatgcgtatacaccggtttatgaaggtacatcaatgggtatccatgaatcacaatcgttgtttaacgagatcattattggaagtagtcgcagcttctggaaaaagcaatatcctttctttcaagaatgtgcagaaggaacattcgatgatattccttttgacaaattttatcgttcattgaaccatacaaaatcaagtttggttcgtatcgaggcagacagtttgacttaccctctccatatcatcattcgttatgaaatcgaaaaaatgattttcaatgaaggggtagatgttgctgaactacctgaaatatggaatcaaaaatatgaagagtatctgggaatacgaccaacaaatgatgtggaaggcatcctacaagacgttcattggtcaggtgcaagctttggttattttccctcttatgcattagggtacatgtatgcggcacaattacttcattctttgcagcaagaaatagatgtggaaaatgttctagcgtcagacgattattctccaatcaaaaactggatgtcagagcatatccatcaatatggtgcatctagaaaaccaaatcaattaatcatggatgcaacacatgaaccgcttaatccgcaatacctgatcgactatatgaaagacctgtattttaatgtatatcaggtaaaataaaatacaatttacaaagatagctgaaattcatctaatctatagatgttttcagctatttacttaagaaagaagtggaacgaatggataaattacaagtgatcgctgattatagtatggaccaattagcgcatgatcaaacaggacatgggagcgatcataccaaaagagttgtcaagttagctgaaaaaattttggagacggaaccgcaggcagaccgctttgtgacgcttgcagcagcttacctacatgatacgattgatgataaagtcgttaaaaatgagaacgaggcaaagcaacagcttcgtgtattccttcgctctttgccaatagtagaggaacagatctcgatgattttttccattatcgaaaatatgtccttttctaaaaatctctctgaagcggccgaactatctctggaaggtaagatcgttcaagacgctgatcgtatcgaagcattaggagcaatcggcattttgcgtactgcttatttcggcggtggacatgggcacccgatttttgatcctgaactgtatccgcaaacattcaaggacaaagaaaattaccgaaaaggcacgacagtgatcaatcatttttatgaaaaactgttcttgctgtctgataaaatgaatactgattacggatatgaagaagccaaacgaagagaaaccttcatgcgtgaattcttagaagaattttttctggaatggtctattgacgatgaaaattttactccagacaattggatcaaaaataacaaaaaatgatggaggttgtgacagaagtggtcagctccaagatatttcggatcattttccgtaaaagttacttctggaacactgtttaccaagaggtcgtgagcctgccgttcagctccgagtcacaaggaacaatttcaaaaaatagcttctcgtgtttgatgaatattgtaacttgtgattcggaattggcaggagaacaccgtttattcggaagaataggactgtgacaagacttttgtcacagtccttttttcgaattcaacaagtaaaacttttaagaaatattcagagagtaaaattaaaaattgctgataaacgaagatggaaattttatgtatttttattggtctatgcaataaataaattaaatattcagaatacaattgattttaacgaaagggcttctatcaatggttgtgttgtatttatctgcccaggtagagtaaaatagatcattatctaaaaggtaattgttcatactatataagtcatttgaaagtaaaaagatactgtaaataaaaaatgtggttaaataattctcataatcagtgtaagcgttatcaaaaatatagcatacttgctttgtagatgaatgacacgatatatgtttggtatgttctgcaagacagatgaatatggaggtggagacaatgtcttccaaagaactaacaatgtatttagagaaagaattggatcaactgaaagaaaaggggttatacaatacgatcgacatactagaaagtgaaaatggtgcttgtatcatcgtagacggaaaaaagatgatcaatctagcatccaacaattatcttggatttgccaatcgcgaagaattgaaaaaagcatgtattgaagcaaccgaaacttatggtgtaggagcaggagcagtccgaacgatcaatggttcgctgaaaatccatcagcaattagaagaaaaaatcgcagaattcaaagggacagaagcagcaatcgcctttcaatctggattcaactgcaatatgggcgctatctctgcagtaatgacaaaagaagatgctatcttatcggatgaattaaaccatgcatctattattgacggttgccgcttatccggagcaaaaatcatccgaattaaacatcaagatatgaaagaccttgagaaaaaagcaaaggaagcgatagaaagtaagaaatataaaaaaatcatgtatatcacagatggtgttttctccatggatggagacattgcacgattgccggaaattattccgattgttgaaaaatatggactgatcacctacgtcgatgatgcgcacggctcaggcgtaactggaaaaggtgcaggaaccgtcaagcattttggattaagcgacaaaatcgatatgcaaatgggcacgttatcgaaagctataggtgttgttgggggttatgtagctggatcgaaaacactaatcgactggttgaaagctagaagtcggccattcctattttctacttcgctaactccaggtgcagctgcagctgcattggcttcgattactttgatgcaagaacatccggaacttgtcgaaaaagtttgggaaaatgctaattattttaaagaagaattgaaaaaagtaggctataacatcggtatgtctgaaacacctattactccagtcattttgggagacgaaaaagtgactcagactttctctaagaagctgatcgaacatgggatttatgctaaaccaatcgtttatccaactgtgcctcttgggacaggcaggatcagaaatatgccgactgcggaacatacgagggaaatgcttgatgaagcagtagcagtttatcaaaaaataggaaaagaaatggaaattatttaactaaatttagttttttcgtctatttaaaattagagaacatgttcacgcatatattgttaatcatctgaagatagtagtaaaaaagatcagggaggatcatcatgaaaaaagtattggtgacaggatgtttaggacaaattggttcagagttgatcacacggctacgtcaagaactaggcagtgaaaatgtcattgcgacagatatacgcatgcctgaagtcattgagaaaaacgatatctttgagatcctagatgtaatggattacgaaaaaatgcgcagcatagcagaacaatatcaagtggacacattgattcatttggctgctcttttgtcagctgttgcagaagcaaaaccacaattagcctggaatttgaacgtgactgggctggtcaatgcattggaagtcgctagagaattccagctgaaattttttacgccaagttcaatcggcgcgtttggtccaaatactccaaaagatcataccccacaagatactcttcagcgtcctacaaccatgtatggggtaacgaaggtagctggagaactactatgtgattattattatgtgaaatatggcgtagatactcgtggtgtccgtttccctggattgatttcttatgcaaccttgccaggaggcggtacgacagactacgcagtcgatatttattattcagcaatcaaagaaggaaagtacactagtttcattgatcaaggtacatcaatggatatgatgtatatgccagatgcgatcgatgccattataaaactcatgaatgcagatcctgatcgattggttcatcgaaatgccttcaatatatcggcgatgtcttttgacccggaagagatcaaagcatctattcaaaaaatcataccagattttgaaatggattatgatgtggatcctgtacgtcagtcaatagcagaatcttggccaaattcactagatgtttcttgtgcgcaagaggaatggggcttttcgccgaaatacgacttagatgtgatgacaaaggatatgttggaaaaactgaaagaaaaattggtagagacggtataaaacaagaaccacatccaaaaagttttttatacttttgggattggctatggtatgaaaggggacaagggatggaagaatatcaagccacgccagtaaaagaagtaaaaatagaaaatgaattaaaacgtacgatgggattttttactgctttatcgactgttatgggcacagtgatcggtgcaggggtattttttaaagccgcaagcgtagcagaagttacaggatccgccagtttgcatatgttttcttggtttctcggtggtatgatttctgtctgtgcaggactaacaggagctgaactggcagctgctattccagaaacaggagggatgattaaatatatcgaacggatttacggaaatacagcagcttttttattgggctgggcgcaagtcgtgatttattttccagcaaatgtagcagccttgtcgatcattttcggtacacagttcgtcaatctatttggtctttcccagtcaatgattgttcccgtagctgttacagctgctgtatcgatcctgttgatcaattttttaggttctaaagctggaggggcttttcagtcgattacgcttgtctgcaagcttattcctttgtttgtgatcgtcattttcggtttgttccgacaagaaggagtagacttccaactgtttccgatccaagcaggagaaaatctttcatttttctcagccttgggagcgggcttgctagcaacgatgttcgcatacgacggttggatacacgtaggaaatatttcgggagaattgaaaaagccggcgaaagatttgccaaaagcaatttctttaggaatcatcggaatcatgatcgtttatttattagtaaatgcggtgttcttaagaaccgcatctatcgacggagtcgcaggaaacagcaatgcggcaagtgacgttgcaaaaatgatttttggcggcttcggtggaagactggtcacagttggtatcttgatttctgtttatggaaccatcaatggctatacccttactggaatgcgtctcccttatgttatggcaaaagaaaacaacctgccttttagcaagctctttgctaaacttcatgataaaactaaagttcctgtagccgcaggtatcttagagctagtcatcgctattggcatgatgatgatcggtggttttgatacactaacggatatgctgatctttgtcatttggattttttatacgatggtctttgttggtgtcattcttcttcgtaaaaaagaacctgatttgtttcgaccatacaaagttccaatgtatccgtttattccactagtagcaatcattggagggacttttatcgtatcaagcacgcttatcactcagacctttttagcttcgatggggatagtattgacacttgctggtatcccgatttatctctatttaaaacgtagatagctaaaacattcgaattttattagaactgcacttctctgccaaacaaaatattttatttaaatgaggagtacgtggaagaaatgtcaaaagtactcgttaattttgatcacgtaaatgtcgttttgtctacgatgaaatagcaaagtaaaagacagaaatcgggctcaaccgatttctgtcttttactttgatttgcgtaactgaactattcggcgtacgccgcgataaatatttaataaaaccaagcaaccagaaatgaaaatgggaagccaaatcagatagacagggtagccaagcactttagacaaagcatgtggagtcattttatccatttcaagaagtgcttgctgccaagtctgaagattgaagactagcatgaaacccgaaataatcaggagaataaatcctaaataatgaattgtagttctttttcttacataagcgatcgtagcataaaggaacagtaaaaaaataggtacgccaaaaacaaagtacatattcagcatctcgacaccccctttgtgtttatcttactttactttgaaagaaatgagaaataatagcctcgttacttgcttgaaacagcaaaggactgctaagataagagagatacaaagaatcaaggaggagtcatatggcaagttatatcgaaccgattcgttttgcgctgattgtttttccatttttagccttagcgatctcatctgttttttttatttatgaatatcgaaagtatggaacatttctagtaacaagggcagttattttgtattctttcgttttttatttattgtgtgcgtattttttggtgatcttaccacttccggcaaaggagacggttgcccaaatgacagggccaaagatggagctgcatttatttgcttcatggcaacatttcagagacaacacggtattggtcttgtctgaacctagtacctacctgccggcaatgaagcagagtgtatttttggaaccagcttttaatgttttattactcataccatttggcatttatttaagatattatttccggctttcttttatgaaaacgatgattgctagtttctgcctttctctattttttgaattgacgcagctaagtggactttattttatctacccaagaccataccgcttatttgatgtgaatgatttagtgacaaatacattgggtggaatcattggttttgtcgttacgccgttatttacatttatgcttcctacaagaagacgaatggatgaactttcttatgaaaaaggaaagactgtctcattgactcgacgcttggtcgcttatttgatcgactggacatttttatctcttattaatttggtagcggcgattttctttaaaattgcgttcgattcaggggcagttacttctcatatctggtggcttttattagaagtaggggtatactttatgattgtaccgtttataaccaatggatggacacttggcaaaaaaattgtgcgtatccgtttggtggaagaagaccgcgaacgaatttctttaaaagcattgatgatccgctacgggtatctgtactttcttttttatggtttaagctggttggggcagttgcttcagcaaatcatgaattcgacaacgaatacggtgttgcagatgagtgcagtattcatttctctcggtgtcttgttactacaaggtatttttattttaaatatcttgctatcatttttgagaaaaaaacggattctgttttatgaaaaagctagtcacacatatactgttagcacgattggccaaacaaaggatgatgattctcgaaattagctgagcaaaaacgctttgtctgtgttataatgccaaagtcgtgataatttaaagagaagaggtgcacgaatgaataattttgatatattccgcttcaaaccgtttatcaatgaagcgttaaccgcaaagggcttcaaacagcccacagaggtccaggaacgtttgattcctttaattgcaaaaggaaaaaatatcattgggcaatctcaaactggtacaggaaaaacacatacgtttttgttgcctttgtttgaaaaaatcaatgcagaaaaagaggaagtacaagttgttattacagctccaagtagggaactagctgcacagatctatgaagcagctacacaaatcgctaaattttctacaccggagatccgtgtctcgaattttgtcggcggtacagacaaacagcgtcaattaaatcgtctgcatcaccaacagccacaggttgtagtaggcacgcctggtagaatattagacatgatgaatgaacaagcgctgaagattcacaccgcatttgcatttgttgtcgatgaagcggatatgacattggatatgggttttttaaatgaagtagaccaaattgcaagtcgattaccagaaaagctgcagtttttagttttttctgccactattccagaaaaacttcgtccattcttacgaaaatacatggaaaatccaatcattgaagaaatcaaaccaaaagcagttatttctgaagacattgaaaattggctgatttcaacaaaaggtaaagatgagaatcaaatgatttatcaactgctgacaattggtcatccttatttagcaatcgtatttgccaatacaaaacagcatgtggatgaaattgccgattacttgaaaaaccaaggcttgaaagtagcaaagattcatggagacatcaccccaagagagagaaaacgagtgatgcgacaagtacagaatctggagtatcaatatgttgtagcgactgatttagctgctagagggatcgatatcgaaggtgtctctcatgttattaatgcagaaattccagaagatctagacttctttatccatcgtgtcggacgtactggacgtaatggcttaaaaggaacggccattacgttatattcgccaaatgatgagcaagccattgatgcgatagaaaaattgggcgtctcatttgaaccaaaagaaatcaaaaacggggaaatcgtcaaaacatacgatcgtaatagacgtgccaaacgagaaaaatcaaaagatgtattagatcccacgctgattggtcttgtgaagaagaaaaagaaaaagatcaagcctggttataagaaaaaaatcgattgggcaattgcagaaaaaaataaaaaagaacgcaaaatcgaacgcagacagcaaagccgtactgctcgtaaaaataagaaaaattcacataaataaaaaacaagaggttgtgacaaaaggcgtgtcacaatctcttgtttttaagctagactttttttcattccgatacaaagtacttcatcttcaataaaaggttctgtgcaagtatgatacccttgtttttcataaaaatctacagccgtcatttcagctactacataactagtctgacaaccttctgaaaccgcccgtttttcagcagcttcaagcaactgaccgcctaacccttttcctcggtattcttttgctacgcaaaatcgttccggcttgaagcaagtaggtgttttcttttcataacgcaaagtagctactggtcttttttgatcaagaaatagataataggtttgttgcgggatatcttttccgtcgaattctagttctgcaggaatcccttgttctaatacaaaaacttgatatctcaaaaagcagctagctgcgcgtatccattcatccgctccaactatttttttcatcatattcctccttgtcatgaatagcagagatgtattgattcctttattcttatcgtaccaaaaatcgtggagtatgaccaaaaggaaatgaaaataaaaattgagatattgacagtgatcaatagaatgcgtatactaattaagtacgaaaaggatatgatttgttttttaagactcacagaaaattctttcttggctgaaaaaagaatagtcactaatcaaattgctccctttttctattttggtagaaataccgacgcagctcagcgttatcgagtttaagaggtaatgattacacatcattgcaatcaaggtggtaccgcgagttttcgtccttggctgtgatggtgtttttttgtatttaatttatagaaagcaggtaatgacatgaaacaattaagtagtgcacaagttcgacaaatgtttcttgatttcttccaatctaaaggacatacgattgaacctagtgcgtctttgatccccgtgaacgatccaaccttattgtggatcaactctggtgttgcaacattgaaaaaatattttgatggttcagttgtgccagaaaatccaagaatcacaaatgcccaaaaatctattcgaacaaatgatatcgaaaatgtcggtaaaacagcacggcaccatacgatgtttgagatgctgggtaatttttcgattggtgactatttcaaaaatgaagccatccactgggcatgggaatttttgactgatccaaaatggatggcattcgatccagaaaaactttatgtaacagtttatccaaaagatacagaagcaaaacgcatctggcatgaagaagttggcctgccactagatcacattattgatgtagaagacaacttctgggatatcggtgcaggcccatgtggtccggatacggaaattttctatgaccgtggagaagcttataacgatttagcagaagacgatcctgaaaactatccaggaggagaaaatgaacgttatttagaaatctggaacttagtattttcagaattcaaccataagcctgataacacatttgaaccacttcctcataaaaacattgatacggggatgggattggaacgcatggtctcaatcgttcaagatgcgtcaacgaactttgagacagacttgtttatgcctattatccacgccgtagaaaagctaagcaaacaagtaaaatatggtgaaaacccagtaacagatatttcttacaaagtaatcgcagatcatattcgcgccctttcatttgctattggcgacggtgcattgccatcgaatgaagggagagggtatgtcttacgccgtttgcttcgtcgtgctgtcatgcatgggaaaaaattaggtattgaacaagcattcttatatcgtttagtccctgttgttggggaaatcatggtaagttattatcctgaagtacttcaacaaaaagaatttattgaaaaagttatccgtacagaagaagaacgtttcaatgaaacaatcaatgaaggtttggaaatcttaaatcaagtgatccaagaagtaaaaaacgaaaacgggacgactctagcaggaaaagacatcttcaaactatacgacacatatggcttcccggtagaattaacggaagaggtggcagaagatgaaggactgaaagttgatcatgctggttttgaaaaagaaatggatgcacaacgcgaacgtgctcgctctgcccgcagtactgaaaaatcaatgggggtacaatctgctttattgacagatatcaaagtagaaagtaaattcattggatacacagaacaagaatcagatagtcaattattggtcatcgttaaaggtgagtctcttttgaatgaagtcgcagaaggtgaagctcaaatgatctttgatcaaacacctttctatgcagaaatgggtgggcaagtagcggatcaaggatggatcatgaatgaagtaggcgaaatcgtagcagttgttacagatgttcaaaaagcgcctaatggtcaatttatgcacaccgtagaagtaaaagcaccaatgagtgaaggacaaacctatcatctattgatcgatcaatcgatgcgcaatcggatcatcaaaaaccatacagcaacccatctactgcacaaggcattgaaagaagtacttggcgagcatgcaaatcaagctggttctttagtcgctcctggacatttacgattcgactttacccactttggtcaaatcacttcagatgaattagctgaaatggaaagaatcgtcaacgaaaaaatctgggaagctatcccagttgaaacaattgaaacagatatcgatacagccaaaaacatgggtgcaatggctttgtttggtgaaaaatacggacatgacgttcgagtagtaaatattggcggctggtcaatcgaactgtgcggaggcacacatgtagcaaatacagaaaacatcggaatcttcaaaatcgtttctgaatcaggaattggtgcaggcgtgcgacgaatcgaggctgtaacaagtaaagaagcgtacgaactacttgaagaagaagaaaaacaactaaaacaagtagcaacaattgttaaatcacctcaattgaaagaagttgtttcaaaagcggaacaattgcaacagcaagtaagagagctacaaaaggaaaatgaacaattagctagcaagttagcgaatcaacaagctggtgatgtattcaaagatccagaaacgatcaatggaaaaacaatcattgcagcacaagtaaaagtgaaagatatgaatcagctgcgtcaattagctgaccaatggaaacaaaaaaatatttcagatattcttgttttagcaaacgaacaagaaggaaaagtcagtctgctagcggcaatgacgaaagaatcaaatgaagctggactaaaagctggcgacttgattaaagcaatcgcaccgaaagtaggcggtggcggtggtggacgtccagacatggcacaagctggcgggaaaaatcctgctggtattccagatgcacttaaagctgcgaaagaatgggttgcgcaacaatagggcgtttacgtttgacagaaaaacaaaagttcaaacattgaacgaaacatgattatgggggcgaagacaaacaagtcttgccctcatacttttttcaattggatggcgcatctaatcaaatggtcggattcggatggtctttagttgacgaaagtgacagaaatttttacgattagtataaataaaaaggggtgaaaaaatgaatagtagaaataagacctttcgactagtcttacgtgcgatcttgttagcaatcatcatcgtacaagcgatggttccttggctggggtttattccattaggattcattagtttaacaattatccatatcacagtaattattgctgcagtagtattaggcccaaaagatggcatggtgattggcttgttttggggaatcgctacaattgttcgtgcctatgccatgccaacaacgccatttgatacattagtgttcacgaatccgattatctcggtagttcccagagtacttgttggcttagtagcaggcttggttttccactggatttatcaaaaaaataaatcaataacgatcagctcagcctttgcaggggtactgggttcattggtcaatacagtcttagtgttaggattcatgggattattttatacaggtgcaacggcagatgcctatggtgtagactctgctcttttatttaaaaccttagcaggggttgcagcaatcaatgggataccagaagcaataggtgcgggaatcataacaccattactagcaaaagcgttatttgcagcaacaccgttgaaaccagaataatgaccatcttttaatagtaataggacgcacgatagatagaaaaaggaagagaggagaggaaaacaatcgtcctctccatctttttacctgagcaacaagcaaactagaaggggtaaaaaacttggctaagaaacaagaagaaaaaaagaaacaaataccgcaacagcggacaaaaaaaggagtactagcgggtatcttaggattggttacgaatctgatcttgtttgtctctaagctaatgatcgggcttttttcaggaagtgtctccattatggctgatgcagtgaacagtctatcagatactgcttcatccatattgactttgatcggatttaaaattgctgcaaagccagcagatcaggaacatccttatggacacgaacgcttcgaatatatcagtgggttatttgtttcgatcatcattacttatgtaggatttcaatttttagagtcttctgctgaaaaaatcatccatccagaaaatgtctctttaacacccatcgtcttttttgtcctaatcatttccatctttttgaaatttgcacaaggcaaaatgtatcaggttattgcgcaatccattgattctgaaacattgagagctacagcaacagatagttataatgatgtctttactacactggctgtattgctttcagcagcaatcgaatgggtaactggatggcgtattgatggatatataggttttgctttagcattatatatcctttatagtggattgacgatgcttcgaaattttgtatacgaactattaggaagtcgcccaacgccagcagagattgaagaaatggaagagcatttaaatgcttgcgatgatatacttggctatcatgatttattggtgcataactatggacccaataaacgctttgcatcagtccacatcgaagtagatgaatcaatgaatttgaatgtggctcataagattattgatctgatagaaaaagactttaaaaagtctttggatgtggaacttgtctgtcacttggatccaatgcctgttgataacgaaaaatactataatatcttgcggcagttaaagcaaattcttcttgaaacaggtacagggcttaatattcatgattttagagtaattcatcaaggaaaaacgctgcaatttgatgtagtggtccctgagaaattccagtttgttgatacagaactagaaagaatcttacgtagtcaaatagaagaaaaaatcggagattaccaattggaaattacgtttgatcacaattatcttttatattaaatgagaaactataaaaagactccttaaagtttttaatttaaagagtctttttttcttttaattgtttatggagagcctgacgtgcaagattatctgctcctttatttttgttttcgggcaaccattgcaggatcaataaagaaaattcggatagaagttcttggattctttgaaggtagggaaggaagagctcgttcttcgttgcgtttttgtcgaccgtagaaactagtgttttgctgtctgaaaaacagaaaatcgtttcattctgtaagtcgtttttctttagaaattctaaagtttttaaaaagacttcgaactctgcttgatggtttgtccctatagaaagcgggatagatagctgttcttgtttaccttgatagacaatcaagattccacctccactaggaccagggttgccttttgtagaggcatcaatgtatacttttaacataaaaagagattctcctttttgttcaaactaatgttatggtaagattatatcattactgaatcggtgagaggttagagaatgaaaaaaaatattcgatggcagcctgaactggcacatacgatcatctattggtcattgaccttgatcattctgttttttagtctgattctttctttagaaaacacaggtccttattggaaaagcaattttgttttaggtatttttcttgtttttctatttctaggtttgcggcgttcttttattttaaaatcaaactctgtgattatacgttatgctgctttttggaaagaccgagaaatatctgtcggacagattcgatctttgacgccaactaatactggggtgcaaatgatgttgcaagatgagaaagccccatctgttttcatgatgcgaaaaaaagatcaagtagtcctttttgatcattttgaaaaaaacggacccaaatcagaatcaattccttatccttatacgaaaaaaagaaaaagctaattttaaaaatcagaacctaaaaaaacgaatttttacaggaaaagaaaagagtgagacgtacggttcatcccgtttagcgtctcactctatttgtttatctattcatgcatactagtatcggtagtctgaacgttgcctttcttgacatgggcagcttgtgttcctcgattcccttcgatgatctcaaattcgaccacttgattttcttccaaagttttgaatccctcttcttcaatcgcagtaaaatgtacaaaaatttcttctgtgtcatcataactgataaagccgtatccttttttgttgtcaaaccattttacaattcctgtggtcaaagcactcacgacctttctaaagtctgatcatagccttcattataaagagtatttataagtacgtcaaataaattaaaaacctgtaattttatgtttttttctgaataaaaaaaggtataattggcatatcttaacaaagaagatattttgttgaataaagttcgtgaaaaggggtaatcaaatgaagaatgatctgcaaatttcacaagaaacagagctagaaccgattgttgaagtggctagtaaattagatcttaaggaagacgatttggaactgtatgggaaatataaggcgaaaatcaatttttctggaatcaatcgatcaaaggataacgctgaggggcatttgatcttagttacttccatcaatccaacaccagctggcgaaggaaagtcaacgatcactgtagggttaggagacgcgctcaataaaatcaataaaaaatctgttattgcattgcgagaaccctcacttggtcctgtgatgggaatcaaaggtggtgctgcaggcggaggatatgcacaggtattgcctatggaagatatcaacttgcattttactggtgacatgcatgctatcacaacagctaataatgcattatctgctcttttagataatcatattcatcaaggaaatgaattgaacatcgatgcccgccgagtgatttggaaacgggtagtcgatctcaatgatcgtgaactgcgtaaagtaattgttggcttgggtgggccaatccaaggtgttccaagagaagatgggtttgatatcacagttgccagcgaaatcatggctatcttgtgtcttgcggcagaccttgaagatttaaaggctcgtcttgcaaggatcgttgtcggctatacatttgaccgtcagcctgtgactgctggagacttgaaagcagaaggcgctctggcattactgctgaaagatgcaatcaagccgaatcttgtacaaacaatttacggaacaccagcttttgtccacgggggaccgtttgccaatatcgctcatggctgcaatagtattttagctaccaagacagcattgagattagcagattacgttgtcacagaggcaggatttggtgcagatcttggcggagagaaatttttagatatcaaagtacctaacttgaaaaaagcgccggatgctgtggtgattgtcgccactgtccgtgcattgaaaatgcatggcggaatgaaaaaagatgaacttaaaaatgagaatcttgatgctttgaaagtaggttttgcaaatttaaagcgccatatacgtaatatggaacaatatcagctacctgtgatcgtcgcaatcaatgaattcgtaacagatacagacaatgaactcacactgttggagcacttgtgtgaaaatcaggggattcttgccaagagagcgagtgtatgggcagatggagcagaaggcggcgttgatttagcaaaagctgtagtacgattgattgatagaaaagaagctaattacaagccattataccgcctagaagaaacgatacaagaaaagacagaaacaatcgtcaagaaaatttacggaggaaatggtgttgttttcagcaaaaaagcgcaaaaacaaatagaagagtttacgaagaatggatgggacaaactgccgatttgtatggcaaaaacacagtattcattttctgatgatccttcactgctaggtgcaccggaagatttcaccatcacgatccgcgaaatcatcccaaaattaggggcaggatttttagtagccttgactggagatgttatgacgatgcctggtttgcctaaaaaacctgctgcattgaatatggacgtgacaaatgacggagaagtgttgggattgttttaagcttgattataatctaccatcgaaggagctgtattttgactacagcttctttttttagacgatagggaattaattttgtttacactaggatcattctttttctttattgtattttgagctatactaaagcataataggagggtatgatgaaaacgacatttataagaaaaaccggtttttacggtatgggtagctcgattcagctaagaatcaacaatgaaaaacgcagtgttctcagtcatgaacaaaagataacgcttgatctggaagtgccctttacgatgcaggtcaccttttattggctaaaaagccccgtttatacagtgaaagaagcaaagcctgcttatgtgatcacaatgaattacttgattcttcaaatctatccgtttttatttctagcaactgggttgggggccgttttcctacaaaatttatttttcagtttttttgcagttattgtgttgattgcgttctttttctatataaaaaaccgggcatatttgatcaaggaggaaaattatggcaaactctgatctttttttaatcagtttcaatcgaatcgaaaaatggatgagagacgagatgggaaatgcacgaaatatgggatttaccgaacttgtcagacgcctagctcaaagaaaacaattaatgatcagaaaatacgaagatgatcttttacagcttgctcagttaaggaatgcgatcgtccatgatcggatcgcagtcgattttgtcattgcagagccaaatgattggacagtcaagcgaatccagctgatcgaacaagaactgattcagcctgaaaccgtgctgcctcgatttgcaaaacgtgtaacaggttttgaacaagatcttccgttacttgaactgttaaagatagtagcagaaaaaaggtattcacaatttccgttatacaataaaggaaaatttgtagcattgattactttacgtaatatcgggttttggctagcaaaagaaagccaaaaaggtccggttgatttaacaaataaacgagcgttggatttgatcatccaaaacggaaagtacacaaattatcattttgttccagctaaaacacatatttacgaggttgaagcgatgtttcgtgagcaagggactttggaagccgtacttatcactaaagatgggaatcccgatggtaatctgctcgggatcgtacgacctcgtgatatttataaacaaatagaaaaggattgattttttgttaattatttattggatattcagcgctttgctagtaggagtggatcagttggtcaaatggtggatcactgataatctagcgcttggagagacgaaaaatcttataccaggtattttgtcactgaatcatattcgaaacactggagccgcatggagtatgctagaagggaagatgtggttctttactatagtgacactcattgcagtcgttgtgattctcacattgatgattaaaaatcgtgaaaaaggtaatcgctggttcatgattggattgagtttgattctagctggtgcgattggcaattttatcgaccgtattcgtcttggctatgtagtagatatgttccagacagattttatgagctttccgatttttaacgtagcagatgtgacacttgtatgtggagtgatttgtatgttaatttatattattttagatgaaaaggatcaaagaaaaaaatgacagaacttaaaacgacgattcaccatgaatctggtaggatcgataaagtattgactaatttattcaccgattacagtcgttcgcaaattcagctgtggctgaaaaatggagcggtttctgtcaatggacagccagtcaaagcaaattacaaagtaaaacaaggagacgagattactgtcttgatccccgaaccagaaacattagatgtggtcccagaaaatatcccgttgacgatcgtttacgaagatgaagatgtagcggtgataaacaaacctcaaggaatggtcgttcatccttcagcaggtcatacgcatggcacaatggtcaatgcgctgatgtaccatatcaaggatctttctacgatcaacggcgttattcgtccaggtattgttcaccgaatcgacaaagatacttccggactgctaatggttgccaaaaatgaccaggcacacgaatcattagctcagcaattaaaagataagacctctttgcgcaaatatgttgctttagtccatggagagattcctcacgaaaaaggaaccatcaatgcgccaatcggccgttcgaaggaaaaccggaaaatgcaggcgataagagaagatgggaagtcggctgtcacacattttactgtattggaacgtttcgaaggatttactctggttgaattaaaactagaaaccggaagaacacaccagatccgtgtgcatatgaagtatatcggttatccgttagctggagatccagtatacggaccgaagaaaactttgaaaggcaatggtcagtttctccatgcgcaaatgttaggttttacgcacccgactacaaacgaaaagatgatctttgaagcacctcttccagaagtttttgaaaaaactttagaaaaattaagaaaaaacattgcattttaatttagataacggtatagtaattaacaacgaaagcataaaacttaatagaattcctttaagtttagtcccgtgaggctaagaagggtgggagcaaggatacgtatggtgcgccataagtagattgctcattgacatagtatagctatcagtgtatcagtatacgctcagtctaaacattcctcctgtcctcttagggcaggagtttttttatgcaaaaaagtagggggaatgaaaatgcaagcaaaagaagtagtagatcaggtaaccatgaagcgagcattgactcgaattacttatgagattatcgagagaaaccatagtatccaagatatcgtattggtaggtatcaaaacacgaggaatctacattgcatcaagaattgccgaacgcctgaagcagctagaagatatcgatattcctgtaggagaactggatatcactttataccgagatgacaaaaaagaaaatccagaagaaccggaacttcattcttctgacatcccagtttccttagaaggaaaagaagttattttgattgatgatgttttgtatacaggacgaacgattcgagcagcaatggacgcagtaatggattttggcagaccaagaaaaatttcattagcagtcctggtcgatcgtgggcatcgagaattgccaatccgtgcagattatgttgggaagaacattccaacatctcgggcggaagagattttagtagagatgcaagagcttgatggacaagatcgcatcatgattttgaaagaggaagattagaggagagagaaacatgtcggagaaaaaaggatttcataatgatgacgtggtgttagatatccacgatcgcccaaccccaggacattgggtaggattaagtttacaacacttgttcacgatgttcggagcaaccgtgttagtccccatcttagtaggtatcgatccaggtattgcgctagtcagttcaggactaggtacattggtgtacttatttactactaaaggaaagatacctgcgtacttaggaagcagcttcgctttcattgcagcgatgcagcttttgatgaaaacagatggttatccagcgattgcacaaggagcagtcacaactggattagtctatttgattgttgcgctgatcatcaaaaagatcggttcagcatggctggataaaatcttgcctccaatcgtcgtcggtccagtcatcatggttatcgggttgggacttgcggcaaatgcagcaacaaatgctatgtataatcagggcacgtatgatttcaagtatattgctgtagcgctgatcacattaggattaacaattttcttcaacatgtggctaagaggttttctcggattgattccgattttactaggtattattagcggatacatcgtagccttgctgtttggaatcgtggatactaagccaatcgtagacgctgcctggtttgctgttcctaactttgagattccctttgtacaatatgaaccaaagctatatcttggagcaatcacaacaatggcacccatcgcttttgtgacgatgacagagcatatcggccatcttatggtattgaataaactaactaaacgtaatttctttgaagaaccgggtcttcataagacgttgacaggtgatggattagcacaaatcgtggcagcctttgtcggaggtcctcctgtaacaagttacggtgaaaacattggtgttctggctatcacacgtgtccatagcgtgtttgtgatcggtggagctgcagtatttgcagtcattttaggattcgtaggaaaattaagcgctttgattttaagtatccctggaccagtcatctcaggaatcagttttatcttatttggagtaattgccgcaagtggaatgaagattttaatcgagaacaaaatcgattttgataaaaagaaaaatctgttgattgcttcagttatcttagtagtaggaattggcggactcgtctttgaagtaggcacatttacattgtcggcaatggcattagcaactgtacttggcatcattttaaatcttatcttaccagaaacttcacgaagcgaagaaaactaaggaggaaacattatgatcatcaaatcagaacgtatcagcttaaagcatttattgaccgttgaggcacttactgatcaagaagttatgggcttgatccgcagagggcaggaattcaagcaaggtgctaattggactccgcaaaagcgccagtactttgctacaaacctctttttcgaaaatagtactcgcacacataaaagcttcgatgtagcggagaaaaaactagggctagaagtgattgaatttgaagcaagcacaagctctgtccaaaaaggggaaacactatacgatacagtactgacgatgtcagcattaggcgtagacgtagcggttatccgtcatggtgatgagaactattatgacgaactgatacaaagtaaaacaatccagtgttcgattatcaatggaggagacggaagcggacagcatccaacccaatgcttgcttgatttgatgaccatttatgaagaatttggtcattttgaaggtctgaaagttgccatcgtaggtgatatcactcactctcgcgtagctaaatccaatatgcagatgttaaaacgtctaggcgcacaagtattcttctcaggtcctagagaatggtacgacgatgaattcgaagtgtacggacattatatgccattggatgaactactagatcaagttgatgtcatgatgatgcttcgggtgcaacacgaacgccatgatggaaaagaaagtttctcaaaagaaggctaccatcaggaacatgggttaacagttgagcgtgcgaagaagttgcaaaaacatgcaatcattatgcacccagcaccagttaaccgtgatgtagaattagctgattcattagtggaaggattacagtcgcggatcgttcagcaaatgagcaatggagtattcgtcagaatggcaatcttagaagcagtgctaaatggaaaagcgtaattataggaggatgaaaaaatgaaaacactcattaaaaacggtcagatcaatacacgaaaaaatatgacgacaccagcagaaatttggatagaagatgggcgaatcaaagcaatcggtacaggattctcagaagccgaatttgatgaagtgtttgatgcaaagggacaattgatcacacctggtttagtggacgtccatgttcatttgagagagccaggatttacatacaaggagacgatcgaagctgggactcgctcagctgctcgtggcggtttcactactgtatgcgcgatgccgaatttaaatcctgtacctgatacggcagaaaagctgagacaagtatatgacatcattagaaaagatgcagttgtgaaggtattgcagtatgcgccaatcacagaaaatctgcgaagtgagaaattagttgatcaagaagcactgattgaagaaggtgcttttgctttcacaaatgacggtgtaggtgtccaaacagctgggacgatgtatctggctatgaaagaagctgcaaaaaacaataaagccctagtagcccatacagaagatgaatctttattatttggcggcgttatgcacgctggcaagaaggcagaagaacttggtcttcccgggatcttaagcgtaaccgagtcttctcaaattgctagagatctgttgctagctgaagcaactggtgttcattaccatgtttgccatgtttctactaaagaaagtgtccgtgtaatcagagacgcaaaaaaagcaggaatccacgtaacagcagaagtttcaccccatcatcttattttgatcgacgaagatattcccgaagatttcggcttttggaaaatgaacccgccgctaagaggacgggaggacagagaagctttgatcgaaggcttgcttgacggtacgatcgattgcatcgctacagaccatgccccccatggattagaagaaaaaagccaaagtttcatgaaatcaccatttggtatcgtaggaagcgaaacagcgtttcaactgatctatactcattttgtagaaactggtcgattcacgttggaacaagtgatcaattggttggcagttaaaccggctgagatttttggtttgaatgcaggaacgctaacggttggtgcccccgctgatgtagcagtttttgatattacacaaacttgcacgatcgataaagaagactttttatcaaaaggggagaatacaccttttatcggctggaaagtaaaaggcgaaacacaaatgacttttgtcaacggaaaacttgtgtggcagaagggagaataaaagtatggaacgtttgcttatattagaagatggaacagttttcgaaggaaaggcttttggtgcagatgctagtgtcttcggagaaatcgtttttacaacaagtatgactggttatcaagaaactatcactgatcaaagttttaacggtcaaatcattacatttacctatcctatggtgggtaattatggggtaaatagagatgattatgaatcgatttctccaacatgcaaaggagtagtagtaaaagaacatgcacgtgtagcttcaaactggcgaaaccaaatgacgctagattcatttttgaaacaaaaaggaattcctggaatatcaggtatcgatacgcgcgcccttactcgcaaaatccgtgaagtcggaacgatgaaagctagtatcgttgatgctggagattccttcgaacatgcatttgatcagctgaaagcaaccgttctagcaaccaatcaagtgcagcaagtctcaactaacaaaccttatccaagtccaggaacaggtcggaaagtcattgtcattgacttcggcttgaaacatagtattttacgagaattgagtaaaagaaactgtaacctcacagtacttccctataacacagatgccgagacgattttagcgctatcaccagacggagtcatgctgacgaatggacctggtgatccaaaagatgtgccagaagcaatcgaaatgatcaaaaaaatccaaggaaaagtaccgatttttggtatttgtctcggtcaccagttatttgctttagccaacggtgcagatacctataaaatgaaattcggacatcgaggattaaatcacccggtacgagaagtagcgaccggaagaattgattttacttctcaaaatcatggctatgcagtcgatgaagccacgattgatccagaaaaactcatcgtaactcatgtagaagtaaatgacggaacagtagaaggagtcaaacacagagattatcccgctttcagtgtgcagtttcatccagatgctgcccctggtccgcatgatgcactacatttatttgatgaatttatggaaatgatggacgcaggaaaggagcagtaaacagatgccgaaacgtacagatatcaagaaaattatggtgattggatctggtccgatcatcattggtcaagccgcagaatttgactacgcaggaacacaagcctgccttgccttaaaagaagaaggatatgaagtggttttagtaaattctaatcctgcgacgatcatgacggataaagaagtggcagatcaagtatatatcgaaccgatcacacttgaatttgtatcaaggattcttcgaaaagagcgtccagatgctctccttccaactttaggcggacagacaggcctcaatatggcaatggagctggcagcatcaggtattttagaagaattgaacatagaacttctaggaacaaagctttctgcgatcgatcaagcagaagatcgtgatctattcaaacagttgatgaaagaattgaatcagccaatccccgagtctgaaatcgtcaatacagtagaagaagctgtagattttgcaaataaaatcggctatcctgtcatcgttcgtccagcctttactttaggcggaactggtggaggtatgtgtgaaaatgaagaagaattacgtatcgtatcagaaaatggattaagtctttcccccgctacccaatgtttgattgaacgaagtattgcaggttttaaagaaattgaatatgaagtgatgagagattcggctgataatgcaatcgttgtctgcaatatggaaaattttgacccggtgggtatccatacaggtgattctatcgtatttgcccctagtcaaacattgtctgaccatgaatatcaaatgcttcgtgatgcttctctttcgattattcgagcacttaagatcgagggaggctgtaatgtccaactcgctcttgatccacatagttttaattattatgtgattgaagtcaatccgcgtgtttctcgttcatctgcgttagcaagtaaggcgactggctatccgatcgctaagctagctgctaaaatagcgcttggattaacattagacgaaatgaaaaatcctgttacaggaacgacttttgcagaatttgaacctgcattagattatgttgtagctaaaattcctcgctggccgtttgataagtttgaaaacggagaacggcttttaggcacgcagatgaaagcaactggtgaagtgatggctatcggtcggaatatcgaagagtctttattgaaagctgtgcgttctttagaaatcggtacacaccatatcgaacttcctgagttggcagacatcacggacgatgacctaatccaaaaagtggttcgagcacaagatgatcgcctgttttatgtagctgaagctattagaagagggtacaccatagaagaattagcggatttgacaaaaatcgatttattctttttagataaactgttgcatatcgtagaaatcgaacagcagttgaaacagcagccgttggatgacaagatattgaaaacagcgaaacaaaacggttttacagacaaaaaagtggcggagctgtgggaaataaacgaagaagccgttcgccagatgagaaaagaaaatgatttgattcctgtatataagatggttgacacttgtgcagcggaattcgaatcaaaaacaccttatttttatagttcctatgaatatgaaaatgaaagttcacgatcagaaaagccctcaattctagtactgggatctggtcctatccgtatcggacaaggggttgaatttgactatgcgactgtgcattctgtcaaagcaatccagcaggcaggatacgaagcaatcatcatgaacagcaatcctgaaacagtttcgactgacttttctatttcggataaattatattttgagccattgaccttcgaagatgtgatgaatgtgatcgagctagaacagccgataggagtaatcgttcaatttggtggtcagacagcaatcaacttagccgaacctttgactgctgctggtgtaaaaatcttagggacaacgatcgaagacttggatcgtgcggaaaatcgtgatttattcgagcaagcgctgaaagagttggatattcctcaacctttaggggatactgctacaagtaaagaagaagccgtggttatcgcttcgagaattggttatccagttcttgttcgtccaagctatgtattaggcggacgtgcgatggaaatcgttgaaaaccagcgagatttagaagattacatggaacatgctgtgaaagcatctccagaacatccagtactagtggaccgttacttgcttggtggtgaatgcgaagtggatgcgatttgtgacggtgaaacagtactcatcccagggatcatggagcatattgagcgtgctggtgtccattcaggggattcaatggctgtgtatccacctcaaacattatctgaatcgatcaagaaaacgatcgaagattacacgatccgcttagcattaggtttgaattgtgtcgggatgatgaatatccagtttgtcatccatgaaaatgaggtttatgtgatcgaagtcaatcctcgagcaagtcggactgttccattcttaagtaaggtgacaggaattccaatggcacaaattgcgacgaaagctattttgggagagaaactaaagacacttggttatgaaaacggactttatccagaaacaaaagaagttcatgttaaagcacctgtcttttcttttacgaaattgcagaaagttgatacttacttagggcctgaaatgaaatcgactggagaagtaatgggatctgacagacaattagacaaagctttgtacaaggcattcgaagcttctggattacacttgcctgaatatggagccgtattatttacgattgcggacgaaacaaaagaagaagcactagaattagctaaacgttttacagaaattggctatagtctgataggaacgaaacatacagctgcttatttcgaaaaaaatggtctggtcgttgaaacagtagcgaaaatttctgaggaagcagcagaaaaaaatgtagtcgacttaataagagatggtaaaacacaagtggttgtcaatacgattgataaagatcggggaaatgcttctaaagacggtttcatcatccgaagagaagcagttgaacatggtattccattgtttacttctttagacacagcagatgcgatcgttcgagtgatggaatcccgtgctttttcaactaaccctatttaacggcgagcacatgttaagacaaaaagacgaaaaaccgttgcaggaggggacagatgaaacaagaaatgatggaaatcgttcagcaaaaacagctggcaccaaagatttttgaaatgacattgaaaggtgatctagtaaaagaaatgcagcaaccaggacagttcttgcatattctcgtgccgcgtgcagacttgctattacgccgaccgattagcttgaatcatatcgaccacgaaacaaatacttgccgtatcatttatcgggtggaaggtgaggggactagagtcttctctactctttctgccggagaccatttagatgtcatgggtcctttaggcaatggttttgatttgtccaatcttcatacaggagacgaagtatttataatcggtggaggaatcggtgtccctcctctatatgagttatcaaaacagttagtcgaaaaaggaattaagccaacgcattttttaggttttgccacacatgaagtcgtttattatgaaaaagaatttaatcgtctaggagaaacaagaatcgctactgacgatggaacatacggtatgcacggaaatgtcggtaatttattgttaggaacgaagacggaacctacagctgtttttgcatgtggttcaaacgggttattgaagacagtggaacagctgttttcttcgcatcaaaatgtccagttatcattagaatcccgcatggcatgtgggataggggcttgctatgcttgcgtttgtcatacgccggaagatgaaacaggaacaaaaagtgtgaaagtttgtgacgaaggaccgatttttaaaataggagaggtaattatatgaatgagaatcctttagcggtcaaacttcctggcctagaattaaaaaatcctatcatgccggcaagcggctgtttcggttttggcaaagaatacggaaaatactatgatttgaatcagcttggatcgatcatggtcaaggcaacgactccaaatgcccgctttggcaatcccacgccaagagtggcggaaacaccatctggcatgttgaatgcaattggtttgcaaaatcctggtctagacgttgttatgcataaacttcttccagaattagaggagtacaatgagttacccatcatcgcaaatgttgctggtgcttgtgaagaagactatgtagaagtttgtagcaaaattggcgaagcaccaaatgtgaaagcaatcgagctgaacatttcttgcccaaatgtcaaacatggcggaattgcttttggaacagattctgatgttgcttttcaattaacacaagcagtaaagaaagtttcttctgttcctgtctatgtcaaattgtccccaaatgtaacagacatcgttccaatcgctcaggcaatcgaagctggaggggcagatgggtttacgatgatcaatactcttcttggtatgcggattgaccttaagacaagaaaaccgattttagccaatcaaacaggtggactctccggaccagcaatcaagcctgtcgctattcgtttgattcaccaagtagcaagtatatccagccttccaatcattgggatgggcggcgtgcagacagtggatgatgttcttgagatgtttatggctggagcaagtgctgtagctatagggaccgcgaatttcaccgatccgtatatctgtcctaaactaattaaagagctccctgtgcgaatgagcgaactaggcatcgaatcgctggaaagattaatcaaagaagtgagagaggaacgtgaacgatgaatcaactagaccaacgaccaattattgcattagatttttcaactaggcaagaggtagaagactttcttcgatttttcccgaaagaagaaaaattgtttgtgaaaatcggaatggaattgttctaccaagaaggacctgaaatcgtacgttatctaaaagaggctggtcataatgtatttttagatctgaaacttcacgatattccgaatacggtcgaaaaagcaatgcggggattggcaaagcttggtgttgatctcacctgtgttcatgccgctggcggtattcgtatgatggaggcggcaatgcgaggattagaagaggggactccagaaggtggaaaacgtccgctacttctagctatcactcagcttacttctacaagtgaagaagaaatgcatgccgatcaactaatcgaagtttctttagaaaaaagtgtgatccattatgctagctgtgccaaaaaagcaggattagatggtgtggtttcttctgcttgggaagtagaagcgatcaaagaaatggcaggagacgaatttgtttgcttaactccgggtataagaccagaaggaacagtcgcaggagatcagacaagagtagtcacaccttctcaggcaaaaaagatcggctcaacttttatcgttataggtcgaccaatcactcagtcaactaatccttataaagcatatcaaacgattcaaacagaatggagctaacctaaaatgaatgttgaacaaagtatcgcaaaagacttattagaaattgaagcagtatttttaaatccaagtaatccttttacatgggcaagtggaatcaaaagcccaatttactgtgataaccgaatcacgatgagctatccaaaagtccgaaaagagatcgcaaaaggattagcaagcaaaatcaaagaagcttaccctgaagtacaagtgattgctggaactgcaacagcaggaatccctcatgccgcatgggtagcggaaatactggatttgccaatggtctatattcgaagtaaggcgaaagatcatgggaaaggtaaccaaatcgaaggacgtatatttgaaggtcagaagatggttgtgatcgaggatttgatttctacaggcggaagtgtcttggaagcagctgaagcagcaaaaagagaaggtgcggatatccttggtgttgcggctatctttacgtatgagttgccaaaaggaaaagcaaatttcgaaaaagccgaaatccctcttatgacgttgaccaattattctgtattgattgaagcagctttagaagatcgttatatcgatgagcaagaattaactctgctaaaagaatggaaaaaagatcctgaaaattggcagatttaagcgcgcttgatgaagatagagaaatccgatttgtgtctccagaatcatcaattggaatagcaaaaatccaaaaactgattgcgagaagcatcttttcatcaggtatgaaaagaaacttctatcgtgatcagtttttgatttttttaaaattcatttttctaagactggttagcagaaagaagagaataatctcttctcttttttctattatatatagattttctctattttttggtaagggagctgtttcaaaaatggtaaagagcggaaatgttgcgaatatcagttatttaatgatatgatattcggaaaaagaaatctcaaagggaggtaacttttatggggttgaatgaatttattttaggattgaacaatttagagacgatcacaagggcacctggattttttaaatatacagagcatacagttgcagcacattcgtatcgtgtagcatctattgcgcaagttctaggagacattgaagaagcgaatggacaaccgatcgattggaaactgctctatgaaaaatcattgaatcatgactacacagagcgttttattggtgatatcaaaacgccggtgaaatacgcaagcaaagagttaagagggatgctgcaaacagttgaagaaaagatgacggacgaattcatcaaccaagagattccagctgagttccaagaagtttatcgccgtcggttgttcgaaggaaaagatgaaaccgtagaaggagaactattagccatttcagataaggttgaccttctttatgaatcttttgatgaaatcatcaaaaataacccggaaaaagtttataaggagatgttcattgaggcagtgactacgattaaaagctttgaacatcggccttctgttcagtatttctttaaagagatatttccggaactattgaaccaggaattttatggaaaagaggcgtttttagaaaccgtctcaacgattgtaaagaaagaagaaaaataaaaatgatatgagatgcagggggaagtatagttgaaaaagaatatggatgtcgaatggggctattctggagacaaaggtccggaaaattgggcgagtttatgtgattggtttgcgagaggtgcggaatttccattgcagtcgcctattcatttgaccaagggggaagaaaccaaaatagaaggagacacgctttcctttcattatcaaaagcaacggtttactgacaaggaattcaaaaacacgattcatttagtaccttttgaccaactcagttatgtagagttcaagaaagaacgctattatttgacagatattcatttccacttgccttctgaacatatcatcaacggaaaacaggaagatattgaatttcattttgttcatatgaacagcaaaaaagagaatctagttgtgggtgtcatgtaccagctaatggtacaggaaggttggctgtataatcaagaaaatggggaaagttggaacttagaaaaacatgagcattgggtaaatccggatgtgttctttccggagcaaaaaagccatttccattatattggctcattgacaactccgcctaccagcgggccaatccaatggtttgtaatggatcatgtaggaaaactgaaccaagagtttcttctccccttcgatggtcagtatgctcgaccgaacaaccgaccaatccagcccttgaatggaagagaaatttattatttcgaggagtttgagcaatgaatattcagcagatgaaatacgtggtcgctgtagcaaacaatggtagtttcagagaagcggcaaagaaaatgtttgtctcccagccaagtctttcagctggtatcaaagaattagaaaccgagttagggatcacgctgtttactcgaacgaatcgaggggcatatttaacagaagaagggcaagacttcttaaatcgtgccgagaaaatattggtccagcttgatacattagaaactcactatctaacgagtgaaaagagagacaatttttcgatcgctgcccagcattatgatttcttaggtcctttgaccgcacagctactcgaggaattcaaagacgagatcaaacaatttcggatcatggagacgacaacagcgagagtgatcgaagaagtcaaagagcagcacagtgagatcggcattatttatatgaatgagcataatcaagctggtatcagaagatatttacaacaaggagagctaagtggccgcagcattggaaaattcaaaacgcatatttttttaaggcaaggacatccattagctgaacacgcagagatcaccaaagaagaattgttatcttatcctcaagttcgttttacacaggatggaaataatttcccgtatttttatgaagaccttatcgagatccctgatcaagaaacagtgatttatacgagtgatcgaggtactttgatgaatatcgttcttgaaactgatgcttacgcttcaggatctggtattgtgattggagggattcgcgagcacttgcggttaatccctttggcagaaggcgaactaaatgaattttatatcatttattcggcgaaacgtccgctcagtgaaatcgctcaaagatttatcaaagagcttactcggttactggaccagcagagctaagaaaagcagatgagaacgctgtttattgaacaccgttgatcaaaaaagaggggttgtgacagaattttgtcacaactcctctttttgtagcaaacaatttataactaattgctgttgtgggaaagtacgcaaatatgattctagaaacactcattgattacctgtttt

SEQ ID NO: 3 - DNA, 2698137 bp, Enterococcus faecium (residues 1,349,070-2,698,137 of 2,698,137)
gtttcatagctgtaattttttcttcttctggtgtcacgataatcgtcttttggttttcataaataacataaccaggcttggcgccatttggttttcggatatgctttacctgtacaagatcaaccggcacttgggcagagtatcggtattttgaaaaataggcagctaactcggcagcttctgtaattgtttcatctgagggcttgtcacttttaatgatgacgtgcgaaccgggtatattttttgcatgaagccaatagtcggtttttttagctgtcttcattgtcagctggtcattttgaagattgtttttaccaacaagaatgagcgttccgtcagaagaaaagtattgatcaggctgagatggtttcttacgtttttgtttttttaagttcttctttttcaggtatccttctgaagtcaattcttctttaattgcttcgatatccattgggccggcaatttccagttgagataagacagattcaagatattggatttcatctttggcttcttggatttgttcgccaatcagcttaacagcgttcttcagcttttggtatcgatggaaatatttctgtgcattttgatttggtgtcaatgccggatctagtgctattttgattggccgatcttcttcataataattaggtaaaacaacttcttttgcgccgcgtggtacttgtgtcagaaaagtagtaagtagttcgccatttctacggtaattctcagcgttttcggattctttgagtgtttgttcacgttttttcaatttatttttatttcgttttagttcattttcgatttttcgaatcagttctccgccttgttgttttgcccgatctttctctgctttttcgtgataatagctatctaataattgactgagtgttggataagctgttacagcagatgcctgttcggacaatacctgataagcaatcggtgtgaaaaaatctttattttccgtttcgtaaaaagtaggaataggctgatggctgatggctgagaaaaattcgtcccatacaaccatcttttcattaggacgttccagtaatcttttggtcagctcttgagcgatatcgaaaccgattccctgaaactgacgttggattgcttttggatctagttcagtttgggaaagccgctgaaagattttttctttctcggagctaaatgggttcaagacctcttgttttggcggagcaacatattctacaccaggaagcaaagaacgataagtgttttgagagcttccaatgtgtttgatcgcatccagtatttttccagtttctcgattaactaagacgatcgtactatgacgtcccattaattcaacgatcaatatgatattttgtagatcacccaactcgtttcgtttagcaaagtggaaatggatcactcgatcattttcgatttgttcgatgtcttctaaaatagcgccatccaaatattttcgaagcatcatcacgaagttaggcggattatcaggattctgataatcgatttgggtaatctgtacacgagcataacttgggtgcgcagataataataatcgatggtttttgccgcgtgaacgaatcaccagcacgatttcattttcataaggctgatggattttcgagatccggccagatagtaacgtttcacgcaattcgttgaccatcgcgtgggtaaatacaccatcaaaggacatggttcattcctcatttcttttcataagtatattcattataacgaaaaaaagaagaaaaaccaatttggccgaatagtaaagcaaaagtctagaaaaatcttggactaattacataaaaaacagtgtttctatcgttgaaatccaaatttttaggtatcgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatatataataaaaaataggagaaaaagtagaaaagaaggtgtttgttatttgggaagtagttaaatcgagagtacaagaaatgaatgaacatttctcagtgtcattcgcagaaaatccaagtaagtattttcgacgtcttgtttttctgctcatcttatcattgctgttaacagttgcaatgtttttattgccggaaaaaatccgagaagagcaagtaaatagtctcgtttattcgtccataccaaccagcaaattgaaaccttttgattacagcaaagctgatcagaaaatcaaacaaagccgggcgatatcggtgatgttcagcaaaccgaacgggaaaacctatcaggacatgcttgatgtttttaatgatcctgagcttatggaagaattgaatcgaccgatcttttattatccgatcgtttatgatgtacatgaactggaacaaaaatataacatacgaacggatgaagtgacatttattttctttgatggaggaaaagaagcaaatcggataactgcgggtaagggaggaataactgattttgataaggagttgatccctgaactgaatcgacttccgttagccaatatcaaacaattagaagaagaattggatagaacgggagtaacttcccaaaattccgagattgctaattgagacattggcgcgatgaaacggtgggtctatatagcgctatttttaattatcagaacaagtgatgtttgatcttcaaaataacaaataaaaaattaaaaaatatagttgacgaaattcaaaaattcgattagacttaaatcaattcttaaggaaagggtgacctgtaatgaacttatcaaaacgtatttcagcagaaaacaaaaaaattggcgcagctggcgtagataagttgtattaatggtgagactttcccatagatacaactttttagagtgcatttctaaagcttgtatctatgctagacatgaacattgactgccgcatagattagaatctatgcggttttttgtgtaaagacaatgaccgctttggccattgtctttttttgtagactggatacttgcctgattataataaataaaaagattgactttgcaggaggaaaaaaatgaaaaacaaacgattaataacagttgtagtaattattttagtttatttagcaggtgcatttatttatggaaaagcctcaggcgaaaaagaaagtacttcgacgaaccagacaaaaaaaacaacagttgttggggtattgcaatacgtgagccatccggcattagatgagatttatcgaggaatcaaagatggtctgaaagaagaaggattaaaagaaggagaaaatcttgagatcaaatttcaaaatggacaagccgatcagagcaagctagccacaatgagtcaacagctagtacaatctgatccagatgccttgattggaatcgcaacacctgccgctcaatcattagcaaacacgacttcatcgatcccagttgtgttaggtgctgtaacggatcctgtgggggctggattagtcgcttctttagagaaacctggtggtaatgtaacaggtgtttctgatcagccgcctgttacttcacaaatcaagcttgcttctgatttgttgccaaatgcaaaaaaagtcggaatcttgtatgcttcttcagaggataattcaaaataccaagtagcacaagcagaagaagctgcaaaaaaagaagggttagaatcagtaaaatatgcggtgccttccactaatgagattgcacaaacggttcaagtgatgagccgacaagtcgattttatctatgttccattagataataccattgccaatgcgatgcaaacagtggtaaaagaagcaaacaaagcaaatatccccgtcattccatctgtggatacaatggtggaacaaggtggactagcaacaatcgggatcaatcaatatcaattagggcttcaaagcggtaagatggcggcagaacttgcgagtggaaaagaaaaaccggaaacgacgcctgtttatacatttgatcaaggggatacagtgatcaatcaatctcaagctgatcgcttaggaatcattgttccccaatcgatgaaggaaaaagccaaaatcattacagatgactcgcagcaagaaacatctaaggaggatgacaaatgatcgtatcagctatttcacaaggcatgctttgggcaatattaggattagggattttcatgacttatcggatcttagactttcctgatatgacgacagaagggtccttcccattaggtgctgctgtctgtgtgacagctattactcatggggtagcgccgattgtagctacattattaggcgtaggtgctggcatgatagcaggactcgttacggggttactttatacaaaaggaaagataccggttattttagcagggattttagtgatgtcaggattgaactcagttattttgtttgtgatgcgaacaccaaatctttctttattgaatcatccgattctacaagacagcttccatcgctttgggttacctgattactttgacacagtccttcttggcttcatctctttgggcatcttgattgctgtactgctattcttcttcaatacagatttgggtcaaggctatattgcgacaggagacaacgaaacgatggctcggtcgttagggataaaaaccgatcgtatgaaaattttaggtttaactttgtcgaacggtgtcattgcattatccggtgcgctgattgcccagaacgacggatatgcagatgtaaataaagggattggcgtaatcgtcatcggtcttgcttccatcatcatcggtgaagtgatcttccaagaattgacgctagcagaaagattgattgctattgttgtcggcagtatcatttatcagctattgattttagtagtaatcaaactagggtttgacacgacttatctgaagttgttctccgctatcatcttagctatttgtctgatgatcccgcaattgaagaaagcactgaacttaaaaacgggttttgagaaggaggcatagtaatgactgatatattgacaatcaaaaatggcagaaaagtcgtaaacaatggaatgaatgaagagaaagtactattggatgaaattaaccttacaatcagagaaggggacttcatcactgtccttggcgggaatggtgctggaaaaagcacactgttcaatacgatcgctggtacgcttcaactcagtcaaggatcgatctcttttaaagatcagctgatcacaaaagattcagaagaaaaaagagcacgattcctttctcgagttttccaagaccccaagatgggaacggctcctcggatgacagtagcagaaaatttgctacttgcacaaaaaagaggtcaaaaacggaaattccgtttacgtaacttgaaaaatcaaaaagaagattttttcagactatgtcaagaagtcggtaatggcctagagcaacacttggatactccagcgggtgaattatctggtggtcaacgccaagcattaagcttgctgatggcgacgatcacagctcctgagttactattattagatgaacatactgcagctttagatcctaaaacagctaaagcattaatgcgattaacaaatcagcggatcaatgaacaaaaattgacttgtctcatgatcacgcatcgaatggaagacgccttgaaatacggaaatcgtctgatcgtactccaaaaagggaaaatcgttcaagatatttctgaaaaagaaaagcaacatttgacaatgggcgaccttttgcagttctttgaagaagtagtggattgatttcgacagaaaaattcctttcagtagaaggacttgaaaactcattgacatcttcctttgattcatcctatacttaaaacaataaacaattaaacatatttgggtgttttgtaggatcacgtagtcaatgattttaacaattaaatagaatattctttgctctgacaagtaaacgatgagaaaagaatttgctactttgccacctagacgtttcgtactttttcgtatcaaacgctaagtggctttttttattgaagtaagaacaaaggaggaataagatgatttctggacaaaccaaattagctgggctctttgctgatccggcttctcacagtttatccccattgatgcacaatactgcttttgaagcaaacaacatcgatgcggtgtatttagctttccaagtaaatccaatgaatttgaagcaagcagtcgaaagtattcgaacttttgatatgttaggtgtaaatctttcgatgccgaataaaacagcggttattccttatctggatgaggtaagccaggaagcgcaattgatcggagcagtgaatacgatcgtgcacgaaaagggtcgtttgattggctataataccgatggtgcgggcttcatgcaatccgtgcaagaagctgggatttcgatcaaaaagaaaaaaatgactctactgggagctggaggtgcagcaaaggcagtcactgttcaagctgcgttagacggcgctgaggaaatcgtagtttataaacgaaacaaccaaacattcgctcaagtaaaagaaacattcgaacaactcagctatcgaacttcttgtaagataaaagttcgtgactttgccgatacgcatcaattaagaaaagacttgaaagaaagctgtcttctagtcaatgcaacagatatcgggatgggaaagaaaatcaatcagtcaccgctcttagatataagcatgatgcatgagaatctagcggtttttgatttgatttatgcacctagagaaacacgtttattaaaagaagcaaaaaaagtaggagcaaaaggatacaatggacttggcatgttgatctaccaaggagcaatcgcgtttgaattatggacaaaggaaaagatgccgatccatgtgattgaaaagctgtttgattaaaaaaggataatagataaagatcttttattctcgcataaacggtctcaagaaaagtaatcctttatgtatcgaagcatttatttcgttattttttattaaattatcaaaaaatgataggcttttgtcgattggttatcgtatcctttatttatcagtaagaaacgaggaggaaccacaatgagtcggatggatcgctataaggacatccataagaaggcgaaacctctgaagcgggatacggggagtatttttgctagaagagaacgaaaacgaacgcgtatggaaaatgaggaagatgctacccgtatttatgaaagagagcagcattcatttgaacatttgaaccaatacgagcaacagatatacagagatgcaccaagagcagaagaacaacaaaaaaataaaaaatttttcaatcggcaaaagaagaacaaaccgttaaaacctcgaagaaagcgatcgtggaaaaaaatcattctatcgattttgcttgttttgatcctttattcaggtatctcattttttattggtaaatatgtagctgaacatgacacaagcttagaggcagcgacttcagaaacctttcatgggcaaaaagcgacgaatggtgcgcataatattttgatccttggaagtgatacacgcggagaagatgccgggcgagccgatacgatcatggtcttacagttggatggtccttcccataagccgaaactgatttcttttatgcgtgacagcttcgttacgatcccaggggtaggacaaaataagatcaattcagcttatgcatacggaggagccgatctagtgcgtcaaactttagtagaaaattttggaatcgattgtcaatactatgcgaaagtcgatttcaaatcgtttgaaaaagtgatcgatgccttattcatgaacggagtgaagatcgatgcagaaaaagatctgaatctggatggtgtagatattaaaaaaggggtccagaagatggatggacatgttcttttgcagtacgcacgtttccgaatggatgaacaaggagactttggccgtgtcagacgccaacagcaagtaatgaacgctattttcagccaattgaagaatccattgaatctgatccgtgcaccttatgcagctggtaaagctttaggatatacatccacagatgtcactgcttggttcttgacgaaaaacctcttttcgattgcacgaggagctggtggcattgatcgaataagtgtgccagtagacggttcgtggaattatgggcaaagtgattatgctggcagtattcttgaaattgataatcaaatgaatcaatctgctattacagattttttgaataaatgatcataaaaaagatcaagaagaagctgcgcaaggcttttgtcatgaatcaatcaaacgattcactcgtaaaaaacgctttcttatggtagatttaaccaagagaggagctgtttacattggatatctatctgaacttcaaaaatgagtcgcgtgaagccatcgctttttatgaaaaagtttttcagactgaagcatcaggtatcaccacatacggtgaaatgcctggaatagaacaaatgaacttgccagaagaagcaaaaaaatctaatcacgaatgcacggctgaacatttatgatacattagttatgtttgcagatacgccagaaggaattggtcctgaattagttgtgggaaataatgtttctttagtcatccagacaagaaatgaagaagaaacgaagcgcctatttgaaagcttagctgagggtggtaagattgagatgccactggatgctgttccgtgggctcagttgtatgggatggtaactgatcgatttggcatcaactggcagattaaccaagagtgacagctaaagatgaatattttctggaaacatcaagcagcaaacggatcatcgtttgtttgcttgatgtttttgtgtctatttcgactatacggtatcttttttttattgccagatgcgaaaatatgttccataatagagaagtccgcaaaaaattaagtaacggaggtcagaagatgaagacggtgatactagctgaaaaaccttcacaagcaaaagcctatgccgaaaccttccaacagcaaaagcggcatgaagggtattatgaaatcagcgatccattgtttgctggtgaagtaaccatcacttatggttttggacatttggtagatatggttgctccaggagcttatgaagagcgttgggcaaaatggtctttagaaaatttgcctattttcccagaaaccttccgttacgaagttccaatggacaaacgtgcacaattttcgatcgtaaaacgagaattgcagtcagccgataccatcattattgcaacagatggtgatcgagaaggtgaagccatcgcgtggtcgattattcgacaagcaaacgcattttctaaggaaaagaactatttacgtttatggatcaattctcttgaaaaagaagcaatctatgaaggttttaagaatctccaacctggaaagaactattttccaaaatataaagaagcgcaagcaaggcagaacgctgattggctgattggaatgaatggaagtccattatatagcttgctacttcaacgaaaagggattgatggcagtttttctcttggtcgtgtacaaacaccgacactctatatgatttatcagctgcaagaagaaatcaaacacttcaaaaaagaaacgtactttgaaggagaaggtttaattacgacaaacaaagggcagttttctggaaaaatcgtaccaaaaaaagcatttaaaacccaagaagagttaacgaaggaaatagaaaaacttggagcgcatttaggtaagcaaaacggacggattcttgaagttacgaaaaaggaaaagaggttgcatagtccacgtttattttcgctatctagtttgcagacaaagatgaatcagctaatgaaagcaagtgccaaagctacacttgatgctgctcaaggattgtacgaaagcaagtttctaagctatccaagaacggattccttttacattacagaaaatgagcatcagtatctggttaaacatctgcaaaattataaaaaatttttaggaatagaagaagtacagacaactgagatcaaagcaaagaaacgatatgtcgatgcgaaaaaagttcaagaacatcatgcaattattccgacaaagacgattccgactcctgcacgctttgcgaagctttccaaattacagcaagcaatctatttgcaagttttgcgcactactgtggctatgtttgctgcagattatatctacgaagagacgaccgtaatgacgggcgtacagcaattaaagctaaaaagcatcggaaagatcccattacagcaaggttggcaggaaatcttacgcatcaagtcaaaaaagaaagaagctcagactcttcctcctatcgtagaaaatgaagaagcagaagtagaactgaaaagtatggagaaagaaacacaacctccaaaaccctataccgaaggaacgttgatcacagcaatgaaaactgcgggaaaaacgctggataatgatgaagcgcaagaaattctcaaagaagtagaaggaatagggacagaagctacacgagccaatatcattgaaaatcttaagcagaagcattacatcgaagtcaataaaaacgaaataactgttacgccaaaaggaatcactctttgtaaggcagtagccaatgaaccattactgacgagcgcagaaatgactgcgcgctgggaagggtacttgagaaaaattggtaaacaagaggggacaccatctgtttttttagagaatatcaaaaaattcatcctacatttattggcagaagttcctaatcaaatcgacaaggtagacttttcagatgagattagcgggacacgtcagataaaagcgatggagaagaaaaacgatcaattaggaagatgtccaaaatgtaaaaagggaatagtcatgctttatcctaaaatcgctacatgcttgaatccggaatgcgacttcaaattgtggccaacagtagctaaaaagaagctgactaaaacgaatctcagagatttgctttcaaaaggaaagacaagtaaagttgtcaaaggttttactggtaaaaaagggaaattcgatgcagttttagtattaaaagaagatatgacaatcggtttttcttttccatggatcgaaaacagtggaacaaaagcagttgatggaaacaaagaaacatcaagaaaaaataatgaaaacgaagtagagtaaatgaaaacaatgaaatagcggaatatttattccgaaaagtgagaatataaataccaataaaactaaaaaatatcagtgaatcaagcaaaaacgttggggtaggctgattttatatagatagcaaggagtttttttatttgaaaaaagtgcattcatttttaaattatcttatgggagcaatcacgattgtggctgtgtaccaagcatttctaaagtatcctgattacgggacgaagttgttgtcattgacgcacaatcaaacagcatattcaccaacgttgattttatcgactttgactgcaggagctaaaagcgctacttatttttttcataaaacgacaagcatgctaaagcgaaagaaacagcgaaaacaattgttggtggtggtagcggctatgatcattatttattttctaccagttattacacaagtatttcatcaatattttggttaagaatacgagagtttgtgacaaaagtcatgtcacaaacttttttctttgtcattttttcgtaagaaaaagcaaaataaaagtatatacattgattaaaagtatatacttggatataatgtacttactatagaatgagaatggtatagagggtggcgaaatatgaaaaaaatgaaaaagtataaaattagaaaatctggcaatagcgatgtaacaactatcccaccagaagtaaaagaattcatgggtgtgcagacaggtgacgcaatcagttatgtttttcaatctgatggttctgtacgaatgatcaaagcacaagaagaacctgatattgattcattagttgattcgatcatgaatcaatatgaagacgcgttaaaagatttggttgatttatgaggtatctttcgactaaagaaattatcaaaatcaacgcgaaagttattttacgtcactcgccaggcgaaatgatcggtgtaaaagatgcaaatgcattagatatggccgtcaaacagccttcacaagcagtattcaatcaagaactctatcctgaaatctatgaaaaagcggcgattttagcaattaatttagctaaaaaacatccttttcataatggcaataaacgaactgctcttgttgccatgttgttgtttcttcaattgaataattgtccagttgctttttctcgtcaagaagctgttgattttatcataatgattaccactagttcattggatttcgattcactaaagtccaagataaccagttatttacgacaaaccgcaataaaatgaacgaattaaaaactttatttctcaattagatcagcatgtcattaaggaatatgctgatttttttatgtttaatcatacaaaatagttttttcataaaaatatggaaaatatggattaattttgaaataattgatttaaaaggaatacaaaagagtgaatagtaggaaatagtggtttagaactagtgggctgattttttatatattttagtttacataatatatattatacaaagtagatttaaaaaatgataaacctctctcgaacggttttttatcaaaaatcgtcatttttccatcaaaatctgcttatgcaaaattataaaaaaattttgcagtttttcttactttttttgtcgtttaattgaatgataaaaaccagtttctttattcagttaatcaaatatgaacgaattagatatgaatcattgtatttgccgttgcggaaggattttttaattaaccacagataaacattgataacgattcgcttattgtaatcaacagattaaatttcatatgttcatatgtacggatacattttcggaccgattaattttaaccattctgtttatttgcttacctattagatatcaataaaaaactgcttaacagctatttcagctgttaagcagttttaggatttttagttcatattcattgtttcttataatacagtgttcaatacttctcttaaagcacttgttgatttgctgaacattgctttttcttcttcgttgattgataattcaacaacttcacgaacaccattttcgtcaacgattgatggcacacctgtaaagatatctttttcgtcgtattcaccagttaaataagcagatacaggcaatacagcttgttcgttattcaagatagcttttacgatacgtgcagtactcataccaataccatagtaagttgcttttttacgatcaatgatctcataagcagcattacggactttatcagcaatcacatctaattcatcttgggcaatacgatggtctttttctacaatttcaaacactggtttaccaccgacagttgtatgtgaccatgcagcaacttctgaatcaccatgttcacctaagatatagccgtggacgctgcgtgggtcaacttttaatttcaatgcgatttctttacggaaacgagttgtatccaatgttgttccagtaccgataacacgtgatgttggcagaccagattcgttccaagcgatatatgtcaaaatatctactgggtttgaagcaacaacgataataccgtcgaatcctgatcccatgatttcttttacgatttggcgcatgattgacgcatttgttttaactaaatctaaacgagattgaccaggtttttggttgataccagctgtgataacaacgatatcagcatctttacattcttcatagccacctgaccatacagccacattttcatcgccccaagccataccatctaaaaggtccaatgcttccccttctgctttttcttgattcacatcgatcaatactaattcattagagattccttggttgatcattgcataagcgatacttgttccaacaaaacctgtaccgacgattactactttacgacttgtttttttcatgaataaacagctccttttcataactatttgttactttcatgaaaagtatagtcttgtttattcattttatcaacatgttaattataatagttgttattataatttttgatggaaacgaattcctgaatacgcataacagataaatgacaaatgtttacacctatatcccctgataatacaaccaaaagtttagaactgaaaataaatccaaaaaaattcgctgcaacgatataataagacagcaatcgcacctaaaacaattttccttcatatgctttagtgaaagattttcttcttaatgtttatttctccattcattgggagtacatgttgaatacttcttgaataatttgaataaagaagtcgtttgtttatatccgatacgattagcgatttcttccaacgaaaaactcgtttcttgaatcagttccaacgcaaagtcgaattttttctttagaaccagttcttgaaaggaagcatcaaaatacattttcaatttattactaagatagaccggattgtagccaaaatgagctgctgtttcttttaacgtacaagaagtaaaatgcttatcgatataatctaatactctaagcatctcattttctgcgcatccatctgctgatgaaaagctttgttgttctaataaatgagtcaattcgatcagtaatagtgatgtatagagatttaacgaacggatcttatgactgtatgtatcaaaataaatcaacagcatattttcaatcaaatgcgtcaaacgacttgtttttccgccgcgaaaatgaatgaattgtgtatgttcccctttttcttttgatgcatttatcaaaaaagaagaaagtagattatttgtgcttgccaaatgattcaatatctctgtagataaggtttcttcttttaataagatgttgattaaaatatcctcttgccctgtgtattcgattctttgagtagcttctttatcaatgatcaccacgtcactttcttccatctctatcctttctccattaataatttgtaaacatgtaccgctatacatataattgatttcaacaaaatcatgtgtatgctcgggaacttccgcatatcgacggtgtttactgatatgaatatttccctgttgaaatagatcccctcggtggatttttggcggtgtctgaagatggtaagctaagtttaaatcattgatattcattccttgttcacgctgcagagtttcgattgattcttcgttacgcaaaaaaaatgtctaattcagctagttccaattgactccctcctttttgtaagcggtttctttcgcttattagttcacgctgtactgctattatatgcaaagctatttttggtttcataaagactttctatggttgggacatgaacttcctgtgattccgctattgagagaataaccacttcatactatatttttgataagcgcttacaaaaatgaaaggaacatgcttatgaataaaaagatgatgaaattttctctgctgtcagtctctcttattttgacttctgctggtgcagtcacgtctgcaattcccagtatgtcagctacttatgccacgcgttctttatctgctgttgaattattaacgactgctccctcttttatggtcactatttttgttttgattagtagttttattgctaggaaaatcggacaaaaacaaactgtgatcatcggattagtgattgcatcgatttatggtatcctccccctcttctcacaaagttacagtattgtcttagcttcaagagctggactaggtattggctttggattgatcaattctttggcagtcagcatgattgctgccttttatcacggagatgaacgagcctctatgattggttttcaaagtgcatttcaaggatttggtgcagctttaatgacatttgttgcaggacagctagtacagttcggttggcaatatacctttttagtctacgccatcagcttacctattcttgtcttgtttgttttgtttgttcctacacctgaaacaactgaacttcaatcacatggcacagccccaacaagacaagtaatcaaaacgaatcctaaaatgattagttatggtatttttctcttgctggtcatcgtggtatataatgctgtatcgattaaattagccacagtcctgacgacttattctctaggaaacgaaactaatgcagcgaatatcttaacaatcatgcaattggcaagtatggctgccggagtttgttttggctggcttcagacaaaagcacatcgctatatgcttacactttctttactactgatgggaatcggctttgtattgattgccactgtgataaacctgtatgtgattgggtttggtgcgatcctaacaggaatttctttttcgttattcattccttacttattcaaccaagtaagtatccaagcgcccaagtacgcggagagtttcaatacttcaatcttattggttggcgctaatttaggtactttcattgcaccatatggtttgctctttctctcttttgcttctcttgggagtaaaacacttgctgttttcgtcaatggcagtatcttgctgttgattagcgcgcttattagccttctagtagtacacaggacgaatagaaagacagtgataagagtagatgaagaaataaaagaacaattgacaacaaaataaatttgatggaggtcgtgtaaaatgacaaatgaaaaacataaagatagatggctttggtatcctggagactttgagatccgccatggactgctacaaaatttccaacgggaagaacgaggttttgactggccagcgtactggtacatggatgattgccatcggaacgtcaagtttaagagatattactttcttgatcaaccttccatgtttaaagtgacgatccaaggagttgggtatgtagaaattaatggacaaaaacatccatgtggaaaatggctgacttgtccagctggtaaagcaaaaattcgtatctttgtaggacatacatcagggctaccagcgatgtttatcgagggagacgaagtaaaatcagatattggctggacagcaagtaattttattgaagaatatccagctggctggagtccgctttatgtcgatatcgcaaaagatccaaatcaaatctattatcaaaaagaatgcgtccatccagtcactgaaacggagattggcggaggaatcttattcgattttgggcgagcagtgaatggctgtgtagaactaatatctctggatgaccatatcgaatctatcactctatgttatggagagtccgatgtagaagctatggatatcgattattgctactataagcaaataggaatgacaagaaaaatgaaagctcgtaaacgcgcttttcgctatttgtttataccagaggtttctactggaatggttcaacttcaagtttttcatgaatttttatctctttcgaaacaagctgctttttcaagcgattcttctttactgaatcagatctggtcagtatcagaagaaaccttcaagttatgtagtgatttgttttttatcgacggtatcaaacgagatcgctggatttggtctggagatgcgtatcaatcattcatgatcaatcaatatcttttttttgacgaggaaatcaataaacgaacgatattagcattaagaggacaaaatgaaatcaagcagcatatgaatactatcgttgactattcgatcttgtggttgattggtatcgaaaaccactatatgatgacgaaagactatgaatttttacgcatcgtctaccctaagatgcaatcattaatgagatacttgatggagcaaacgaatgaattagggtttatttatgggagagcaaaagattggatatttattgattggtctgaaatggataaagaaggaacgcttgctgcagaacaagtcttattactgaaagcctatcattccatgatcacttgcggagatatcttagctgaaacatatggagagaacgaaaattatcatactcatctctatcaagaaaaatatcaactattgaaacaaaacctatttgactacttttgggatgaagaacttggcgcttttatcgattgctatgaatctgggagaagaaatgtgacgcgtcatgcgaatattttcgctgttttattcgattttgctaacaaagaccaacagcaatcgatcttaaagaatgtcttattgaatgacactatcacacagattactactccatatttcaaattctatgaacaagatgctttatgcaaactcggacagacgaatatcgtctaccaaacgattcttgattattggggagggatgttatctcatgatgcggtaactttctgggaagaatacgaccctactcaaacaggaaatgaaaagtacagtatgtatggagatccttatggaaaaagcttatgccatgcatggggagcaagcccaatctatcttttaggacgctattttatcggtttgtatccaacaaagccaggttatgaagaatttatgatacaacctaatctagattcatttgaaacactgaattgtacgctacctatcaaagatggaaagatttcgcttgaaaaaacaaaagataagatcgtgattacttctgatagaacaggcggaacagtgaaaatgaatggtaaaagttatcctcttctagcaaaacagccacttgtcttaacaagctattcaaaaataaatgcataaaacaaaaaactgcttgcgacatatcagaagactttaaatcttcttctgatattgtccaagcaatttttattttgaagtttgcttaattctgttctttagaaacaatgtttgttctttttccggcaaaaagaaagctagataatacgacaagtaaaaagaaagcgatgattccaactgtcaaggctatttgaccgtattctcctagtttcccaagtacaagtcctggtactagataatcagtatcggcaaatgtagaagaagcgattttaagatctcctaatactggaaggataaataatggcagccaactaatcaataagctattgaaagcagaacctaataccgcccctcttctaccgccagtcgagttgccgaagacaccagaagcagctccgcagaagaaatgtcctactaccccaggaatgataactgtagtttgcaagcctatcatagcaaacatggatagtgttcctacaaagaagctaacaaaaaagccaattaatacagcattaggtgcatatggaaaaacgataggaacatctaatgctggtttagaatcgggtacgagttttttagcaatcccttggaatgctggaacgatttctgccaacaccattcgaaccccttgaaggacgataacaaacccagctgtgaatgttccagcttggatcagtgcaaagattacagcgttgtctccattgcttagttctctttcaacaaatccaggaccagctaacaaagcaagtgcgacatatacgatcgacatcaagagcatgatcgatacagtagaatctcgcaaaaagctgaaacttttaggaatctttatgtcctctgtagaacggtctttgtttccaaaaaactttccgatccatccactagaagcataaccgatatttccggtatgccctaacgcaacttgattgtttccagtgatgttcttcataaacggttgacaaagagcaggcgtaatagttaatagtgttccttcgaagaccccgcctaataagatcatccacaaatttgcagtaaaccccgcgcttactaaaatgactgctgttagacaagaaacataaagcattgcttgacctgtaagaaaaatgaatttatatcttgtgaatctagcaagtaaaatattcacgatcatccctactagcatgatcaaagcagtaggtgtaccgtattgttgcaaagcaatcgccactactgcttcattgctaggaactactccttgagtatgcagagctgtttggaacatcgaagcaaaaggggttagtgaattactgattaaaccagcaccgccgatcagtactaggaatccgacaaatgttttgatagttccttggatcacttctgaaaatttcttcttctgaagaacgagaccaagcagtgcaatcaaagaaacgaggatggagggctgactgacgattgacacaaacaaattcaacaatttatccattgatagttcctcccttgaatcatttttattcttttgacaagatcttcgttactttttcttttacttcttcgctgtcaatgatcgattgcaaaggtacgagcttttcatcaggtatagaagttagcgtatctttcaaagaatgctcaatgaagaaataatcagccatatcgctagatacacttccaacatccgtatgacttacttcaaactcgtccacatctgctccaagatctgcaagtgcttgtttgatgttcatctctaccataaaacttgttcctaatccactttgacatactgcaaaaattttcatatcattcgtctccttttcttatgatcgctaatatttcttcttttgttgatgcgtgtaataaatcttgaagattttgtttattagaaagtagctttgttaaatttgccaaagcccgaagatgtgcctcattatcgatagcagctaaacagatgaacaaactaatgggatgggctggattatcaagcagatccacaggttgttgaagtttcagcaaagacatccctacttcgtttacgccatcttctggacgagcatgaggtaatgcgatgtgatcgccaatatggataaacgcaccatactgctccacgcgctcgatcatagctttgatataactttcttctattttattttctgataatagcggctgtgcggcaaatgtgattgcttcttgccagttttttggttgatccgataattggatcatttcttctgttaataattcagatagcataggacgttgatcctccttcttttctaaaagtttgttcattttacgatttaatacttgatagagcttttcttcgtctacgccttcttttaattcgatataaggcagtagcgccgacaacaattcttgggcagaaggcattgaaaatcctggtatcagccaatctctttgtacttgattgatcagctgatttttttccaagtcagtcatgattggatgcagaacatagagagactttttcttatcagtaagtgtgagaggtacagtagaaaaaataatatcgtaagaagtttcgtcaacctcgtgtaagcggtcagctgaattagtctctgtaaaaaagatcatcgggaataattgctgaagttcactttttaagatcaatgaagagctaatgccacttggacagacgatcacggctcttatttttctatttctttcttctgcgtccgcttttctgatctctccgccaaatagtatagtgaaaaaaccaatctcttcttcagggatgctcttccctattcgtctttctaacggaagtaatgcttttcttgtcatttcgtagatggaagcatattgatgcttaatttgatcgatcatcacattaggtaaataaaaagaataggaaatacgaaaataggcagggaccaagtgataaaagacattcatcaataattcacgaaacgaagcaaattctacggccatcaggaattccatgcgatggatgacttctgaagaacattccagcaaaaaatcaagtgcaggctcctggacatctccttcaacgatcgatgctaagcaaagagagaaaaatataatctccgaattttgatgttcggaatagccaaggccagtcaatacttgtcgactaatgtcagtgactgcaagagaagccaacagttcagcatcttttaccagttccatggatgtttttccaattcgaatggttgtcaaactcaaataataagctaattcatccattcgatttggtgcgaatcgaagatctgatagtgaaatcgttttatctagcaaatctctaactttggcgtaataatcaatggaaagggttgcggttaaatacgtgagcccaaatcttccagcaagtgactgcatcaaacgagcagtgcgattttttgcttctcttcttaatattgcttctgaccctagcagcctaaaaccagttttcctagtatacgacagctgacaatcttccacttctaattcatttcttatctttttgatatctgacaggactgtccctttagaaacctgaagaaaatcttgaaaatgaaaaacagaaacagacgttgcagtcgaataaaccatcaaataaagaagatctcttcgctcttgttcggtatacacagcttcaaatcgagtaatatccaaaaatttttctgcccagtcgattgctcggaatttctttatacggatacgggtatcatccacatattcggcaaaaggagttaattgtttgatcgcctcgcttgtatttacttcgatgatctctgctgctttttctagactgatttctcttggtgttttcaggagataactaattttgtagttcacagcgctgttcacctcctacttatattctagtatggtagcgcttttaaatcgaggggtgtttggtacaacttacagttggattttttttacgactgtaccgaacgatttctatcgaatggatacagaaaaaaagcaggtgaccaaatgtctcctgcttttatgaattgatttcgtccgatcaatgatgatcatgtttattttttgaggtcagttcttcaaatttttctttgacatcttcaaccgctttttcgatatctttttcaaagtgattgggctcattaggctttgtttcctcttctacagaatttgaaccagataaagctgtttctttattttctgtttcaccagagtttgtgccagctaatgattcttctttgtcttctgtttcaccagaattagttcctgctaaagccacttcttcttctgttttaggggccattgaacctcttaatcgtttgtgtttttcaccgtcataatttgtcatgttggttcctcctagtagttctatactttttcatcgtacaataagacagtttatgcgtcaaaaaacaaacccgattcttacaaatatgtcatatttttccttctgattcttgaatgcttttgattccttcttccaaaattttcatttgtaagattgtttcttcatctttgatgactttttctgcgccattaactaatgtctcgtaaatcccttcgtagacacggctgtaatcaccaacctcggaaattactttttcttcatgataactcccttgttcatctatataggtcaatacaccataatgttcgggcaaatcgataccaaagtcttcatgatcaggcatgtaaaacattttcagatgttcttcttgtcgatcttttgtttgtttcacgaacatccctttttttccgtaaacgacgaaacttggacgttctttgatgcggaaataactggattttatcgaaattttcatatttccatagaaaaaatccagatcgaagtaatcattcattcgtcctttccctaaaagttgacgtacatcatagctgatatcatctggttcgccgaaataagaaagaacttgatctactgtatgacaagcatgtccatataaatagctgttcgcagtagaaaattcatgcgtattttctggtacttccggtctgaaataatcataatgcatttctacttctaaaatatcccctaattttccgctttcgattactttttggactgtcaagaagtcagaatcgaaccgtctgttttggtaacattggataaatagacctttttcttttgctaatgcaaataactcttctgcttcctttgacgtttctgcaaaaggtttctctactagtacattcttaccatgttcgagtgccatttttccatattcataatgaaattgactaggtgtagtgatgacaactaattggatctcaggatcatcccaaagatcagacagctgatcagtatattcgatgtcttcgaatgttttccacactggttcagatggggaaaaaatttttttgatattgattttgttcgtaagttttcttgaaaaaggcaaatgatagcgatttgtactctttccattgccaagataagcgattgtaagcatgagtggtgcctccttttattgatgttttcagtatatcctagaaaagcgcagaaagtatttataatagctattctggtaaaaaagttcagaaaaacacttgttatcattcggtttggtgaaattaatgttcaaagtaaggataaaaatcaaaaagatagtagcggaaccaagtgtttatcagtaagatagaatttggaggtcagatcatgcttattgaagaaaaactaacaaaacaagagttgtttaccacgacagagaaacggattgtcgattacatccgtaggaatatcgaagctgcagtctacatgacgattgaagaattagcaaaagctacgtatacttcccattcagctatcattcgtttatgcaaaaaaatgggattcagcggatttaaagaattccgtttcgagctggggcgggaagttcatcaattgattgctcagttcaatcaaacgattgatcctaattttcctttttcaagtgaagatagcactcagcaaattgcaaagaaaatggcggatttatcgatccagtcaataaaaaaagcacaattgcagattgaacatgaagatttagatcaaatcggtaaagtattgaacaaggcacagcgaatctttctttttgcaaaaggtgattctcaaatcacggcaaggaaattccagaataaaatggtcaagttgaataagtttttgatcatggctgaagaatacagtgattcttcttggaatgcagccaatttgactagcgaggattgcgccatttttattagctacagcggtcgcatccatcattatgaacgaataatgacctatttgaagcatgtagaggcccctaccttgctgattaccggaaatcagcattcagaaatggccaaacaggctgatatgtgtcttgttatatcgcaggaggaatatgattttgctaaagtagcgactttctcctctcaaattgccttcgattacgtattaaatacgttattctcagtgatatattctcaaaattttgaagagaatatccgcaacttgaaaaacaaacaagaattgatgcaaaaaggccttcttaaagaatatcggaaaacttaagaaaagatcctcatttagtaataagaaagatagtgtttgataggctctctttgatatcatcataaaaacaggctgaagttttctttttcaaacctcagcctgtttgtttacggaacgattcgaatagatatattatagaaatgaggaatagctaacttctgtttcttattttgaacgattgacgaaaaagatatataagaaggaggaaaatcagtatacatgcagctaacaatccatacaggaaaaatcgtttgttctcggatactttctgtacttctttttgaacttcttttgcatgataaggaacccggtgccctctgacaagtaagcgatgactgttgaccatataaggtgtacaagttaggagtgtcacgaaatcctgccctttttcgattctcagatcttttgtatcagtcggttctaccgtcttgatctgatcgacttgataagcgagtgtccgtccattgatttcgatatagaaagaatcacctaaagtcagtttcggtaagtctgtgaacaactttgcttgaggcagtcctcgatggctggaaataacggcatgtgtattttctccccccgtaggataagacgttccttccaataatgaggcacctttttctagcagcacagtattcgtttcatcaaaaattggcaaatggacattgatctcagggatcgtcaaaataccgatcgtatgtttctcaaaataggttctatcctttttcgcaggttcttttttcttagtaaagggatctgcacctggatttccaccttcttttgctaattgctggtttttctttgtcatgttttcttggattttagccatgacttcttcattttctttgaccgcttgttgctgataatgagagatgatctgctgatccagataattattcagcgcgtcgctaacaaatggataagctagtatccctattcctgagagaagcaagaaaagcatcagcagatctagaagtttccttttctttggtttcatttgtgttctccttgtgatgactgtttgataataaaagaaaaaggagcatttgcgtaatccgctgctcctttttccaattcttgcaaaaagactaaatctgactgtgcttgcgtctagcaaagtacagtccagcaatcagtagaaggactactcctgcaccgatatacacatagattcccttaccgcctgttgaaggaagtgtacctttgtgtttatttggtattttttcaggagaaatcaactgtcctgctgttacataagattgttcatcgatagtaaatgctacacggtttgttaatggaacatatttttctggcgctttcgtttcttccagatagtacgtgccatattttagacctgtcacatcgattaaaccgttacttgtggttgtaaaaaccgttgctgattctttcgccgatacccagctgacggcttttgtggatgggtcgatcgataaatatttcgctgtgtcactatcttgatcacgaacgacgaattctgctccagcaagtgtttggtctgatgtaacgtcaccatctactttaacaaatcgtttgcccccagtaacgacatcgactgacggtggtgtttgatcatttgtatgcccgttatcgacatttgcttggttagaaaatcctttggttggatctgctttttcgttcaaatgcatatagtaaacgaatttcaatgtaccgccaggagttaatgaaggaatataattcggatcaactgaaaccgtgaatccgtctgtttgctcagtgacagaataatttactgggtcgatttctttatttccatcatataaggcataagcatacgttcctgaagaatcattatcaaatgttaaagcagcgtcatgagtatcgataagtttgaatgttgtgtacttgttttgcgttccttctttatcagcgatacctaatgggatattgacagaaatctcatattgaattttttcaccgattgcgacatcttttccattcaattgaggtgttgttttatcaactttagacgtatcatttttgatggtcttttctactggtgtttggctatttgccaggatctcaaaaggcgtgattgtttgcttttcaatcatttccgcattatcaggagcttttacttcttctaaattatattttccaacttctaaatgattaacgatcaactggcctttttcaatagatgcctcggcaaagtcattgttgccgatgtcataagaatgaccagtaatgaaatgtttggctttggtttgatcagttgtccaagtgtacaatccatctgtgacactttggatgtattttttgacgcttggtgttccttcttctttagaaataataaattctgctccatttagtgcttcgttttcggcagtaccgatttttgtaactttcaacgttccatcattaccgactgtatttttagggtagagatggatagtatctagttcttctgtcccgtatttataagagccatctgcttgtttgatcatctcatatacagggaaagctaaaaccatgtttgcggcagctgacactccgtcttttggttcttctttgatcgtgtagactgcatctttcccattttgttttttaggtaaagataaagtgacatttccatcagcatctgtcgttcctgaagcaactggtgtaccaggagtcaaagactggactgcttgttttgctgcatccacggacgctcctttatctcgttgcgcataaaattcttgagtgacgttataaactgaaaatgaaatatcggctaatccttggtattgatcgaattcgctcatttctttcccgctgttttggattaaaggatcgggtaaatcagtcattttctttttatgaaggatgacttgagctgctgtctcctctgcaaacactttttttgcgccgaagctgtttgtgagtaatggtaaaataaggaaaaggactcctaacataacgtttatttttttatgatttttcattttttcactcctgttctttttttgataaacaaccagattgcaaagcttgcgaataccataccaacaacgcctaaaagtgtatttttcgtttcgtttgtttttggaagaaatggacggctattttcttttttattgactactttcaatatactgtccgcctctttatcctcagaaagaaaagttgaaatggtaaacggaatttctgtttcacttaaaatataaccagaaggtgcttcgatctcttttaatcgataacttcctgttttcaacccggaaattgaaaaagcgccatttttatcggaaatcaggtgaagcgcatctgattcgttctttgtccacttgtatccgttggctgtttgctggaggtaatttcctgctttgtttttaataaggaatactgcgccagctaatcgtttatctggtttatttgtctcgattttgacaaattgcttactccctgtatatacagagactttctttgtactgacaccaaaaccaaaatccagtgttccgttgttgttgatttccttgttcgcctgtgctgtactgcttagctgcatctgataagaaatggtcagtttttttccagcatatttttccaacgaagggatcgaaaataaaacatcaaatccgtgaggtttcttgtgtatgacaaagccttctgtcagcttttctccattcgatgaaatcgttaaactattaggtaaaaacgttaatgcttcatccgcactatctgacaattcgaacttttgatagtcaaggatatttacaggaattgtcgtatgcaaggaataagtgattttttcaccaatcgtaaaatcatttctaggctcttctaataccttctcaaaaggtggatcagggtagtcgttttcttcatttttaggatacaaatggatagttgaaagtttttgattgttttgtccatgtacaggaagaacaactaccatattctctgccttttctttgacgacttctggtactttggattcaatgaaaagatacgctttatctcttttttcttgatctttagcggccagagaaaaagaagcgataccatcttcgttgttaagagttgtagttgttgcttctgcggtaaacataccggaagacgcaccgttttttgcgatctctgcttgtgcttcttctaccgttttgcccttttcccgtagatggtaaaaagaatctgtgacatcataaacttggaatgtgacaccatttaatcctcgatacgtttgtaataaagctttttcttgtccgtcatttggatgatttttcggcagttgcccgtttgggaaaagcaatttgtgtaaagtaatctgaaccatttctgtttctgtttctgttgctacctgagtaaaagctggtttaaatagtaacaagaagagacacatactaagccaaccaagttttttcatatttagctgccccctctttcttttttcaaaaaaagataccaaatagaaaacgcacaaccaatcatccctactagatagattcctaaacggccaattcctcccgtttcaggtaatggtacttttgcctgattcgtgatgtctaaagaaatctggttgtttttggctcctggtgacagaacagattcatgatcttgtccatccacttgaattgacccatcttcgtgtataactatagtaactggctcttttagaccttggtatccttctggtgtaaaagtttcggtcagcgtataagttccaggttttaaattttcgaatagaaaggtatctgtttcttgtccatcttttggcgattctaagtccatttctggtccctgcagtctgaattttgctccttttaatgtctgtccgttgtcttcttttttgtgtaccgttagatcaaacgcttttagtcgattttgatgagtgagcgtccatacattatttgtcatctcggtattttttcccgtgtaaatgatttttccatatttatcgatttggaattcataatttcccggcgaagtatcatatccggcaggaccagctgtttcaacgactcgatatttaccaggtgtgagtgaatcaaaactggcaagacctttttcattcgttgtttggctgtcaattggctgataagtaccatttgcttcttttttctgtagggaaaatgctgctcctttaagatttatctctttgtccgtcccttgcatcgcatacttacgtactgctacaggaacttcaacaaaaggattttcaatagtcaactggatcgtatcatcggaagtagtgactgtttttccatcaatggttaccgtaccatcagaagcgatcttgatttcccaagtagtctttttgcttaatccatgcccttctggagcttttgtttctgtcagcgtataggtcatttctttttgcaatttgacattttctggaagagaataggttccgtcgccatgatctgttagtaaagtatcaatagaatctcctgttaatttgaaaacagcgccaataagatccttttcacctgtagaggaatttttcgttattttcaagtttaacggtgtgaattgtttagtatttttccatgtcattgcatctatttgttgagaatcgtatcctggtacaggtaattctttgattgtttggtaactgaatgcttgaccttgattattgtattgaggtagtgataatatctcttgataactttctccgctatttgcagataatttgtcaatgtctgcacgttcccacgtatttgttgtatctttagctggtttaatgattcgaatatatccgtttttccaagctgcagcatttgtcgtatgttcccgttgaatctcaaaagtaacttgatctggacgatcagctagattgttgtcaaattcttcccataactttttgatgtgaagactgactccgggagctttagcagatggtataccgaattcagctaattcattggtatcaatgtttggctggaaagttgtcctgccgttcatttgataccagaaatttggatggaagtcctcattttctgtttggattctcacttggtaatggatttggatttcttggtcttttcctaaatagatctgattgctcttgatggtatttccttctatggaaatagatggagtgaccgttgtaggacttgtccccacactcttgactgaaagtgtaccaggctgataaatgaatggttctgcgattggatcatttatttgtccattgcttacagttgctgagatctgtacagcttttttggctaggtattcagagatatctgttgcatgatcagctgattcatagtaaagatcgcctttttcatctgatgaaaccatttgtcgcatacgagactctacttctgcttttgagagaccagctgccggatcgctttgaagttggatgccaagaccatgtatttcgattcctcgttctttgagtgccatcgcttctccgatggttgcgataaacgtactgtcgattcttctggatagattgttttggtcaggtgcatcatagattcttgagattagagaagtatttcccggccgatcttgcgtattagaaaactgagttccgtaataattgctgcttgattgtgcgtgtacccgctgtactttataggaaaatgttggtacaccatccgtcagcaaaacgatcacttttttatgtccatttggaacggatagcatgcttcctgcatctcttagtgctttttgtgtaaaagtaccaccatttgtccgtgaaggtgtaatggattttacttgatttttcactgaatcaaatgaacccatctgtactgcaccgttactgtagctatatccttcgcttgagtagccgacatatcccatattgattttgtctgtgataccgctatctgctaaagtatcgacaaaacgatcgacaccaatctttacttcaccgatccgattattgtcgttcatacttcctgaccagtctacgaccaatacgagatcaagaggcgtgatatctttttgtacatttccacgagcattcaaataaacatcaaacaatccgggtgtacttgtttcctttgcatactttcgtatcgcatagtctgcttgattaccggttcctccatattcgatatacgaatgggtccgatcattaggatctccattccaagaatttataccatcccattgatttgttccgtttttattgccttgatgatcaagaacatttgtatttcctgtaggttgccaactggctttaggataagtgccctgatcatctgttgtatattctgtaggaatcgtttgattagatggcacactcacagctggcaaggataatgtaggcaatgtaaatgggctgacagaattttcgttttcttttgatgattcttcttctatttcgtctggctttggtactgacacatctgtatctttcttattttctgtctcatcaataatgtcatattctttattatcgacgatcagcttgtttgcctggctgtggtaaagtgctggatcgattggaaaactcagatcgatagtttgtttagtgtttgatgagatttccaacgtaattttcccgctatttacctgataagcatagccatctccttcttttctttccacatcacttaagtaattttcgactagaccaatttctttttctatcttttcagcactggtgttattcgcatttagcttgatgttcagtgctttttttccagactgatccgaaatgacttcagctgaaattgtttctaaaactgttggatcatctgtagtgtctgctattgcagataatggcacaaagtttgataaactcaatattatcagcatgaaaataactttcagtttcttccctgtggtcgtcatttttcccctcctttttctttttttctgttttgacgtgaatagtgaaaattattaaaataaacaggcgttacataattttatttattttaatatgataattattatacgaagggcgctaaagggaatcacaccaattttcataccaattggtttcatttatgaagttgattccttcgattaatgagcgtttcattgaaagaaaagggttgagggagaaaaacatatgatcaggttgttggaatgaaactatagaaagatggaaaaaatcattcgaattctgtccatttctgacaagtggatgactaaaaaagaacttgccaaacgaattggtagttcagaatctacatttgtaaggtatatcgaagagatcaaaatccgctggggaacggatgtaacgattcaatcttcacaaaaattggggtatcgtcttgaacatttgaatgtaccagcttatttaaatgttctgatggaaatgtcgcaaagttctacaaacagtcgtttattaaatgagattattgtcaatccgggtaaaacgattgagtattattgtgaaaaaatttccatcagccggtcttcttttacacgtaagttgaaacaatgcaatcaaattttagaaagctatttattaaaagtgatcgttgaccaaggttttcagttaactagccttaaaagtgagctccagttgcgtatctttgttacctttttctttttaagttactacggaagacgcacgttgccatttccaatcgaaaaaaagaagatcaaagaaattatggtcaagaataattgtcagatgaatttgtttcaggaagaaagcccatatgagcaatctttctttattatgtattttgttgtgcatctcatgagagaatcccaaggaactccatttgaatggaaagctggagactcttatgtacagttgataaatatcgataaaaaagacttcttaatcttgaaaaatctcttaggaaaattgaagtacagcagctatataaaagtagtgaactattttgtcaatacgattttttcagaattttcggagaaagaaaaaaatgaaatcagtgagcagatacgaaaaaatatgtcctactgttcgttttcatccgctgattgcaaagaaaaaaacgaagaatatgttgttcaattattaacgcaaatttattttttctcccgtattttcccatacgatacgactcatttgacgatccgtgcaacttactttgcacagcagatgcaacaccgccagatacgtctatatgctggatttcgtgcagaacttcaattttattccactctactgaatcagaatctgatttattatttatctagctatatcttttggatgcttatcggtaatcctgaaattcaccattatacttctgataaaaaaatactgattatcagcgacttaagtcttcgacatagtcaatatattgaagaatatatcagtgatattcttgctgtgcataaaattcactctgagacaactgctattactgaagatcagctgtcgaaatacaatcttctcgagtatgatctgatcgttacgaatcaacccattttgaatgcccatgttcctcatatattgattgatgatagtgtgtcattcgcaaatgaagaagaactcatccgcttattcgagttatgaataatcaaaaaacagctatgtataaaccaccctgataaaaatttcaggacaaatacacatagctgtttctttttattgtattccttcagcaatccaacgagatttatagcgaaagtcttttaacaactcttcttttgtccaattatttgcaatgagatccgtcaaagtgttcattacgagggtcatggaaaagtataggaaactaactgcttcttccgacgattgaatggagaaatgattgattcttaataattccagccatttttcgttcattggagaatcagccgatagttctctacgtttggttgtctgctgatcatttcgctgggttaacaagtataacctttgccaatagatactttcgtgatctaagtcgcagcaccactctaaatatttttcgatccccaaaaagaaatgttgtttgttttcgctaatgaattttaagatatcttgatggactatgtgagaactgcttttgatcgtatacaaataagcatcttccaaatcttgaaaatatttataaaaagcaccgcgcgacatccccatcttgtcaacgatttctgagactttgacttggctgatgtgctgtgagcaaaatatctccagtaataggtcatcgattctctgtttctttgcgttcgataaattgaaaaaagtttcttttggcatccacatctctcctttatctctgattatacgtggatagcccttcattgtcatgaaggattcattccttctttttctcttcttctgtcaagtacccatcttccattcgataaacgcgatcactccattgaatcatacggacatcatgagtaaccataatagtcgctttttgtttctcatgagcttctttaactagtaatttgacgacttcatatgcatgatctgtatccaaactagctgttggttcgtctgctaagatcaagcttggctcattatataaagcgcgagcaattgccactctctgtctttctccaccagaaaggtctttaggataactatttttaagtgactggatatctaaagattgcagcaaggaatcgatttttgttgaatcttctttttttgaagtaacttggtcaactagttcaaattgttcctttaccgttaaaaaaggaatcaaattagagctttggagaataaatcctatttctttaaagcgtaaatctgctcgttttttttctggaagctcagttagtgagtgaccgttgatcactatttctccggaagtcggtgtttgcaatcctcctgaaatggtaaggaaagtacttttacctgaaccagaaggaccaatgatgctgacgaattctccttcctttacataaaaatcaattgctttcaaagctgagacctttgtatgaccagaaccaaatgttttggtaacttttttcatcgttaatatttttttcatttttattaacctcctattgctgtaattgggtctactttggttatcgtacgtatcgaaaacaatccgcctagcattgcgacaatgatcaaaatcccactatatagcaaccattgtgaccaaaaaacagcaaaaggcatcgcgcttggtaaaatcagactagtcaaataagcaaacaaaagagcaagcagaacgcctaccaccccaacaataaaggactgtgctactaaagatttagcgatgaagaaatttttgatcccttgtgctttcattactccaaaaatagcagtcttctgaagtgtcatcacgtacatgaaaataccgaccacggcagcaaccactaagaacaaaaagtatatcatcgcatttaaggtcatattttgggcagaatagccaggaatactttcaatgaatgtcccaatagttaataactgtagacccttcgatgctttttctttcgaaattttagctgaatcctttattacgatcccattgatcggctgttcttcttcagaagcaaacggctgttgtccatacttcaaagcagtccacgtatctagggacgcatagatgacgggagaaactgtgtaataagtttcaggaaagataccgacaatcgtcaaaggatcgtcgtaactgccaattttgatcgtatctccaattttatagcctgaatcagccagattttgagagatgatgatttcattctttgttttaaattcatgccctttcgtgagttttggtaataaaaatgcttctttcgttgtgccgaaaactgtaacattttctttgttttttcctttgattgctccgctgtacaatccgattggtgctttctctcctccttcaatgtatttcagatctcctcttgttaattgtgaagctgcaaatacttgatttgcatcctccgacaaaacaatctcttgtgcgtcccaatcatcgattgcttttttaaactcttctgaaagtccattcgctagtcctgacaacatgaatacgacatacgcaatcaagaacataataccgacgatcaagccatatcgtaatttagaatagcgaatttctttgatagctagaaacatttgtttttcctccctatgatagattgatagtgacaaaatgtcacttgttgaatagtgtaactctaaagtgacaatttgtcacttgtgttgtttttttcttatcaataaattgtctaagacatctttcgataaaaccttaacatgagtcataaaaaatttatttaagccttatttatgctttccatgataaactaaagtgaccaaatcaatgaggtgggaaaatgattaaactattagtagtagaagacgataaagtattatccaataatataaaagaaatactcgctgcaatcggcgagataacacaagtttatgatggtagtgaaggactgttcgagttggaaagtggagtttatgatcttgcaatcttggatttgatgatgccggaaatgaatggatatgaagtgttagcaaaaatacggaaagaaaaaatacagactccagtattgattttgactgcaaaagatagtttggaagataagattgaaggatttgaacgaggtgcagatgattatctaacaaaacctttctatcgagaagaactgatcatgcgcgtgaaagcattattgaaacgctcgctaggtctctttgatgaaaatgttctgaagtataaggatatcagttgtgatttaaaaagcaatgaagtcttgtataaagaacaagttttgcccatacaaggaaaagagtttgaattgctcgtttattttttacaaaataagggaatcattttgacaaaagagcagatatttgaccggatctggggatttgattctgatacgacgattacagttattgaagtttatatgagcaacttacgaaaacatctgcgaagtactggattggataaagaaatcaaaaccttacgtaatgtcggttatatactgcaaagggtgtgatgcaatgaatggagatattacacgaaagcaacgtagtcgcttttttgcgacaaatgtagcagcatttgcttttatcttttttcttttgggattcattactttacagatattaaaccaatctgcatacagagaaacagatctgtcattagagaaaataaattttgattctcgaacagtacaattagagatacaaagatatcagcaaggcgatccctttttaaacccgactcaaacggaacaaaacagaacaaacatggaacagccattaatggaaccatcaaatgaccgttttaacactcaagtgatcttgtggtctaaaaatggtgagatattgaataaagcagctattggtgggcgtttcaaccaaatcaaagaattaaaaatggatacgaaaaatctgaataccatccaaaatattgaattaaatgaagacagtggctcatctgccctctctttccgttcgattacgaaaaaagcggagacgaatcaagatggcgttgcctacatccaaattttagaaaatacaaatcaaatcaagaattcattagcgacttttcgcacgattatgattttgtgtatgattgttttttggattctctctattggtatcagttattacttgtctagtctaagcatgcgccctattattctttcttggagaagacaaaaagaatttgttgagaatgcttctcatgaattgcgcacaccgttaacgattattcaaaatagtttggaacatctttttaccaagcctaatcatactattattgaagaatccgaaagcatcgctcaagcattgtcagagacgaggcgcctcactggattgacttcggatttgctgacaatcgctcggaatgattctgatcagcagctgctttcaaagcaaatgatcaatacacaagaatatatcgaacaacttgttaaaccatttcaagagatggccatcatagatggaaaagagtttattctccataacgatgcaacattagaagtaccaattgatgaaaaaaaaatccatcaagttttggttattttgctggataatgcattaaaatatacgaatccagaagataagatcattttggattcatctgttaaccataaagaatggctgattcacgtaaagaatactggcccttctatcagtgaagaagatcaagcaaggatttttgatcgattttatcgggaagatcaatctcgggcgaaagagactggcggatacgggcttggcttggcaattgcaaaacaggtaatcgaacagcatcatggacagatttctgtatccaattatcttccacaaggagtcgattttaaagtccaattgccgttgaagcctaaaaaataatgcttatccctaaaaaagggctgtgacaaaaatcttgtcacagcccttttttgttgcgaataaacggtgttccagaagtagcttcttcggaaataagccgaaatttctttaagctgaccacttctgtcacaacctctttagcttacgcttacgattttttattgcggtcttcaatgtgtacatcaccgcttgtgtcaatatccaattcttctcggctaacatcttctgtcactttttcaacatcttcatgttcttctttatgaatcccaacttcttcacgaataactgtatgtttgcttacatctacttgctcttctttgattgggatagtaatcgtgtcatcttccaatttttcgtctgttccctgtgaagattgatctgttactggtttgcgttcgatgacgatttcttcacgtttgaccggtacttctaccgtttcagtatcgttgaccacatgtttgtggatgtcgacttctccagttgtcacatcatgtgtatttacatctaatttttcttcttttagttgaattgtatcatcatctagatttggtttgcgatcgatgtcttcagtcttgcttgtacccattgtatcagtctcgccaggtacgtccatcggatcagttcctggtgtcatattcaatggatccgttgtattttgaaagcctgtcgtgccacctacgtccattggatctgttccagtgccagtttctaatccagtccccattgtgcttgctgggctaacagtatcttgtgtatccattgtatcttctgttgtttctggctgacgatagccttttactgtgatgacaaattttccatcagaaatatctcctctatattgatataaaggatcattttctggtgtagccgtctcagaatcataggtatcaaaagaaaaagtatcttttattttttcccataaagaacggtcttcttcaccatccatccgattttcatctgtttcaacatctataccagacaatccgtcaaatcctagtctagatgctgcttcatcagtagtataaataacgatatcatctcgttcatacccttcgttacgcaaccgttcaattactgataatgcttcttccctcgtactatagcttccgatgaccgttaaatttttctcttccatgtaaattcctcctagcaaatagatttatgattggtatattgttacttataaatttattctataggagacgattgttttctacaaatatttagattggaatttgattaaaacaatttaattgaaatttgaaaacatttatgttaatgaaagtcatattctaataaaatgtcatttgtttctatatgaatttttatgaaaaatttcatataatttccactcgttgtgatggtttaatttatccaatccatcaataagcaaacaacttatataaaaaaggattaattctcaatataattgctcctaccatagaataaatcttcatgtaaagtaatgaagtaccaactatttctaatacttctttaagaattatcccaacaatatcgttagacaaaccattattgaataaatggagagccaatcgattctgaaaaaatgttttctaatttttcggaaataaaagaaagagcctcctgccattagaacgaaccaaatccatttcattgctcatgaagtaaccacatagctaaaaagaggataaatcaattaaaagatcaaaagaatgactgcactaataaaataactaaaaatgtatcttcttacttcatatcttttagctagtacttagttaaaaatttgcttcctaagatcaagacaaactgtctatcttcatttgatgaaatgcggtaaaatatagaaaatgaacactattggagggaatttgtaatggacagcaaaactagaaaacaactgcaagaaaagttaaagcaacgtacacacttgctcccttccgtctttcaacagtttttagaagaaaatcgttcttccctttcattaggcagtcgctatgaatacgcaaaagattttcatctgtttactgattatttgagaaaagtattttctgaagaagtggatgatcagctgattatccatttagaaaaacaagattatcagaatttcttagctaaaatctatcgacatactcgttcgttccaaactacagcgaaccaagaaacggagcaattgtttgaaaatagctattacgggatttcaaggaagcaatattcattaaatcattttttacgatttttgtatcaaaaaggactgattgaagaagagatttctcttttgggtacaagtttaccggaaacaaccaaagcagctccgcgatatatcgatgcagaacttttcaaagattttgagcatttgtttatcccgattgaaggctttcaaacaagcagagaagctagctttgaagaaaagaatagaccgaggaaccttgcaattactgccattcttctgtattgcggattaaagatccatgaagtagtagaacttaaacgtaaagatgtatctttgaccaagcagattcttaatctgaatagaaaagaaaacagactgaataaagtaccaataccaaaagaagcgatgccatttctggagaactattttaagttaacagcacaaaatacggacgaaaattcttttgtttttcgttcctcacatgatcagcaaatttctcctcggactattcgccaaattttgagcaaaattacagtatataaaaacgtatcgccagaactatgcagaaaaacatatcgttattatgcagaactatatttagatgatgctgacgcggtaaattatttatgtggtaatcgatacctctcatcccattcttttcaagatatctgggaaaagatggttgatttttcttatcacgaattagcggcattcgttcgggtttcttccatataaaacaaatgtatgatctttttttcacaataaactatgttattatataaaggattatgttacgattatcttgaatttgtatattacttaacaaaagataatggagtgtgaatgatggagaccataacgtattcccctttgaacttatttacgaattttcaagaagctgcagctaacttttccgagaccccgattatctttgatgagccactttcagctttcccagaattaggacttgaaacaacttacaaaaaatgctgcgaaagtgtgttgaaacgggcttatcaattggctcatcttggagtgaaatccggagacaaagttattatttataagagttccgcttttgacacataccttctagctgtttctgtgtcttaccttggtgcagtgcctgtcatgacttcttatcatctaccaacaacaacaatggaagtatttatcgatcgtttagaagaccctttcattttatttgatgatgagacaaaaaagcgagtgagagaaatttcaaatggaacaaaatcaaaacagattcctattctttatttaatggaacaacctgctttgtctgtttctcaatcatttttagacaaaaatgaaatttcttatatgacccatacttctggtacaactggtatccctaaacttatttgtcattctgctcattctatgggatggcggacgaaatggcaaaaaacagttttcacaaaaatttcggaaaagaaattaatcgcttttcacatctctccagtgcattccagattcaatattggtatctcttctttgatgtccatgggatttcctatgatgcctttagcaaacgcacaaagttcaaaagttgttcatatgttggaagctcaccggccaattgcactagagacccatccgaataactttgttcagtggcgttttactgctaaggagcatccagaagctttttcgggtatccgatactatcactccacttttgatgctataaacaaccagacaatgaagacatttttgcgaacgtcgatggcacaggatgcggtatttcttcaagtatatggccaaagtgaatgcggaccaatgattcttaaggctcatacactagagagtttgaaaacaagtgatgcaagagatatgggcgttggactggaagacatgacaagcgctcggattacagattcagttgggaatgtcctacctgaaaacacagatggtcatatacaattactgtctaaaggacgggctttgacttattacaaggaagatgcacggttccaggaaaatgtttatggcgattggtgggatagcggagattacggttttatggataagcatggccacctatttttgaaagatcggcaagtggatttgatcgaaacgatcaatagtacattagctattgaagactttttattagattcgttagattttttggcagaagtagtgattgtaagggataaaaatcattctccacaaccgattattgctttagctcctgataaagaaatggattggaatcgatggtgggagcaagtccatgaacttcctcgcttgaacgtccctatcatccgtgattttgatgcaatcccgcgaacagctacaatgaaagtgcaacggcttcaaatcgagaaagaattaaaatcacaaaagtcctaactatttaaggaaagaaagatccattttggtctttcttttctttttgtttttttaaattggatgagataaaaatatgccaattggctgtttttcttttttgaaaatttcgttatactcttattcatggaggaaaatgttatgaaaagaatcttgacaattggcggttctgatccatttgctggtggaggaatccaaacagatttaaaaacttttgagaattttggtctattcggactaagcgccttgacttctataggggcactagatattaatgagcgatttatgctggaatctatatctttggaattgcttaaacgacagttagtttcgattgataaaatgacttcattagatggtatcaaaattgggttattgaattcaagtgaagcaatcatggttgttcgagacttcataaaaacaaaacaaaatatcccaatcattttagaccctgttttggcattcaaagaaactgaagctgtgatcaatcaattgtatatttcgcagctcatcgaagaactttttccacttgttacgatgattacgcctaatttggcagaagctgctttactttctggtcaagctcttccctcttcgttaacagaaatgatccatctcgctaaagaactcactgcttcaggaacaaaaaacattgtgatcaaaggcggcacaaggatggctggagatgaagctgtggatcttctctattcaattgatcattatgaggtattttctcataaaaaaatcgacactacaacagtaaacggggccggttgtgccttttcttctgcaataacagcgaatcttgtgttaggggcagattttaccaaagcagtagcagaaagtaaaaaatttgttgcccattgtatttctaatggcgtgctgatgaacgatcataccggaagtgtctggtctggcggtattcaaaaaggaggaatgagaaatgaaaactaagcaattaacgatctatgctatgctgattgcgttgacagttgccctttcattaacaattttgatccctgtaccggctacgaatggatttgtgacattatgcgaggccgggatctataccgctgcttttctttatggtccaacgggtggattagttgttggtgcttccagtggtctattgatcgatttgatttcaggatatccgcagtgggcagttttttcattagtgatccacgggttacaaggatatgttgctggttctttcagcaaatcttctactcgtatgtggggattagggcttttattaggaagcttagttatgatcatcggctatggtatcgccggttggattttatatgattggccggctggagtggcttctataccaggaaacatcttccaaaatctgattggaatgggacttgcctttcctataactgcaagtcttcaacgtattcaagcacggaagcaatattaattgaaaaagaaggttttagaaaatgaagttgtcagaaaaagaattaaaagaccaattgactgaaatagttaatgacatattggctgaggcacacttgaaaaaaggtgatctttttgttttaggatgcagcacaagcgaagtcgttggaggacatattggaaaaaattccagtgcggaagttggtcaatggatcatccgtacgttaaaagagttgttggatcctaaagaaattgcgctagctgtccaaggttgtgaacatttgaaccgagcattagtagtagaacgaacagtggcagaagcaaaaaatttcgaaattgtctctgttgttcctgcactacatgctggaggtgcttgttctgttgctgcttttgaccagttcaatgatcctgtcgaagtggaacacgtagttggacaagccggtatcgatatcggtgacacatcaatcggtatgcatatcaaacatgtccaagtacctgtcagacctcgtttgaaaacccttggacaagctcacgtgacagcccttcgctctcgtcctaaatatatcggtggtcctagagcgaattattgaaatgagtaattgacagagcaatctgaaaaacttcctcgcaaagtccaactaatgaactttaacgaggaagttttacttgtttgttttatataaccgagcttcataaggtgctagtatgcctttagcttcaaattctccgctagaggaatttgacaagagtaatgtccaggactgatctgcttcttttggaagttcatagtcagcaagtgattctgttaagtttaccataataagatattgttcatcttctaaatatctttcatagacataaagttgtggatgttcatgaagatattctttataagaaccgtatatcagacctttattggtttgtctaatgcggatcatgttcttatagaattgcaggaccgactctggttcatattcttgttgttctacattgatcgttttggtatttggattagtgatcagccaaggttcatgtgtagaaaaaccagcatattgttccgaagtccattgcatgggtgtcctgctgttgtctctcgttgtttcacgaatgatatccaatgcttcttctcttgtcttaccttccgcaagcagccttttataaagtcttttcgaatctactgcatcaacttgatcgatcgattcaaagggcatattcgtcattccgatttcctgtccttgataaataaatggcgtaccttgcaaaaagaaatacatcatagcgattgcttttgcagacatagcccaaaaatcgggacgagtatctccaaacactgaaacggcacgaggaacatcatggttttccatatataaagcgttccatccgataccatccaatgaagtttgccaagcgcttaatgcaagtttcaatttaaggacatctaattgcccttctttttcttgctgccagatatggatatgatcaaattcgaatatcatatcgaaataaccgtctttccctacccattgtggtccttcttctgcagtgacaccacttgcttctccgacagtcatgatatcgtactcttcaaaaacatgtttcaaatcggtcaaatgttcttcgattcctgagacattttgaaagggtgagaaagggttctctgtggcttttactgaatattcatctttttttacatgagaaatcgcatctaaacgaaatccatctatccctttatccaaccaccatcggatcatattgaatagttcttctttcaatttctcgctttcccaatttaagtctggttgttcttttgcaaaaacatgcagataatactgtccagtttcatgagaatactcccaagcagaaccgccgaaaatcgatgtccaattattcggttctttgccatctaccccgtcgacccaaatgtaataatcgcgatacgggctttctttagattttttcgattcttcaaaccattgatgctgatccgaactatggttgatgacaagatccataatcactttgatccctaattcatgtgcttcttttagcaataaatcaaaatcttccatcgttccgaatctctcttctatatcttgatagtcacttacgtcataaccattatcgacaaatggagattgatagatcggattgatccagataaagccgataccaagatctttcaaataattaagtttttcacggatcccattgatgtctccttgaccatcgccattgctatctttgaaactagcaggatagatttgatagcctactgcttctttccaccatttttgttcttgtatcatatcgtttcactcctttaacggtccctcttgattataaccgattctattttagaagtatccttgttaccggtaactagaaacgaaaagctcaacgaatctgctaagtgcgttcgttgagctttattttatcatagatagcgggcaatcagttgaatcatttgcttgggaaattcattcaagtcagtaatatctacaaaacgactttcaccgtagatcgacttgatttcttctttgtcttggccaatagctgcggagacaaataggattccttgacgttcatattctttcaaaacagactggatatcttcttttgcttttttgcctgtataatccggcaacgcttttggctgaccgtcactaatattaagcaacagtttggttgttgcggattgtctgtttaatttttctgctgctaaacgaagtgcagcaccatcacgattgttttgccttggtttcatagtgactaatttttcatttaaccattgaaatccgtcttcaaattctttataagaaaacaaagaagtcttttctcttgacgaacggtctgctgtatctccgtaaatcaacaatgggatatcgactttcttagaaaattcggcaatggcaatcgctgctttttttgccgcttcgatccgatcatcccgtatcattgacccagattcatcgatccgtacagctaccgctaaagaaggttgctcatgtggcgggttctttttgtcaaaatttctcaaatcaccatatgctactttgcttgcattgaaccgctgaccttcgtattttcctttttggtacgtctctgtttgttcattatccagtaactctaaaatttgccggctaagtgattctactattggcattacttgcatgtgtagctcacgtgcttccggcgtttttccttggaaagctggtcggtgaacgatgagaccttctttttcatgaatcgtttccttcatgatttgtcgcgcttctttattcagttgcttcttgatttccttatcatgtgcttccatgtcagaagcagacatttcttgagaatcatctcctgtttgttgttctttttgattttttccttcgatatcgctactgcgttctttttgcatttgaggaggaatctcgtttttttctattgtttcttcttgtttctcttctccctcatttggttcttcagcagacaacgatttcttttcatctaagcgcagaatttcttcagcattttcagtgatgtttcgttcatttgcttcttcggcgctaatggttcttccttttgtatgctcagattgaggatgaccccatttttcttttctcaatatgtcctgaagttccagtagcaatccactgtcagacaaagcttgttcaagaattgccaattcatctgaatcagtggataatttatacaaaacttttggataaatcgactggagtaaatcttgtccttgcttataggtatttgcccaataaaaataagaacgcattcctgctacacctttgatggcgttagcttttgcagtttcatccaacaaacggataatctctgccatctttaagagaagttcttgtttttggatcatagttttcgccatcgcacgttctgccatgacttctaaggcaggaagatccattttttccgcatgttgcatccgatctcttaaagattcatttaatgggcgatttccttggtaatttcgatttgtagtgatcacaatgacgcaatctggatggcgacgaatgattcctgtcggtaaattcaacatcccatttggttcgagcgctgagttaagtgccacaagaacagaggcatctcggatgacagtcggctcttgaatctctaataaatatcctttttcaatcgctcgaacgatttcagaagggtaatagctgtaatggattgcatctggataatcagcttcgatcctttgaactagctctgctaatttttctttagcagaaaaaggatcaatgccgtaatggttctggatcagtgtcagtacagcttcaagtgtatctgtttggtaaatagcttctagtaattcttggtcttgttccttattagaatctactacaggtaataaggctccgaaaacatctgatttgtccatatctgcaaaacaggtcacttttgtatagggaagttgcagatcagcagatagtgctttggctaattgtgtcttccccgacccggcatctccttccaaaagtacgttactgattttcatttcaggatcttgccaattccctttgatttcggaggcgatccgccattcttctgcacttgtccgatggcttttcggtttcttccagatcatttgcttttctagccgtgaaaaggttcggttttctgttagtgagaaattctccatgcttctcttccccttttgatcatctctgtctattaatatcctagctcatctaaaagacgttttaaaatacggaatcgttccccaatcagttctccgtctttttgtagtgtatcgtaatacaaaatgatgtcttcatcgatctttggatttttggtatctacttctaccgtcattcggttcccttgtaatccaatgatgtctacgactggattttctggatcataaaatttttcataacgataagcatcttggaagtataaacttccttgtgcagctaagatcgctaaatctaaaatacgtgtgattggtaattcttccgactgtcgtgaccatttttctccagtatgtcgccataccttgcctgagatatcgacttttccacgatcattccactgagcaaggcccagtgaaagcccttttgcatccgtatttaatgcatttcttccatcaactttatcatagtcttctacaacgattactggtttatgttttaaatttgttggtatttccattattttaactcctcatccttttatttttagtaaataagtaaattagtagtttactcatttactaaactatatgcgacattatagaggattgaagtgaggattgcaaagaaaaagagcttcattgatagaaataaaaacaccatctcgttcttttacacgctcattagtaacatgtagaaagtccaagatgatgttggaatatttttggtatgttttttgaataaaaggaattattgcgctgaaatggcaatgccgatggctttttcacctaaatgtgtaccaatgactggtccgaaatgaccaatttcgatttctgcatttggatattttttctgcaatttctctttctccgcaatcgctacttctaaattatttgcatgtatcacgtaaagtttgactggcggttgtatttcgttatttcttctaccaataatttcttcagctcgagcaaatgcttttttacttgaacggattttttcgaataaaacaattttcccttcagaaaatgtcaggatcggtttgatttttaataagctgccaatcagcgctgcaccatttgtcaaacgtcctcctcgtactaaattgttcaaatcatctacaatcagataagcgtaggtattatctcggattcgatcgatatgtgcaagtatttcatcaagggactgaccttcatcatttaagtctaaggcagcttctaccatgtgtcccatcggcatactagtgatcttagagtcataaggaatgaccgttactccgctgatgtcatctttcatcgcaaataatgtgttgacaaagccagaaatccctgaagaaagatggatacttaaaatcgtgtcataccctttctctttcaattcctcatataaacccaaaacttcccctacgacaggttgtgaagtagtaggaaaatctttactgttttttaaaagtccataatattcatccgcttcgatatcgattccttcgttataaattttcccatccataatcaaagggattggaataacgaataagtcgggatggttcttgatacgttccggcagatatgccgaactatctgtaactactgcaagtttcatgtgtttaatttcctcgtttcaaagaatttttccagaccttataactatatcataagtaagattagatatgaaactaaaattggaaaatagaaaaacgacaagcgtaatcatacgagttgccgtttttcaagtgacagcaaaaaacgattagttaacctattctttgcttctgctatgatgtttaacatttttcaacattcgaaacccattttttccgaattgagaaaataaaaatactaagccgccaatacttcctacagccacacaataaatcattgcatagctttttgattccattgacaatcgctgattcagcaaaaagaaaacggcaaaacatactgcaagcataatcagggtggagcggaaagtttttaagaaaaaattgctgatctttgctaaaggtgctattcggtattctttgcacataaagtgatagccgcgaacaaagacaataccgaatgctaagccatttgataagctcatcccgtatccgccaactaatcctaatccgattacttggaagatgactttcaggataattgcttctacagttaatcggatcgcaaaacgatggtgattcaaagattgaagcatcgtagataggatcgtgaataaagagaaaaacaaagaagctagcaaagccatttggaaatatccgacactttcaggatcatagccaaaaaacaatgtgtatagtggtccagctaataaagacattccagtcaatgaaggaagaagaatcaataacgcaatcgagaaactatctcctactgttttttcgatttgtatccgatcttttttcttcatcgtgcttaatattggcaagctgcttatagctactgttcctaccatggagatcaggatcaatgtcaatttatttggattgacagaagcacggctgaataagaattccagttgctgatctgcgatctctggacggaaaaagtgaagcagtggtttcatcgttacttggtcgatcatttgaacgatagtaatgactgagccgacaaaaataaacggtagtgtttcccgaatgatagagacagaggcagatcggttttctctttcgaaataacggctggaaatcaaaaaatctttaagttcgaagaagtcttttctgcgtccgacgatatacatatggataatcgcagctaacccaccgaagaaagaagcgactgtactgatcaatacagcttctaatatggttccgtcagtcaatacgcgcaagtaataagtaccagccaagataacgatcactcgcacagcctgttcgataatcaaagaagttccataaggccgcagatcattttttccttggaaatatcctctcattgcactaagaattgggatagcaatcaaagatgggcataaacttctgatagctagtatcccattattaacgttagcaatcggactgattccggctagtaaaggagcaaataaatacatcagtgcagcagaggcgataccgatgacaaacatgatattgatcgtacttctaaaaatcagccgacaagcagcgttatctccttcttttgtggctacagctactttttttgcaatcgcatttggaaatccgactgtaccaagcatcaggaacaatccataaggaagatagccaacattatacaatgtcgtagcaagcataccatcttgattgttccccatcatacttagccagggaatcaaatagactacccctaaaactttacatagaagattagcaaaggttagccaaaatgttccttgcatcaattttttattcatttaaattccctcaactattctttcataaaataaacatcttccctattatagcaaaaaatcatagaaggacaaatccctctctaattcctaaaataaaaaagagcttgcatcataagccaacactaatcttttttatccctacgaataaacttgcatccagaattgactgttgcaaatgcagttcggatagatcagtttgaacaacttatgtcgcaatctctgtttttaataaaataaaacagtttaaagcatagacagcaaaaagacagacgcaagtcctgtcaaaactgacaacgccatcgaacgtgttttgtaagccacgcctgctactagaatcattgcagctattttgatattccaagcaatatccagatgttcatgagtaatgaaaacatctttaaaagctaacgccgcaaataatgccaccggtacatatttcatccagtcactgaaccaggatggcacttttcgatgagtaaaataaagcatcgggaacaagcgcgggatatatgccacgatgaacagacaagcaactaaaagtagcaaatatagtttagtcatggtgattggcctcctgttccgggaagttgaagagcggctcattgacatctttaccgcggtctcttagtttcttagctttttcttttttgaatgccttctccagcataaatccggcaaatgaagcaatgactgttgctgcaatcaatccgaaagtattttggaataataccatgaatacgacccctaatacgcctgagaataaacctgtaaagatcagtagtgcgcttttcatctgcatgataaacatgaaaatgaacatggccgtcaaagcaaaatggacaaggtcagcatctactcgaatcaccgagccgaaaaaattaccgatcatattgctaccggcccatgcagtcattgagaaccaattgacatataaagcctttcttttattccaggaagggtcagttgaaaactttaagtagttcaccgcatagttttcatcattcagtgattgagaaaagacagccaaaaacgtccgcttttcttttttcataaaaccggcaagacttgctcctaataatgtatagcgtaattctaaaaagaaaaccatcaataatgtcgttgcaaatgatgcttgcgtcgtaagcatagatgcaactaaaaactgcgcgccaccggaaaagaccagaatcgataacagtcctgataagagaggatcaaatccaactttttgcaacaatactccgcaagctaatcctactggtatatagcttatacaaagtggcatcactgcatgcaaagcttgaagccatggcgcacttttctttttgttcattaaaatatctcctttaattacaacaaataaacagcggactcattgtaacataaattcgctaaattgtagccgttttatttaaaaacaagattatatttttctcatttttgcttcaattcatgaataaacgttttatttacgagaataatttgggtcatatttatctgtttcaatgtatatatacatcttcttgtcaggaagagactgacgcatatttttttcaatatcattgatgaccgagtaagcttcattctctttgttaccaacgatatctgcttttgctgcaactaaaatctccgttggacttaaatgaactgtttttatatcgatcagccgactgatctcaggacgttcaaaagctaacttgatttttgataaatcgcttgctgtcacgctttcaccgatgatcagactataaaattcttttgctaggaaaatggcggctcccatcagcaagaaaccgatcagcaatccgctgatcgcatcaaatgcagcaatcccggttgcataagtcaatattgttcctgctaaagccaagaccaaaccgattacagcacacaagtcttccgtaaaaataatcagtatttcactgtgtcgactttcgcgcaaaaagcgcatcgtggaaagtttttcagtattcaattctttgatttctttcattgccacgcgtaacgaacttccttcgattaccaaaccaaataacagtattgctataacaatgatcggattacccacttcatgggatggatgcgtcaacttttcaaaagcttccatcaccccaagtgccccaccgccgaagaaaagcatcattgcgacgattgtactgaaaaagtattttgctcgtccttcaccaaattgatgcaactcgctctgtcctttattggcttgtttatcaccgaataacagcaaaatctgattgctgcaatcaacgatactgtggatgctttcgtttagcatggcggcactgccactgattgcatagccgacaaatttgctgatagcaactagaatattagcccctagagcagcaattacggaaaacattccgctttttttaaaattttccatgttattttccttctttcatcaactgaactcactgaattatggcaatattcgccctttaacagttttttatgaaacttatagtttagacaaattgaaaatgaccgattgtccatcattcaatttgatctctttggcaccagtagtagcacttttcccgtccacagtaaacatccaatagagttgatttttctcatcctgtgagtgcccttcaagcgaagtgatgaagccgttatcttctttgacttcaaaatttcgtttcaaaatactcagtaaatcatcgccttttttgaagaacacttctttttccgaaaagttttgaccattttcttgtaacgtgattgttgctttttgcgatgtttttacttcctccttttggttggaagccgattgtgtataggttgtactgcaacttgtcaaaatgagtatactgacactcattgcaagcaaactataaattatttttttcattttttcctcctgaatgattgtaaaaacgtttgacgactggcagaaaaacaagaaagaacacaacattgcctatactgtgcatcaaatcaaacgacaccccttgaaggtaatagatccaaggttgaggcaaacgatataacagcgtatcaaaaacggtcatacctattccgtaaaccatgcccgccagaaaaaaacagactccctttaaccatagagtcctttgcactgtttttctcaagcagacgattgaaaacaaactcagaacaacagtatagctgatccattggccgatgacccatggtccaacaccaaaataaaaactgctgatcgcaatagaaagactcatgacaattaacgcatcttttaagcttaagtaaagtactataaataaaaaaatagcagtcattggctggaaattcggaataaattgaaaagcgatcctacctgctacacaagcagcagacaataagctaagctgtgctattttatttgtggacattcctaatgaaatccctccttcatcagcaagttattcacgtccatttagtacatacagaaaagacttgtgacaattattctggataactgccgcaagtcctttggaacagaattatctgaatgacatctggtaatccaacttatccaatcaggactttctcaccattaatgggaccaagaattcgtaattgataaagaaatcaatgacagatcgtgggtagtctccagatgagatcgacaagactgtttgatctttttcgtttgttgttatcgttaaagactgtcctttatctaatcgtacttgataagtagtttcgttgatcttttccatatcgtaggatggatttttcattgccacgataaaaatatcatccaatacttcattcgtcaattcaaattcgctctgaagattcaaacgaagtggcttcgtattgtctagtaatgtctgattaacggtaaaaccaagtgttcttgcatgggctaataattgattcaatttgtgattgaatatcgtgatctgccctgcagagaatactcgatccactgaccagtgtcggatcaaagaaagcacccggtcatcttggacattgatttccattgtctctggtgatacgtttaggagactcatcgattccacttggtatcgttgatcgatggtcggtaatacaaaggaaaagactaattcgttttgtccattcaacgtataattgatcgaaaaatgtcttgttttccatgtgtcataagctgaatttgaccgttccagaccaatatcattcaacggtttcagtaattcatacgtgaagtattcgatcaggcttgtctttccgatcgtggagattggttcttcattcaatataaaacgatcatatgattctaataattgtggaaaatctgattcgatcaaatcttttctcatacgtaaatccgctaattctgcttccgctgtttcaatcaaactgacgatatcttgatgatcttgctcttttccttctaaatacccgggattttcagttatttcgtaagcatgggtgttttctgcagtattcgtattcgtcggagttactttttctttttcgtgtattttgtttcctctagcatagggatttcttctgtgtcatccagaggattacttgtttgttcttccaatgaagtgttcgtttcttcatgatcttctgtttgttcttcattttttgtccattctgcttcatcgtgttcattcatactcggaacctccttcattagattgattattaggattctcattgccaagataattcatcaagaattcatggattgcttgaccgaatccctctttgctaccgaaatagcgtctgatttgcctttgttctttttctacgatggctgcacgaagctggtctgctcttgcttcttgcttcaatgcttctttttgctgctggattgtttcaggcgtctcaatataaggaagccagcctaatttttcattagatagtacttgcttcttcttctctaattcttgaatttcttcctcgatttttttacgattcaagaatcctttattgtcgttcaaatcagtcatttgtcgattgatttcttttatttgttcatctaaacgttcaatttctgtctgagcagtgatcacctttgcgtctagctcattgatttttttgtcatagtccgttgactccggttgggaatatttctcccactcttcatcgatcttaggcaaaacaaaaatttctggcagacttgcatcaataccgaccgtgggccgatcatggtaataagtgccgattttgtaatagctcatcgttggcgagatgttttctacttgttccataaaaggaaattcctgtaaaaaacgatcatggatcttacgcatcagcaattgatcgatctcgtgattttcatttgagcttctttttaattcttcattcaatcggccattgtataaacggtagatctcagggatatcttcttcgcggacagctttttcaaaagcctgtaagtcttctaataattgggaaagattcatgcttgctttttctttgatatcgtaaaaagaagacgattcttgtcctgtatcctgatccgcattcgtctcctctagttcgtctggctcataatttgcatttgtatctggctctttcatactacttgcctcctcttactcatctgtttttcacttattaatacttcaatagtaccattttctgtaaaaaattgttataaaaaagagcgggcaatgctccataaaacaggctgcaccaaaatttggtacagcctttttttcgatcaactagtctttccatctgataggacagaatcgaatccgatgacctttatcttattttttatttactaggcagatctcttgttgtgaaatgaatgcgctgatgctcatcacgagttagctgcgtttcttcgtttagataagtaaacgtcaattgttccaattcgggatcttcaagcattctttcataaccggtaaaaatcgaacggatatagtgtttatatgcgtttttctttttctgtctttttttcatgtagcaccttccttatcaaaaactatcataccaatgaataactatctagacaagttggtttaaaccattttctttgtttttttgaggaatttcgctcttccagttgacgaatcctcaaaaaaatgaaaaaatgctttagtacttaaggagggaacctagtgaaaaaaattggttttgattcagaaaaatatattgaagagcagtcagcgtatattttggaacgagtgaaccactatgacaaattatatttagaatttggtgggaagctagttgacgacaagcatgcgaaacgtgtacttccaggatttgaagaagatgcgaaaatcaaattgctgcaaaaattgaaagatcaagctgaaatactgatttgcgtctatgctggagatattgaacgtaataagatccgtggtgattatgggattacttatgatatggatatcttgcggttaatcgatgaattacgtggttatggcttattaatcaacagtgtcgttatcactcgctatagtggacagcctgccacgaaagtctttatcaataaactagaaagacgaaacatcaaggtctataaacactcagaaatcgaagactatccagtcaacgtagaaaaaatcgtctcagaagatggttttggaaaaaatgagtatattgaaacaactaaaccaatcgttgtagtgacagctcctggcccaggaagtggaaagctcgctacttccttgaaccaactgtatcatgaaagccaaaaaggacatgcagctggttactccaagttcgaaactttcccagtatggaatgttccgttgaaacatccgctgaacattgcttatgaagcagccacagtcgatctaaaagatgtcaatatgatcgattccttccactttgatgcctacaataaagtagctgtgaactataatcgggatgttgagacatttcctgtaatcaaacgtattattgaaaaaattactggtaaagaatctgtttatcaatctcctactgacatgggtgtgaatcgtgtaggatttgggatcgtggatgataccgttgtccaagaagcctctaaacaagaaatcatccgtcgttatttccaaacagaatgcgacttcaaaaaaggattgatcgacgaagaagcagttaatcgaatcaaactgattatggaagaagtcggtttacgtcctgaagaccgaaacgtggtagtccctgcccatgactatgcagataagattcaagcgcaaagtcctacaaaagatccttctgctgtgattgcaatcgaattaccagatgaagtcatcattaccgggcgtacaagttcattgatggatgcgtcagcggcagttatcttaaatgcagtaaaacatttagcccatatcgcagatgacattcctttattgtcaccattagttcttgaaacaatacaaggattgaaatcaaagacacttcattcctctttggatgcactaagcatcaatgaagtcttgatcgctttatcaatcagtgcagtaacgaatccaatcgctcaagttgcttatgataaactagctgaacttgagggagcacaagcccactctactgtgatggtcaataaaaatgatgaacaaacattgaaaaaactaggaatcgatattacctgcgcacctgtctacccttccgaaaatctatattaccaatagaaaaagtttacttataaatgttgaaaacgaaactattagcttaatcgatagtttcgtttttttatagactttactaagacgttacactttttaaaccttttattttgttcgctttattttctaatggaaaatgaatgcgtttcactctaaaaaagtaatgaaaatttcactaaagattagtattttatttgcaaaacaggtaaaataaaacggaatttggaataggagtgattatttgagttatttattaggtattattggtttatttgtcacattagggcttgcttttttgatcagcagtaacaaaaaagcaatcaaattgaaaccactaattgtgatgttcgttttacagcttgttcttggtttcgtattattacgtacaacttttggtacagcggttgtttctgtattggcaaaaatgtttgatcatcttcttgcttttgctgggcaaggtgttgactttgtttttgccggtgtagcaaataaaggaagtgcacctttctttctttccgtattgatgccaattgtatttatttctgctattatcggtattctacgctatatcaagattcttccattatttatgaaagctgttggtctaggattaagtaaaatcaacgggatgggcaaattggaatcttataatggagtagcttctgctattttaggacaatcggaagtttttatttccataaaaaaggaattacccttcctatctgagaaacgtttgttcaccatgagtgtatcggctatgtctacagtttctatgtcgatcgtcggatcttatatggcactgatcgattctaaatatgtgatcactgcccttgttttgaacttatttggcggttatattctggcttcaattgtaaatccctatgtattagaagaaaaagaagatgagctgatcattgaagaaaacaaagaacagacatttttccaaatgttgggagaatacattcttgatggtttccatgtggcgatcacggttgctgctatgcttatcggttttgttgctttgattgccatgatcaatgctatcttccacgggatattcggcatcactttccaagagatcctaggttacatctttgcccctcttgccttcatcagcggaatcccatggaaagaagcagtggatgccggtagtatcatggcgactaaactggttacaaatgaatttgttgctatgacagaattagcaaatggtaatttccattttactgagcgtacaacagcaattatatctgtcttcctcgtttcatttgccaacttctcttctatcgggatcatttctggtgcgatgaagggattaaatgaagaaaaaggaaatcttgtcgcaaaacacggattgaaaattttgctaacagcgactttagtcagctttttaagtgctattgtgactggcttgctggtataatatacaaaaaagcaaagttacttttaaaagctttggaaatattttccaaagctttttcacttgttcaatcatcaaaggagaaatgacaatgaattattgctatgtatttatcggtccttctggttctggaaaaacttcactcgcagaagctatttttcagccggaacaaaagatcattacttacacgaatcgatcaccaagacctggggaaaaagatcaagaggattattattttgtttctgacaatacattcaatcagatgatcaagggaaatgagtttgcagagtgggaccaatatgctcaacataaatatggttccagtaaagcagaaattaaaaagaaactgacagtaggaaattgttacgccgttttgacagcaaatggtttttggcatttatatgagtatttcgggacggtagtccgtcctatctttattacgatctctaaagaaacattgcaatcgcgcctgaaaaaacgtggagattcatctgaacagatttcagccagactggcggtttatgtagaagatttagcacagttgaaacgtttgaaagctatcccctcacttttagtcgtgtcaaacgatggagcgttccaagaagctgcagataaaataaaaaaaggattattgatataaatgtatcgaataatactcgtaggataagccgagaggtcgtgacaaaagctatgtcacgacctctcgatgaagggagtttcagaaagcagctatttcgtaaaatacgctaaaattccacaaaaatttgagaagcattttcggaaattctttcttgttttttgaagctggccacttctgttacaacctcttggctatcatatgattgtttttttcagtagtgttaatgtctttatctttgctcagatgattttatagtcaattgatgattatttgatatgcttttctttcgccgtgttcaaaaggaaattcaatcatcccttgataagtgaatccagcagaatagatggtcttttccatcggttcattagctggataagtatcgatacggatatcttggatatttttgctggctgcaatcgtcaacaaatgttctaagaacggttttgctagtttttttcctcgagtactttctgctaaagcgacacgatgaatcgataaataaggaccagttgattctttccaactaccatctatttttgtgtaaacgggatccacgcttgagactaatgcagctgttccagcaatttgatcttccactattaatacatagctttcttttctttcaatatcgttcaaaatcgtttcttttgttggtttctgcccgttttgccattgaggagagccttgcgaagcaatgaaatccgctgcggcattaatgatttctaccacttcttctacttcttctttccttgtttgccgaatatacatccagtttcctcttttctattcctttttcatttacattatctaatcattggatcacttcatatagttcctgaacttttgaataatatttaagccaatcttttggatgatctagcaggtgactaataagttccaaatgatgcataagtgaccactttttcaacactcccagtccagggaatttttgttgctggtaaagagccaataattcaatcattcctgaagtaatcaagagttgatgatggtgacgcatgatccattttttcattttatctcctgcttcaagaaacttcaatgcttggtctttagcagagtcgttactgtcagagacaaaatgtttcacgcgtatattgccgtaagcatcaatatacgttagatggatagcaagcgctcggctagggaaccctttatcgaaataacggctaccttcgatcgtgaaatcagaaaatccaatatatccgtctgcgtggaaaaaaagatagtcatcactaaaaaagtcatctgttttatctgcataactttcaacatgctttctcgtttgaaaagagtcacggatcacaattttgttttcgggcagccagatgcgaaagcgactagtatctggtatcaaaaatttcgaatcaactcctgccaactgtttccacacctctgtatcttttgggtagtgctgtccatcgaaaacaagaaacgctggaggtgaatccagtacttcactgagattttctggcgttaagatctgtgcagggacgacagagctattttctttgactgtccaactgtgcacatgctgatcgaataatttgaattgtcctacttggggattttggatcacagcgattggatggtgctttttttgaaataattcgatcacatttttaagcgtagcggaatcacgtactggttcgatcactggttggattttattggagagcaatcctcgcgacagtgcttcttttaatgctaataggtcaaattgttttcctcttaaataaggatagtacatatttttcactccaatggctctgtaggcaaccgacggatctgctgttgttgcctcaaatattcataatcatgctgaagcgcgataacttcttcttgcaactcattgattgcctgactagctatttcctctaaaaaccgttcataatatcgttcgttagaaaatggatcttgattttctgaacgtcttttcaattctttgtacaattgatctgttggaaaatattttacgcctcgctccatttgctttgcttttcttacttccctgaataaagaagccatgaagcggtttgtcaaagcttcttccggtacagcaagctctttctttgctgcttttttcgcaatcagaaatgtaccagaggcaggcatctcctcttcaaccgtgtacggacgatacactaaaacacctattcctgtagggatttcagtttttacttcttcatatagtttacttggtaaaacaaaataattataatgtccaacaaatgacagtttggctgtagagcgaaaatctgcttttgtcactttcagctcatagcatcgccattctcggcttccatcaaattttgtcaagcagctaagcgtatctacaattccttggtcatcaggcatcgtgacttcttctacaaccaagccgccttgctcgatgcaatattggtataacgaggattctatttcgatggttagcggggtcttcatgttttctacctccgaacatattttcgatttacattttacatgaaatggttttaaaatactaggcagaatatacaagaaacaaaaaatagaaatggtgccagccacgctagcaccatttctatttttcagattgactgatgcatagaacgtttttctaaatactgttgcactttttcgatcccgatacaaatgacccaataaatcagtgcaactaaaatatagagagaaaaataatcgaatgtccgaccgcctatgatctttgctttttgaaatatttctggcactgtgattgttgctgctaacgaagtacctttcactagatccatagctacgttactgagtgccggtactgagattcgaaaagcttgcggcaaaacgatatatttcaataccccaaagaaagaaaaaccagaagctaaaccagcgtcccactgacctgaagaaacgcctgctagtgatcctcgatagatttcaccaataaatgcactgctggtaatcgtaaagcagatgactgaagccgttaaggcacttaattgataaggtaacccaaaatataacagaaacagcaggactagtgcgggaatgcctctaaagaacgataaataaaaacgaataaatacattcagaggcagccaatccaaaagacctaaaactgtcaaaagcaaccctaccagatttcctaaaagaaacgacacgaagccaatccctaatgtgtataccaagccttgcagtacgaaaggaagtgaagtccacatgagggaaaaatcaattagaggaaagtacatcactcactcaccgactcagccatcgtttctttcggtttgactgaaacatcagtttgaaaatatttttcagatattttctttgtcgtcccatcttctttcatctcttttaatacgccatcgattttctttttcagagcatcatttccttctttcaataaaaaaccactttcgttttcattgaaataaacgttctccagtatttttacagggatatctggtaaagcagatacggccattttctgcagataataatcatttagaataacatctgttcgaccatttgctacatcgcttaaatactgatcattcgtggcattgtcatatgtgactaatttagctccgtgtttttccgctaaacgcatatagctagtattgggttcgccagctgcttttttccctttaagatcttcaagtgagtggattcctgaatcatctttttttcgtacgatcatactgtcaaatgaatatttgaaagtctctgaaagggagaattttttttctctttcttttgtgataccaaaatcgttcgcagcaaaatctgattctctttttgaaacagaagtgatttgtccatccacgttgtattctttaaaggagattttgacatttaaccgtttagccacctcttttgccaaatctacatcataaccaactaattcattttgatcattataataagatgcgggaaacagtgtgccagaagtcgctactactaattctttctttttttctacattactccagctgttatcttcctgattagcggcagctgtaccgcaagcgcttaaaataaaaaaggcactagttattagagcaaacaatctttttttcttcattcttcttctccttgtttctgctatttccatggatttggtaaatggaactgatgatttgcttcaaatagatagccgatttgaaatagcaaatcttctcttcctctggcagccataaattggattcctagaggcatgttttcttttgtcaaatgagtaggcaagctgattgctggttgtccagtcagattagccaactgtgtataaggtgtgatcttcaagctctcctcaaacatggaagaaacaacgtctaaaccttctacttcagaacaatcactgatgtgttccatctgtgctcttatcgcatcactttgcaaatcttcgctgattttaggggcggtaaatgcagtcgttggtgaaaggaatagatcgtattcttgatgtaggttttccatgacaattgctgcttcatcccatacatgcagagaatcgatgtaagtagcggcagagagcttctgaccatattggaacaaagtccaagaaatgggttcaagttcttcttttctgacagctcgctggatgcctgtttcaatcgagcggatcattgctgctgtttctgcgccattcatctgataataagacgtgatcagtttacgaccatctagtgggtaaggaatctctgtcaaatcatgcccttcttttccaaggaaatctacagctttttttacagcaagtactgcctcttcactaatctgtgagtggatcggtgaatcaacacaaaaagctatcttcaaccgtttttttcttggatgtgtttgccactcaactggcgatacttgatatggcgcaccggaatggatacttctcatcccataaaataaagcctccgtgtctctcatagaaactgtcaagccgaaatcaatagcagctccttgccatcctctccaagcatatggaccaactggcatcgtccctcgcgaaggtttcagcccaatcaatccgcaaaacgaagcgggtattctaatagaaccaccgccatcactagcaccagctaaaggaacgattcctgatgaaactgcagcagcagctcctccacttgatccgcccggtgtacattcaaggttccaagggtttcttgctgggccatagatgactgggtctgtaatatttttgaaaccaaactctggcgcattggtttgtccaaaaggaactagacctatcgcttctgcttgccgcacataattagatgtatgagaagctcggtgtgtttcaaataaacgagatcctgaagtagctagccatccctttttttcttgaccgagcatttttaaaggaaatgggataccagccaatggccctttttctgactggggaatcaatagctcgtgggaattactctcgaatggttcaagcgcgacaaacgcattcaattcatgattttgcttctttatttttttctgtatatccgtaactagttcttgaaaactaaattctttttctttaagctcttttgctaattctgttgcatcattcatattatcctcctttttgcctctgttattttcccacaagttcgtctaacatacaatgagtacgcttgcacaggaatgaacagacgagtgttttttataaaaaaagacgaagatcaatcatgaccttcgtctctttgctatgaaatggtgcgtaatttgcctttaaattcgtcaattgacgtatatcctttttctgacataatctgcgttaattcttttatgattctagaaaaaatttccggcccttctttatgaagctcggtaccaatctgtaacatgcttgcgccacatagcagatgttcaaatgcatcttgtcctgtccgaatcccacctgtaccaatgatttggatttctggtttcaaacgtgtataaaaagcgcgaacattcgccaaagcagtcggcttgatatactctccgccaatgccgccgaacccttcttttggtttgatgactactgcttcttgttctgtatcgatatacaaaccattgcccacactgttgatagcattgacataggtcaatggaaactgattcaagatatcagccatctgatcaaaatgagcaaaatcaaaataaggaggcaatttgattcctagcggcttagaaaagatgctgaatacttctttcagtgtttcataagtggcctcaaaatcgtaagctagttgtggttttccaggcacattgggacaagataaatttaattcagtgatcccattaaacccacttttttctattttctcaagcatttccaagttttcctggacactcatcccggcaatggaaaaaaataacggttgattttggttttcctgcactttttcatacgcaagagcatactctagataataagaaaaacctaagtttggaagtcccatagaattgatactccctaaaggaacatcaaaatagcgtggttcgggatttccttttcgttcattgatcgtacagctcttagtgataaatgctcctgcttctgaatgagccagttcatctaattcctgggtagtcatgcagtggacaccagatgcattcatcaaaggattggcaaagatatgattggcaaggtcgtttctaaactcaagtaaatcgctccttcaaacaagttattttgtctagtgtatcatgactaaaagaaaaatcaactcttgttttccgaagaaattcttaatcatcttgttcagttgacagtacttcgcctgtttggctattgatcttgactgatgtactttgattgccgtcttttactttgacttcccaataagtagtacctaaatctttatccaaatcccaatctgttgccgtaccgcttcctactttgtcgacggcgatttttgctgcttcctcaatcgtgatcaatttatcaacatccagaccatcttcttttttcttttgaccattttgttcatctcgatctagagtttctggattctctgtctccattttttcattttgagcatcaattcttgcttcgtattctttttgatcatcgacaccttctatcttgtagaagtaagatccccaatcactatctaattccaaactagtaattgcagtatctgggtatttatcttggaacaattcgatcgcacgagctgcagacactttgatatctgactgagtacttgcttcactagaactttttgtctggctagacgaagatgtgcttgcttttgttgaggagtccgatacctgtgaagagcgctgttcgctactggaagacgtattcccagatgtgccttgattggtatttgattgacaagcagctaaaaacaaagctgcaaataaactagtataaataacagtttttttcattgattcgatcccctttgttataaaatagtattctattacaagtataacgaagaaaaaattttctgtcatgtttaaaaattaaagaaccaaacttttattatgaaaatataaagaaaaagaaactaagctttagagacaatcctagaagttagacaaaaaagttcacttctggagcatcataaaacttagcttctttttaaatagtctttaaacagtacttttgcctcaattatgcacgatgcattgggatgtcattgtttccaggttgaacaagcaaatattgaatcacatcgatattacttgattcaaatgaagctgcacaagcttgtaaatatagatcccacattcgatagaaggaatcacccatttctttcgtgacttgatcttggacttgatgaaaattctttgtccaatgttctaatgtcaattggtagtcacgacgtaagctttccaaatcaatcagttgcaaatcgttttttgtaatattatcaactaattcagtaacaccagggacataaccgccagggaaaatatatttattgatccaagcatttgtcgcaccgccttgttgtcggctgattccatggatcaaagctgttccttttggtttcaataaatcttttaccactttgaaataaccttcaagattttcagaacctacatgttcgaacatacctacacttgtgatatgatcaaacgtttcgccttttagttcgcggtaatccattaataatacacggcatttatcttctaaatgttcttcttttattcttttggtaatcaaatcgtattgttcttcacttagtgtgatcccagttgccttgacattatactctttggtagcagtgaacatcaatgttccccagccacaaccgatatcaagcaacgtttcgccttctttgataaagagtttgtctaagatatgatggactttattgatttgtgcttgttccaacgtatcttcaggtgtattgaaataagcacaagaataagtcaaagttggatctagccaaagtttataaaagtcgttacctaagtcataatgcgcatggatatcttctttgtttttttgtttcgtatgtttttctttctttggcagccattttagataatcttttcctcgtaaaaagctgtttgcttgctgataagcatcgttgatcaatgcttggatacttccctcgatctcgattcgatgatccatataggcttctcctagtgccaaagaagcgttacttgtaatctctttcattgggatttcttcatggatattgattttgatttggggaggagtgtccgtatctccgtattgtttcgttgtaccgtcccaataatttacttcgacagggagcgagaaagaacgtgaaaataattgattgtataaagttttctctaacatgattttcctccttaaaaaaactaccctattacgttaatactaaaaaagaaaagaatcaactaagaagtttaattttttcagaaatttttcaaaaactactttatttttcatttttttcacattcattgtcgcataaatcgcttaaacttgtcattcgacacgcttatctttgaatcttgttttgacaaaaacccataaaagcagcaagacagttatcgttgtttggacacttagcatcaagataaagtcaaagtggataaaccctacaactgctgctgccatggaacctattcccataacattcagcatcaaatttgcactctctttgaatgtatgaatggatgaaagttggctttttcttgtcatccacaagaaaaaggaagccccgaataaaatgagactcgtcatgacaaataggacaagaccaagacttaaactataagataaaactgattgttggacgattactggcataaaattctctttctaaaaatcgttggaaatcttcgggcgtacgtacagaatctggttggaaagatgggctataattcatcgtatagcggcgtataccagatttatccttttgttggatcacccattgttccttctcaaaatcaataaaagttccatgatcggattgttgtttctcagataaagacacacctaccaaaatttcaggggtcacagctatcgtttgttgcgatgcttgtaacccagtttcagataattcaagttcagaaaatttttgggttccttgttcatcgatcagcgaatgaacggatagaaattgttctaatggaatcgcttggatctgattggcataaaaaagagtcacaggcatgaccatcaaggaaactaaaaatacaaatatcaagaaaaatttaggccatgataatagtttgcgtcccgcaaacacttgagttggcgtacgtaatgcggaaaaatagtttaacggaaatgtttgcatgatactctgctcctatccttttgttccgccagatgtcaggccggtaacaaagttcttttgtaaaaagaagaataatagacaaatcggtagtgcaatcaaaattgccccagcagcaaaaagagagactctttggtttgtcacatcagaaataaatgtttgtaagccgacagcaacagtctgattttcaggtgttcgaagcaggaacttagctaacatgaaatccccaaaaggtcccataaaagcccataatgcttgaacggcgagcatcggtttgacaagcggtaatacaatctggaaaaaaatcctgaaatgccctgccccatcaagtttagcagattcatctaaatctattggtacagtgtcaaagtatcctttcatcagccaagtattcattggaattccaccgcctatatagatcattgtcaagaaccagtacttatcgagcgcttctaataagaaagccatgacataaaaggcagtcaatgctgccatagtcggtaccatctgaatcactaaaaagaacatcaaacttgatttgcggccgataaaacgatagcgactataagtatagcccgccaaagttactacagtcacttgtacgatcattgttaggacagaaatgatcaatgtatttttataccaagtcccgtaaagtgtttcactgaatagccgagtaaagtttcctaaagtccagtcacttgaaagatctaaactaaaagctgcaatatttcctgacttgaaggcagtacttgctgtgatcaaaagcggatagatgataatgactgacagtattaaaagaaaaaagtaagtaaaaaagtgagaaagtcgtttttggaatcgagcactcgaatgaaattttttcattgttaatcccccatattgaacgcatttgtctttttaaataccagcaatgacacacagataacgatgacggagataatcaacgtgattgctgaagccatagaatactgcggagaagttccagtcgtaagtttatagatccaggaaataagaatatcagtagaaccagctcctccgcctacgcttccgggaccgccattgttaaacagatagatcatggagaaattattgaaattccccgtatactgtgtaataaatgttggcgctgccactaggaagacagcaggaagcgtgatgtttgaaaagcgctgccatgcatttgctccgtcgatttttgctgcttcatataagtcttctgaaatcgattgtaagattcctgtaaccatcacatagatatagggaaatcctaaccagccctgcactaagataattgctactttcgtccagttcgggtccgttttccaagagattgcactgatatctacaaaaggaagctggtttatgaaaggaatcacttgagtattgatggcacctacgctatcgttgaatatattcgaaaaactcatgatagtaataaaagctgggaccgcccatggtaataagaaaatgataccgaaaatacgtttgaatttaataaatttctggtgagcaacaaccgctgtgagaataccaagggtgatttgcaaagttgttgcacataaagtccaaatcacggtccacgaaaagactgcaaaaaaagtattacgatatgagcttaaaaagaagatactaaaaaagtttttagcccctacccaatcaattaaactggctggtggaatatgattgaagtcataattagtaaatgcagtgaacaatgtaactaggactgggaaaatgatcgtaaaaatcatgagaagataagcgggaagtgtcaatagataaggaaaaccttcatcacctatattatgtatgacttccttcatcgtccgattgatttttttgccctcttgacgcatcttcgctactcgataagcgtctaaaagattcaaaccgtaaaaaatcaagaaaatgattgtaatgatgaattgcaaagtgccttcaatcaaaataaataatgaatgatcttccattggtatacttcccaaagtaaccaatcctaccaatgcatgaaatccgcccagaagcatctgaccaatgaataggacgaatatggcgaaaaaaacgatacctttaaaagcttggccatttacaaactgccccatccctggaataagtgaacaaagcgtgatttttttttcgttgatattgcttgttttatcttgctgcatctgaatgccccctctaaacttgctaaaccgcaaactgcttttaagataatggcaacaagagcaagataattttccatctcgctcttgccacttttatctgaagcacctgttccattttttataaaaatggacggttatcattttaatcagtatttttgttctatggcttcactgattgtttttactgcttcatctgcagattcttttggtgtttttgaacctgatgctgcatcgaacatcaagttttctgcacctgtccaaacttcgcccatttctgggatgtttggcatcgcttgagctgtttcatattgttcaatcacagctgttgttaattcatcgtttttagcctttgctgtttccctagcttgttggtttgcagggatttcatttaccatttcaaagaatttttcttgattttcctgattcgttacataatcaagccatttttgagagaggtctttgtttttagcataattgctgactacccatccttttcctccgccaaacggttgataaggctgtccattatttagagtaggaattttggctacaccataattgatattgttttctttgtatgtttgcgcttgccatggaccgtcaatgattgctgcagttttattggacatgaattgctggctggcgaagtctcctgcactttttatgtcttgcattccctttggccaaacatttttgaaccaatctgttgcataagagattccttctacagcacctgcattattcaaaccgatatctgaaggatttgtgccatcatcaccaaatacatagccaccgtaacctgcaattaaaccataggaataataaaagtcagtccatttagctaaaaatcctgtattttttcctgcttctgactcaaaagcaaaacgactgtctttggatagattctccaaatctttaaacgttgatggtgctgtatcgactaaatctttgttatagtacaaaacaagggtctcgattactgcaggttctccgtagatttttccatcataagtcacttgggctttgtctgtttcatcgtaagctgcttcatttcccagttttacttccgccagatgtccttgctgtcctaacgcaccgatccggtcatatgctgccatcataacgtcaggtccctttccagcaggcccatctaacgctaatgattccaactgatcgaacatgtccttttctactagcttgattttcacatcgttttctttttcgaaagtgttttttatttcgtttatataatctttatatccagaatcaacggaaactgttaacgtttttccttcatcggcttccccttctgctgaagagttaccattgccacaagccgctaatccgcctaagattcctaaagagattaaccctaaacccaactgtttcacacttctttttttcatcttcatttcctcctgtgtattcaacgtgctgttacacccttattataatgggcacaaatcttcatttgcaaacgctttcttgttgttaccggtaacagttttcaacacatgatcaaaaatccgtattgtcgtatctctgctttcccgtcttctaacaactgacaattttgactaagaatcacctcattttcctgttctactacccaaggttcttttgactgattaaagtaaacatagatgatctgtccctctagttcccgtgtgaaatagagcttatcttcacgatcatatactattagccactgagtagaaccttcagaaataatcttagacaactgtttccttagagaaacaagttcttttataaaaccgaatagctctagatcttgttcctccttctcccatatcatacatttgcggcaatccgggtcatcttcaccagtcatccctatttctgtcccgtaatagatacaaggagaccctttttgaagaaacataaaggccatcacagacttcatcaattctttgttaccttggcaaagggtcaagatcctggcagtatcatgagaatctaataagttgaatgttccttcgttcacctgatctctgtaaagcatttgctgatgattcattccactgaccatttgtgaagctgtgattttcttttttgcaaaataatctttaatcgaatctgtgaatgcataattcatcactgcatggaattcatccccttgcagccaagcttgagaggaatgccaaatctctccaaggatatagatgtctggtttgatttctgtaactgcttctctgaattttttccaaaaatgatgatcgacttcattagcaacatcaagacgccatccatcaatatcgaattcttttatccaataagttgcgatatccagcaaatatttttgcacttctggatttgctgtatttagtttcggcatgaatggagtaaaagcaaaagtatcatatgggatattttcagcagtttctggtaagtcagtcatctgataagaatctactgggaaaaaacggatgtggaaccagtctttatagatcgatttttctccgtttttgagaacgtcttgccactgtggtgaatggacacccatatgattgaatacagcatcgaacatgatacgtatccctcttttatgtgcttcatcaatcaagttttttaaaagttttttatcgccaaaagcgggatccacctcataataatcaatcgtatcgtatttatgattggatgtggctttaaatatgggacaaaaatagatgccattgacgccaaggtccgtcaagtaatccaaatgatccctcacaccttgcaaatctcccccgaagaagtcttctcggtctggatctttacttccccaaggtaaagtgtgttcggggtcatttgctttgtccccgtttgcaaatctttcgggaaaaatttgataccatactgtttcttttacccattctggaatagtgaatcgatcgatttgatgaaaataaggtattcgaaaataaaaatttggttcagtaatcacattttctcgataaggaaaaattccttgatcaccgtaaaaacagtccgtgttatcttccccaacaacatggaacgcatactgtaagcgccttgtttcgctcgtcacttcaatttcccaataatcatgaacattggtacttagacattttttcattggtcgttgtttttgataccatttttcagttgttatggtatatggatctccacaaagcacatatacttttttgatatcatttttcctagtacgaagccgaatacgaaatcttgtattcgtatatagaaatgcatattcactttccggtcgatgataaattgcagctgtatccattgatttcctccttgtgttttaatatgacgtcatcactataagtgatagagaaacaaaagacaacgctttcaaaaatgttatcggtaacagttttttgataccgaatttttattttttaaacttgccaaatagatagacttaaaacttttaaaagttttaatctacttcctgtactatttagtgtcctgaatttatcttaagcgatcaatttctccaattttctaaagtaaaagttttttaacagtttttaacgtagaagtatattctagaagaatgaaacataataatttagactagcctaatttttttattaattaaagttaacttaaggtgaaaagtaagttataataagataagagtattattaatgaattaaggaagtggataaatgaaagaaacgagacaatttatatggacatacattaagattatttttgccctcttcatattaggagtcgctatcaatatgtttttagggcctcatcatattgctgctggaggtgtcagcggtctaggaatattactggaagctgctttaggatttgaccgagctatagttattttagtgttgaatatcgttatgttggtactagctcttctatttttaggtaaaaaacccttttttaaagtacttttcggaagcttggtttttcctttaatcattgcaatagttccagaaacaatgattacttcagatcggttgttgtctgtcatttttggaagtgcgatttttgctttaggagttgcgattttatataaaaacaactcttctagcggcggtacgacgatccctcccctcatttttaaaaaatatttccacttgaatacttcgattggcttattttttacagacgcattcgttgtttctcttaatctgtttgtttttggaatagaagagtttctttatgctattttatctattgcaatcacttcaattgtcatgacttatatcgaaacaggtatcaatcgaaagaaatctgttatggtcatgagtgaacattatttggaagacatccgccttcgcttaagtgctgagattggacgtggccttaccctgctagaggcaaaaggcgggtataatcgaaagtcaaaagaggttttattgatcgttgtgactgatcatgaattttcccgaatgaaaccattgatagaagaaatcgatccaagtgcctttgtcattgtcagcagcgtagcagaagtaatgggacgcggatttacttatcatccaatcgaatgagttggtaagtaaatccgctattttttttgaatgcgttttctttaactggtataataaaagaatctagtaactgttcgactgaaaaggagaggagatctttatgcataaaggaacggaaatagattttgtattaaatgatagtttgaaagcactagaactgtatcaaacaatctttgatgaaatacaactgattgaggcaacagattaccctagaggcaataatgaagtcatttttaccttgtatggcacgagattccatatgctggatgaaaacacgtctcttggtttgactgctcctactgctgaacatccaaatacgatctggttcaatatcatcgtctctgatatcgaggacacacataataaagcattacgaaatggctgtgtagagattcaagaaatgacagaaatgatggactttggtgtgactaactcaatgttcagagatccttttggttatttatggatgcttcatcaggtccatcgtgaagtaagttttgaagaaagaaaacaactttttgagaaatatatgtaatgtttatgatgagattagtttttgtctctgatatttttttgtatatgtttgctattcgagaaagcgcgtctgtttcatgtgctttctcttatttatcttatgccaatccatttctttgctttccacaattatattgtgtaaaattcaattgtataaaatataattaaaggtggtaattttatgaaaaaaatgtattctacgaaaatgatcaacacaggcggacgctctggagaagttcataatcccgatcgtacattcgaattgaatattgcagctcctggtaaacgcgtcgaaaatgcaaccaaccctgaacaattgtttgcagctggtttcagtgcatgttttaacagtgcattagaattgatcaaacagcaaaaaaatatctctggggcttctactgtcagtgcacaagtttccctttattcagaaagtgaaacgagctttgtcttaggtgtagagattgaaggatctatcgaaggtctttctctggaagaaacgcaagaattattagaggcagcgcataaagtgtgtccgtattcaaaagctacagctggaaatatagaagttactctgaaagcagttagtgaatagacttttttgtgtaaatccgctatgatacactatagtaaaacagcggaggtggaaaaatggaagatctatatttagttaatcaagtatgttttcctttatatgccgcctctaaggaaatcattagacactacacttccctcctcaagccgctgaatcttacctatacccagtatcttgtgatgttagttttatgggaaaagaaaaagacttcagtgaaagagctaggaaatgatttgtgtctggattctggtacgctgactcccttactaaaaaagttagcagaaaaaaattatattaatcgtcagcgtgaaacgggtgatgaaagaatcgtaaatgttacgctgactcctcaaggtgctgcgttgcaaaaacaagcagaaggtattccacaaaagatcaagtcttatcttccacttgaacaggaagaattggatacactgcaacatctgacccgaaaaatgctagataattttcatcaagaccagaaaaagggctgaaactgctagatgaacgattttatgaggaaaaccaactcataagataacgtcatttagcggtttttctttttgctctttctctttcttattttcatattccatcatataatgaataacgtgtttattttttgttatttggaggttgtcgatttgaccgtttatcagcgttttttggcgaatgaaaaaatacgccgtctcactgttttattatttgtcgtttttgttcttttcttagttagaagtatgattacaaccattttgctcacatttatctttacttatttgatgattcatcttgttcaaatcattcagcgatttgtccgaatccctacaggtgttttagctatcatgatttatacactgatcgtttaccttatctatctggcattcacaaagtatatcccgatgcttattcatcaaacatttgatatgatccagtccgttattgatttttacgagcatcagccaaaagatgcagatcctgttttacaatatatccatacttatattgagcgaaacgatttttttgaacagcttcaaaatggcgcttcgattgcgcttggctatttacaggatataggaaaaatggcagtggcgtttgctatgtcattcatcttaagtttcttttttatgattgaaaagaaaaaaacaattgtattctcaagattgtttttaaaaagtgaattttcttggttctttcaagatatttactattttgccgataagtttgtcaatacatttggtttggtattagaagctcaatttgttatcgctcttttaaacacgttgctcactacaatcgccttggctgtatttggctttcatcagctgctgagtttagcgatcatgattttcattttaagtctgatcccagtagcaggtgttatcatttcttgtattcctctatctttcatagcttattcccaaggaggcatccgagatgttgtttatatcctgattacgattttgattgtccatctaattgagtcttatgtgctgaatccgaagttgatgtccagcaaaacagaactgccgattttttatacatttgtggtcttacttgttagcgaacggttctttggcgtttggggcttgattgtcggcattccgatctttaccttctttttagatgtattgaaagtgaaaaagatcccgaaccatcttccaaaagaaacagatatcccttaaaataaatatgaagaaagataaagtatgaacgaccccaaatatcagatttcaatctggtattttggggtcgttttctggatatttctttttatttgaaaaatgcgttcacagacattattcaaatgttagagagatctgttttgtttaaatctttttgcagaaagcattgttgctatacttaatagaatgattccgctccacagtataactttgttttgtgactctccggattttggtagctgtttatttttcgtttcaggactagcaaaggttgtatccttgctactttttaaggtttcagctgattgggcgctatcaaatattcgtgattttttattcagctgctcttcatttatttttagaattgctagatttgattttttactctctttttttccatcctcttgaattgtttttttgtttattttttctggtattccttggtctcttgcgtccgtatctggttctggagtcacatctggtttttcttctggatctacctctggtttttctggattttcagtttcattatctgtgtctggatttgtttccggtactgtttggtttccagaatccgtatctggttctggagttacatctggtttttcttctggggctacctctggtttttctggattttcagtttcattatctgtgtctggatttgtttccggtactgtttggtttccagaatccgtatctggttctggagtcacatctggtttttcttctgggtctacatctggtttttctccaggggttatttcaggttttgattcattgtctggctctggttgagtttctgtatcgggttcttctccaggttctatttccggtttctgttctccgtctggattttctgtaggcggtacttctggcttattttcattttctggtttatctgttggttcttcaacaagatctcctcctgagtcgatagctgaatcttgctcaattgtctgccgctgactatacggcgttaaatgatgatgatcgttcggtagtccatctgataccttgacagtaaaaagcgctggttttaacaagtcctgatttaatgtaacggtgaaggtaaatatcgcttgcttgtgttggatagtcaaagtgttctcgtcatagccaatcgacaaagcgggatcaacattctcaaatgtaacagctgattgtagtataggtgctaagtctcctgaatagtcaatttttgctttgatggtcgctgtttgtccttttcttaattttgcgactcctgaattgaaggatgaaaattcatcctgaaaggtaattcgattgacgttggcccacttggtttctgtccatttggctgtttctatctcctctgtgtggactgtctgatttatagtaagcgataagcttaaggctgcaaatgttgatattaagatggttgaatatctcataactctctcactccttgatttttttgtatgcaagaaataagatagtagagattctacctatatgtttactgtttttttgtctaaatttatgaaaaaaacagtaatattttcaagttttaacaatttaagtaaaaaggagcctctttcatgcaaactcaagaagcgattaaaacgtttctcttgaagaaaaaaagcaatacaaaattagatatttttcttttcctatctgaacatcgtttctttattactacacaatatttagcagatcatttccatatgtctgaatcaaattttttactatacatcaaagaattagaacaagactttgagcgtctcaatctaacagaactgcatattgataagcaaaaaccttttttaaagttgaattttgaaggaattgatccggcttactgctattatcgtctatttggaagatactgcaacgaatcagtcagttatcagatcttgacttctttgttcagctgtcagacaaattcgattatcagtttaagtcagcaaacaaactatagtgcctcttatttgtatacgaaaatgaaaaagattaatgcatttttagcattgtacggtttgtctatctccttttctaataatggcagaaagtctttttctggaaaagaggtacaaattcaatatgcagcattagatatttattggaacatcttttcaagtactgctacagaattttatgatgaagatccgcaagtagtggcttttatgatgaatactttttttaaaaaagaagtacttgaccgactaaatagcggtatgatagataaattatattttctattaaaaatatgtaaagagaattttcctgcaacttctgtgaaagacgtacaaaaagaattcacagagtatgaatatattgacttttttattgatccctctgtagatattttgcgacctaatctgccaatttgtcgcgaacaacgcatcttagtgaatattttagctcgactttctatcacgaaaatcgaatcggaagaaacaagcttggagcaatacaaacttttaaaaaaagcaaacgttcctcatgttctttattcaagagaaatggtggagtccttttgtactgtatttgatttgtttatacctgaaaaagaaaagattctttactcattggcattcgcacgaaataaactttataatggatttcttaacttcaatcaaccaaatacgccccttcctactttcatgctttatcaagaacatagcgtgttgaaagaagtccaaaccgccattgaacaattttatatggatttcagagaacaaaatcaacacttgttaccagttattttagaaaaggaaaatgtgcaatggatggttgaagacctagtacatttgtatgatcgctacaaaaaacagccgcgaattgtgattggtgtgaactatacgcgtgatttttatatcagtaaagatctgatcgttaagatagaacaaattttttcaaatgaatcgatcaaaatacaaaatgattttatggagaactgcaacatcgttatcagcgactgccctttgaaacaattgccttctcatatcaaaaaaatctatattttaaaaggaatcatcacaccagaagactggaaaaaagtgattatgaggatctcagaatatatctttgaattaaaagaagaagcactcatggatcaatcgaaaaaagaaaatcaagttacttcctagaccaaataagatacataaatccgaatgcttattaacaacctccggatttatgtatcaagaatttgaacatccttcttatttacataataaaattacagtttttttcactaattatctttacttttgtttcctttttcgattgcttcccataatccatttagataaacagcacctaatgctcgatcatataagccgtatcctggtcttcctgtctcattccagatcattcttccatgatcaggacggatgtattcgttaaatccgttgtcatacattgtttttagtatgcggtacatgtctaatgaaccgtattcggatttatgcggtgcctcatagaaatctcgattagctaaaaatttaatatttcgaacatgtgcaaatgggattcgatctctttgacaaaattctgctaaaatcccatatacatcattttctggatcttctgcaatactccctgtacaaagagtgattccgttataagggctgtctactatgcggcacaaccaatctaaatcttctcgattctttacgattcgaggtaatccaaaaatcgagtatggcggatcatctggatgtacagccattttgacccctacctcttcacatgttgggatgattgattggagaaaataggcaaaattttctcgaagtttttcttcgtctactgatgcataggcttcaagcaaggatttgatatgagctaagcgctcaggttcccatcccggcaattcaaattcattgctggaatgttcgatgcgcgcgacgatttctcttggatcatctggaatatcatcagatataaaagctaacgtggatgagccgtcttctaagcggtagtcaaggtcagatttcacccagtcaaatacaggcataaaattatagcagatgacttctattccatattctgccaagtttcggattgtctgcttatagttttcgatatactgctcacgggaaggtaatccaattttaatggcatcatgcacattgacgctttcaattacttttagtgttaacccacgagactcaatttcttcttttagttctttgatcctctccctgggccatacctctcctactggtatatccatcaatgtgcctacaatccctttgaccgcaggaatctgtctgatttcatctaaggtaatcttttcttcctgtgatccgtaccatctaaaagtcatttccatgataaatttcctccatgttcttgtaagtaatcctgtaatgtttttcgtacggcattcggtcctgctaccatcttgatgaacatttcttctatttttctgccaagctctgcttggtaaagatctacaccaaaaatttctttatttgacaaaataggagccattttctcatgaatatgtgatgtatcttgcgtacccagttgaatatcggaaagcttatgctgaaagtctgtcaatagtgggtctggactcgggatgaatggttttccttgatcatcaatgccaataaggtatcgaagccaagcagcgagagtcaatggtatgaatacaagtgtctgcgggtctttaacttctatttccatatattttttaatcgtctcaccataacgaatcgccaccttttgagaggtatccgtggcgattcgctgaggcatatcaggaatatttggattagaaaagcgcacagtaattacttcttccagaaagatctttggatcaatgatacctggagactccacaactgggaggccttcattgtacccgatttcagaaactagcagcgataaatctggatctttcatctcctcagctatgctcctataccccagtaaacaacccataatagctaaagacgtatgcaaaggattaaggcaagtcgtcaccttcatcgtatctgctttatctaccgttgcacgatcagtcaagaataccccagctttttcgaatttcggacgtccattgggaaaatgatcttccatgattaaataatggatgtcctctgtattgacaaatggagcaatattatttccttttgcggtttggaaaatcgacatatttgaaaagccctcttttgccaacattttgctaactgacaaggaaggattcggggtgatacgatcaatcatcgtccatggaaacgcaacaatttcttcattcgataagtattggataaatgtattttgtacataaccttccttttgccattcttttgcgatcgttagcaaagaagtacgtaattgactaccgttttgtgaaaaattatctgtagagacaagtgcaatcggccaagctccagataaaaaacgtttataaagtagcgcagcaagaatactcattgtatgtgatggcttctttggaccattttttatatcgactgcaatcggtcctatatatttattatttgtatctttcaatcgataacctttttcagtaatagcaaaagtaactaattgtaaactaggattttcaaagtgtcgaatcatcttatcaaagtgttcagaacaatctggatgacaatacagactgtcagctgtcgcagctaatatacgtttgacgaactctccactgcttggcatgaccacttcaagaatcaaatcatcaaaatcttggtaagccctttcaattatttcttcatcgaatgtttcacaaacaatgacaccagtggacaattcgcctagatccgctaaacgttgagcgatttctgcatgaaatcctcgataaagatttccgccaccgaaatggatccagacaggatttttttgtccattttctcttaatgatgcacggtcaaaatgaggtatttctacttctttttgagataattcagggataaagttcctccagttgtttaaatcaatcatttttcccctcctaaactaacatattagtttttgtattcaagtgaattttatgcaataaaaatcgctatgtcaaccaaaattttactatttatacaaatttactagttaatgtgacataccagattgtttttcagacctcttctgttatactacgttcatagaaatgattttggaggaataaagatgaaaagcagcttgcaatcacaagcttatcaagcgattcgtaaacaaattatctatgctgacttagaacctggaaggaaaatatctgaaaaggcactggaggaacatcttgctatcggccggactcccattcgcgaagcattgattcaactacgtcagcaagaactcgtgtatacgatacctcaaagtggtacgtatgtttccaaaattaatcttgtttctgcagaaaatgctcgctttgtccgagaacagttggaagagcaaatcatgattgaatgttgttccaaattggacacacaaacacgaatagtgctagaaacgattttagaagaacaagaaaaagcagtcaaaataaatgacgaacgcgcttttttccgtgcagataatttatttcatgaagcttgtttcgaaattgcaggaagaaaagaagtttggaactggttagatgaccataatacccatttagaacgtttccgctggttacgagtgaccattcaggggcttccatgggaaacgatcatggaacaacattatgatttactcaaggctttagttgataaaaaaccagaagaagctcgatttcaaacgggattgcacttacacatgatgctgaaagaacaggaaactgttactcaacgttatcccgagtatttccagcagtagcattttcttgcgacctcttctatttttataattaaccttcgtttttgagtaatctttattaaataacaaaatatccattgactttgcaactccaactaaattacaataattataaataaataattattattggaggttttactatgtcattgattgggaaaaaaatcgaagaatttaatgcacatgcttatcatcaaggagaatttttagaagtcagtgaaaaagatcttatggggaactggagtattctttgcttctatccagctgattttacttttgtttgtcctactgaattagaagacttacaagaacaatacagtacattgaaatctttaggtgttgaagtcttttcttgctctaccgatacccactttactcacaaagcatggcatgatacatcagatgctatcggtaaaatcgaatacgtgatgatcggtgatccgtctcatcagatttctcgtatttttgatgttttggatgaagagcaaggattagctcagcgaggaacatttattattgatccagacggaatcgttcaagctatggaaatcaatgcagatggaatcggtcgtgacgctagtgcactgattgataagattcgcgctgctcaatatgtacgtacccacccaggtgaagtttgtccggcaaaatggaaagaaagtggcgaaacattgaaaccaagttttgatcttgttggaaagatttaggtggtggatatgttagacaaagaaactaaacaaaatctcgaacaatatttagcactgattgaatctcctattgttttttctgttagtttggataatagtgaaaatagtcaaaaactagctgaatttacgaaggaaatagcagaaatgtctcctaaaatctcttgggaaaaaagagattcgatgcgcacacctagtttttctatcaatccagttggcaaagaaagtggaatcgtttttgctggtatccccctcggtcatgaattttcctcttttttactggctatgttacaaattagtggacgggcaccgaaaatcagtgaatctttgagtcttaaaatcaaaaaaataacacaaacattgcattttgacagttatgttagcttgacttgtcataattgccccgacgttgtacaggcattgaatatattagctgtattaaatccaaatattactcatacgatgattgaaggtgggatgttccaaaaagaaatcgatgataaaaaaatcatggcagtgccaactgtgtttttaaatggagaagaatttagtagcggacgcatgacgatcgaacaaattgttgaaaaaatcactggccctttgattgaagaagagttgtttgaaaaagaaccttatgatgtattagtgattggcggtggaccagcagctagtagtgcagctatctatgcagcacgtaaaggaatccgtacaggacttgtcgctgattctttcggcggacaagtcgttgaaacactagggattgaaaatatgattggtacctcttacacagaaggtccaaaattgatgcagcaagtagaaagtcatgtgcgtagttaccctatcgacattatgatgaatcaacaggccgtttccttaaataaagagcaacattttattaatattggcttagctaacggtatatcacttaaagcaaaaaccgccatcatcgcgacaggtgcgcactggcgttctatcaatgtaccaggcgaaaaagagtttaaaaataaaggaattgcttattgcccacactgtgacggccctttatttaaaggaaaagagattgctgttatcggtggtggtaattctggtgttgaagcagcaatcgatttggctgggttagcaaaacatgtatatgttctagaattcttaccagaattaaaagcagatcaaatcttacaggataaactagtctctcttgcgaatgtcactgttatcaaacatgcagcgacgaaagaaatcagcggtacgaatcaggtagaatctctctcctatatcgatcgccgtacgatggagatgcatacactagctgtttcaggagtattcattctagtcggcttactccctaatacggattggctagatggaacgatcgaaatgaatccaagaaatgaaatagtgaccgagaaaaatggcgcaacgaatatccccggtgttttcgcagctggtgattgtacagatagtccatacaaacaaatcattgtttcaatgggttcaggagctactgcagctttaggagcattcgattatctgatgcgcacttgagctatgaagattgtaaaaagtcagagagcggaaaaaaggatggtgacaagaattttgtcacaatcctttttgtttttttgaataatcgctttttcttctctttttcttatatactataagtagtaaataatttgaaaaaaagaaaggtgactgattatggcgcaaaatcgtatttttacgacaagttttgcaagcgtttatcctatgtatgtagcaaaagcggagagaaaagatcgtataaaagaggaagtagatgaaatcatttgttggctgacgggttattcccaaacagaactagaatatcaactacaaaaacaagtgactttcgaacaattttttgcggaagcccctgtccccaatccttcacgttccttgattacaggtgttgtttgtggtgtacgagtagaagacatcgaggataacttgatgaaagaaattcgttatttagataaaatgatcgatgagctagcaaaaggcaaaaaaatggaaaagatcctcagaagttgatttttccagagatattcttctccttcgctcattttgtaacatttaatttggtaaaatgactagttcacgttaaaataagtcaaaggaggttttcttatatgtttgagacgattaaacaaaatattcaaaaatacgccttattaagagctgctgtttatattatttctgggattgcgattgtgctaaacccttctgctgtttttcattttatcggttatctgatcaccgcctatcttgttttgcttgggttgttgaatctttttgaggcttaccgttttaaaaggaaaacaggttcttggagtatcggtctgttcagtggtctttttttcctgatcttagctctgatcgtctatgcttttgcacctgcaatcgtttctatcctgccgattcttcttggattagctgttatcatcaacagcttgttccagttgttcttcagcatgaatacaaaagctaaaagttggagtgtttatagtagtattctgttgttgattggcggattcgtcttattgttcaatccattcaaaagtttgatgcttctattccaaatattcggctttattttgattttcatgggcatccaggagattatcaatttcatcagaataagaaaaatgactatacgttaatcatttttagttattaaaatagaccgtataaaaaccaacaatccaaaaaaatcttttggattgttggtttttttgtgagtatattttcctattttttcaataatgtatgttatgctaagttcgggctatattttatacaaaggaatgatgagaatggaatttattggtattttatgcctgatattgatttcaacaacgattggctcacatatctcgcggagattaggtatcccagcagtgattggacaattacttgttggtgttttgctaggccaagctggattgaattgggtcaaacctgatattctagtccatgacttttcggagattggtgtgatcttattaatgtttttagctggtctggaaagtgatttatctcttttgaaaaaatatttccgacctggtatgttcgttgctttgcttgggatcatcttcccggttgtttttggctggttgacaggcaaagcattccaagtttcgggaaatgaagcgattttctttgggattattcttgcggcaacttctgtcagtatttcagtagaagtattaaaagaactaaacgtagtgaatacaaaagaaggatcaacaattttgggtgcttctgtggtagatgacattttagtcgttttagttctaagtttcagcctatcttttctaacgggggaagcttctagcaatgcttctttaccgcttgttttgattgaacagctaatttattttgtttttattttcttattagtcaaatggattgcgcctttcctactttcatttgcagaaaaagtgtacgcaaattcttctattatcatcgtatcgctagttatttgtttaggaatgtcttacgtagcggatcttgttgggcttagctctgtcattggtgctttttttgctgggatagctgtcagtcagacaaaggttaaagaagaagtataccacaatgtagaggctttaggatatgcagtatttataccagtattttttgtcagtgtaggattagaagttgatttttctgactttagtgaacaactactctttatttctatattgacgcttgtagcgattttgaccaaattgcttggaggttattttggtgctcagattgccggtttttctcaacatagttcattgatggtcggtgctggtatgatttcgcgtggagaaatggctttgatcattttacaaattggacagcaaagtcaattgatcgaaccacagtactattcacctttagttatcgtgattttattaagtacacttatttctccacttgttctcaaatactttacaaaaaaagtttatgaagtgtgagtaaatcaaaaagaagttgtgaaagagacatcgtgaaaaccgtttatttgaaaaaaggactgtgacgataacgccacagtccttttactgtacttaaaaagcaattttttattgataattttggttgaggtattgcaatagttccgatgctcgtttggttgctgaatcatcatcttctttattttccaacatgctgaccatcatataaccttggttatcaggattgaaagcaaacaagaaactgttctctttccccttttcatcctgtttttctttgatttccgctgtaccagttttcgctgccaacggaatccctaaagcagaaagagaatgtgctgtaccatttacatcttgcacaacttctctcagatctggcacgatcgtttgtactgctgtttcgccgatgacattcttcttatcttttgtctctttatctgcaatcaatttaggatagacaagtgtgccattgttggcaaaaacagaatacattgctgcttgctggataggattaattagaagttcgccctgtccatatccagtatcagctagcaagatatctgagttaaagctatcttcattagaaatttgtgctggattcatactaattggcaaatcaaggtcttcaccaaaaatgaatttatctaagcctgtacgaaattttttctcacccattttcaacgtttcttgtgccatatatatattatcggaatagatcaaagcagtttttaagtctacttgtgatacatcactgacacgcgttacttgataagatccccaagaactgtctttttgccatttaagcccgttgatcgtcaacacttcatttggatcgatagtgccgttgtcgagaccgattgctgctgtaatcattttaaacgtagatccaggagcataacctgtcgcaaatcggctgatgaatggctgttcaggattttcttcataagctttgtaatcttcttgtgagatcccgtttgtcattttgtttggatcatagcttggagagctagcaagcgcaagaagatcaccggtttttggcgttgtcgcaacagttgatccagcttttcctcctagactgtcaaaagctgttttttgtgccttcgcatcgattgtcaatttgatatctttgccattttgaacttcatgttcgatcagaacttttttctctacaccgtctgcatctgtaatgcttaatttcccacctgttgtcccacgaagatccttatcaaaagccatctccaaacctgagcgaccgatttttccattactgcttaattctggattcttatcaatatcttctgctgtgatatctcccacgtaaccaatcagctgagcagctgcttcacccaaaggataatatctgccgtctacttcttgaatggtagctccagctggaagttctggcgttgctccatcaatgattttcaatgggacaaagtaatcgggttgtacccagctttgtgaaatcgcctgattgatagcatcttctgttaagtcgaaggaggaagcaatcgctttgatattggctgttttttcgcctccatctccaagtttacttggaacgactcctaattgttttagtttgcctgttgttgctaatggttcaccatttcgatctataatattccctcttgctgcttcttgtgtggtcaggcttactttgtcatttccttccatttctggaaaaaccaagttgggttgccagttgatcgtggtttgaccatcatttctgtctaatgttcctttataagaaagatctttcaattcacctaatgaggtattcatctttgctttatatgaaaaactgtaagtagaatcgtcttttttatctacttttagattcgatatctgaagtcctttgacatcagcagcaccgtatatattctggtatttatctaagatctctttttcagataatgcacttttatttgccgccttttttgatgtcatttctgcagctttgttataatctcccttgttcaaagcttggacaaattgctcaactgtcttttctccagcttctactgcttgggtttcttgatagtgctggtagtaaaaataaccgccacccgcagctgctattaagatcactgcgccggcaatataagcgcctgttcgatttttgccgtgcttgtcacttcttttcattttttcctccttctcttgcttgtcattcctttatttcactatttatacctgtttattctaacataataaaagaagtcagagggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatgttacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacggtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctcaagtcagaacataacatagattgttatttctaacttcttttattttctttacttaattattcagaaattttttgattgcttcttggtttttggtcaaatctaattccagaacacttccggaaggcgtattgtcgttgaagtcccaactgccgtctactggtacggataatgtatcgatctttttattattgtctttgaggaaatccataccacaatccagaagcacactttctggaaggttcgtttggatactaccaagtaatttcccaaccgctttgggtagcttgaatattgaagttacgtctttcagctgctgagagatagctttgatcacttgctgctgccttctgatcctcccgaagtctccttctttgtcttcccgaaatcgagcatactggagtaaagtattaccatccatcacttgctctcctttgtttatatatacgccatctaaatctagagatttttctgcatcgatcttgactccaccaggaaacagttcattaacgcaatcgataaaatcttgaaatgtgatacttgcataatagggagcttcaaatttgaaattttcctttaatgtttgatttaataaatcaactcccccataagagtaagctgcatttatcttattcattccgtaacctggaatatcgacatatgaatctctcatgatagagatcagttttgcttgttgtgttttctggttgtattgtgcaaccagaagtgaatccgagcgaccgttttcgtctttcgaacgagcatctgaaccaatcaaagccacatttagtgtggtagggacacttttcggctctacctttttcacagttgaactctgttttgcagacgaaaatccatggataaactcaatcgaaaaatagccaactactaatgtaagcagtaacaaaatagataatatgattttttgagatactttcattgcgaattcctctttctaaaagaacctctcgcttgaaaaataaaagattgtactttatgataattcaaactgagagtttctcagtttctctttattgtttttcaggtcgatagagcggcaactcttcggcctgtatctttgaagaaatattcaacgtgattccgattcctaaagaaaggatcagataacttgttcctccgtagctaacaaatggcaatggcacaccagtcattggcatcagccccgcgatacttcccacgttcattatcgtctgaacgaatagcaaagttccgaatcctaaaagaaacaatccagcttgctgatttttacagcgactgcttaaacaaaagattctcatgcataatgagaacaataagaaaagcacacacaatgcaccgattagcccaagctcttctgtaataatcgaaaaaataaaatctgtttctgtctctggaagataccctttttttgtgatactatttcctaatccccgcccaaatatgccaccattatatagtgcataaaacgaatgggtcatttgatagcccgcaccatgactatcgataaaaggatctcttaaagtcgcgatcctttcataagcatgattaaacatctgtggaagccaacctttatttcctaaatataataccccgcctgctgctccaatcagcaatgcagaaaaagtaacgattagatagatcccttttttaaatggaaccgccgctgcccaaaatatgacccacgcaatcgaaaggatcatcaatgctccagcaatctttggctgaaataaaatcagaaaagttatacctactgtaatcaggaatggtttttttagatcttttgggctactatttccgtcacgaaaaaaccagcttaaataaaaaatcaaaaaaagatttgccagttcagaaggctggaattgaatgccaaacagagagatccaacgttgtgcgccgttgacagtgacaccgaatatccctattcttactaatactaaaaagaaaatcgataaggctaaaccgtatcctgctattttagggtgaagtaaatagtgtagtttgactgaacgagctaagaagatcacgctccaactcaaaaatatgaaaattagttgacgcaataatagactttttgtattttcatcggcttgcaataaacgataagaactggcactgtatacttctaaaagaccgatcatggacaaagtcaaataaggacccaaaatccaccaatcgatcttttttctttttttcaccgcatctcctcctcacacagcaatccacttgtcaggtgaggagcgagtttgtctcatcaaataagtcagtcacaaaaatataaagaaaaggtcagaaaccttttcgaacaagaattctgacctagcatcatctcatcgtccgagttttagcactatacaacgtaaagaaaacattcttagctattggaaaaagccttaatccgacagtttctgttttacccattggcgactttcgacgtttctgggcaacagcctatgtttgtataggagcctcacctaacaaggttattactatattctatttacgagttcatgatagacttttcctaatgattaggcaatggaatttgaaatgaaatagtgaaatttaacaatccgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataataatctttaatattttttagaaaaaaataacaaataagttgaaagaatcccgttgcaaattctttcagttgcaccaggattctttgataattttttagttttatgtgtttttttatatgttttttcacttttcggaataaatatttatttgttaaagtaattaaacaatccgctaatcgtttgatctggcatttctatttccttaccatctaaagtaacagtagtaacgacaaaatggtcttgcaatggcggaacttctaagtactgcccttgcagaaaatcattcactgtttcatattcttttttcatttcttttgaatctgtcgatggtttatagcttatttttaacataactagtgctcctttttattcgggacgtgcaatcgtgaaaatttctcctattgctgcataatcatttcctgccaaacggcttacagcattcaattttcttggatcgatccttcctgtcttatcatcatagactgtttcatttaaatgatatttctgtacttctagcaaaaataaatcagctgttactttatttttattccgtatctcgacatgttcatataaggatgtttcaaaacgaacttttgcttctgtcaatgctggtactgaaatgattactgaatcagttaaagtcaagtcagtcaggtacagttcgctttcctcattaggcagattggctgctgttttatttacttcttctacgttgtcctcatcaaggatatggataacagcttctcttgtctcaagaatattctttgctgtgtcttttactgcatcttgttttctctggatcgccaaggataagatgggtcgattcgaactgacgatattgaagtaactgaagggtgcgatattcactatatcttttgctgatttagtcgttactactgctactggtctagggatgactgaaccaatcagcaacttgtaattttcacgttctgtcaattctgaaggactccgttcaaacatggtttcgccttctttctataaaattcgttaaaaagcagatcttgaagacaaaatgaaaagtaatgcttttttcatcttcttagaatctgctttaaactatctatcaatttttcttttttgtcaagaatctgtgccgtgcgtgttttttagttatttgctttacttgcggcttcgacatatcttttagtgatcaattgcggacgggtgataatagatccaactacgactgaaaaagcacctaattcatatgctttctctacttgttcaggagagtcagtatgtccttccataattactgggatatcgacttgttctatgatttgattcaataaatcaaaatcaggtgtctgcgtctttcgtgaatattctgtatagcctgctaaagtcgtagacaaaagatcaaaaccatcttcttgcgcttgaagcgcttcctcaaaagtcgaaatatctgccatagctaaccgaccgtgttcgtgaatcatttggacaagttcagcagttgttttttctgtcggacgtttacgagaagttgcatccagtgcaatgatttctgcttgcgtctccaaaagttcttccacttctttttctgtcgcagtaataaacacttctgacccatcgtaatctcttttgataatccctattaccggtaaatcaacgattcgcttgatttcattgatatcttctgtcgtatttgctcgaataccaactgctccgccttcttttgcagccaaagccattctccccataataaaagaactgtgtagcggctcgttttccaaagcttgacaagaaacgacgactccgcctttgatttgttccagtgtatccacaatatctcctccagtaatgttatataaaaatacagcttcatataaaaatgtaacccttttctattcaggagtcaataatgagctatttctttcagcagacctttcttactaaaagaaaattacttcaaattcttcgtatacgaccagcttctcttctgtaaattctatgttcaacgcttctttataagcatgtttaaaaaactcagcatggactttccgccaataagctaatgtccgatccccttctccttctttccaagcatgctctttcgtgacttcactaaaaggcaagatggtcacatttatatttttgatgatacaaactggttcattttttccattcaggaccacgtctaattgaccaacttttggtaaaggctcattctcttgtttatacagatcgtaaccacttgatgtaccagtctttatcttttttacaactagttcgctcaactcgtctgccattttttctgtatccccaaatgaaaagaaacctaatttttctgattgataactaggatatttttcttggaactttttgacatattcttctacttactgatacataacatccacccctttgctttttataatgaaaaaaccatccagatactagtataaacaattatctagatggtgagcataatgaattattgaatattcaagacacgcagactatcttcaacgatttgttttggtgttaaatgataacgttcataaagctgccctacaggaacgctatccgtgaattctttctctgcaccaaaatttaatacgttcattgaagaatcaccataataacgactgatattttcgccaaatcctcctgacaaactaccatcttctaatgtgatgactaattcgtgtgtttcttttaatttatctaatgtttctacgtcattttctgtgatcgttcctggattgatcaacgttgcttcgattcctttttttctaaaagcttttactgtttcttttcctaattcaagaaaaccgcctaaagctaaaattgctacttttcctccattatttactgtttgataggctggaatactataatcatttgcgatagctgtaccatgttctacaccatgtgtaggaattcggattgctacaggctgcgctgtttgttcgaacgcccaatctagcatagagatcatatcctcttttgttgctggagcaagatatttgatgttcgggatacttgataagtaaggaatgtcaaatgttccttggtgtgttcggtcactagctgagatcgttccgccaccgactaaaataatcactggattctcgttgatcgctaaatcatgtgataattgatcatatgcccgttgcaagaaagtacttgattggaagacgactggacgtactccctgagaagccaaagcagaagcgaaagtgatagagtgctgttcagcgatccccacgtcaaaataatgatctggatgtttttcttggaatgttttcagtccaaaggcgcctggtatcgctgcattgactgcggcaataggagctgtacttgtttgcattttcttatccaaataatccatgatgatcatattaaatgtttctccagaagttacttgctttgcctccccggtggacagatcaaatggtacatgccaatgatatttcattttattatcgattgccggctgataaccgcgacctttttccgtatggacgtgaagtacaatcggatgatcaatatcttttacttcttcaaataaacggatcaccgtttccagatcgtttccattatccacgtaacgataatcaaatcccattgctttaaataggttattgctgcttttaccgttggtttgacgaagctcagctaagtttttatataaactgccatgattctcatcaatagacatctcattatcgtttactaatacgattagattggattgtaaaacaccaccattgttcaatccttcaaaagctaagccaccacttagggagccgtcaccgataaatgctaccacatttcctgattctttcttcagatctctcgctttagctaaacctgttgctaagctgatagatgtagatgtgtgccccactgtaaaatagtcatgtttactttcatgttggttggaatatccgctcacttcacggtaatgtcctttttcaaaaccattttttcgaccagttaaaagcttatgaccataagactgatgggaaacatcccaaacgattttatcctttggtgaatcaaatacataatgaaacgcaatcgttaattctactacacctagattcggaccaacgtgcccacctacatcgctgtccttttgcaagattttttggcgcatctcttctgccaactgtttcatttcctcaacagataattttttgacatctgcggggctattgattgcatccaatacatgtaatactgtactcataatacattctctcctccgtactatcttcttttaatgaaaatagatttgttacactttatctattctactacttagagttgactctaagtcaatagcattttaaaaaaatttcagagaaagcttgttatataagtagatcttcgcacgaatcaggactcaaataaaaaccttctacagacaattaaaaagctttgtagaaggtctcctaattaaggtctcatcaagaaatatgtttttttaataggtgaagttcctgagcaatatgatacaaatggatgtttgcaccttttaatgagattggatagatctttgtcttttcagtttctaatccattttgatagctagcagcatcgcacaaaaccactctttttttcgcacatagacattcatcaggcaattcttctaatgaacgaaataaaataggatttatttcagcgatgccttcttccgcatacaaatgaaattgggttcgataaaaaaattgtttgactgaactttctgaaacaacaaaaatttctatttcctgtctccccgcttgttcactgttgatcaaagaaagacttttgacgaattttcgaatgaaattttcattccatcttagttggatttgatttttctttttccactcttccaatatttctacaatttttccgtacagaagttgttctttttctgatagaagatagatcctttccggtaaaaatacttgtccatctgcccacaacgtacggacaaattgtaaaaaggattgcttgaaaataaaattttctgcatcgtcgatttcagcgatactaataatctgtaaaatcaattcattcagtgataggtcattgagaacaaaatttttataaacaacttcgaaatcttttcttaacagctccatgttctcattggtataatttctactgttgaacaaagaaaaaatataatagacatcttcttcttgtaagtctagaattcctttttgctcttccaatccttgacagactaattgaaataacggcttcgtttctgcgcttttcttatcttcttctttcagtccaaggggaaatgcctttcttccgattgcgatctctattcctcgtatgataaaggacttttcatcttccgaatatcttcttttaaaaaaatgagtctctacataatcaatcaactcgttacaagcttcttctacatacggatttttattttcatagccttcccaattgacataacgtactaaagctagcaagatgttccgcgagtcaaattctgggataatgatttctttatttttcaaataatcattttctttaaaaaaatccaatacgatttttttgattgtatatactttgctcaaagaaataaattcaagatcagccagttctgtactcgtgaatataccattaaaataataacgccgattgtaaaattaagctagacaactaaaaaagtcatttgtgctacactcaaaatagttccgaccaaagaattataaggagtgagtacaaatgacctatacccatcttacaacggatgaacttgtaataatagagtcttatttcaaaatgaatcaatctgttgctaaaactgcccattgcttgaatcgttcaagacaaacgatccataaagtatatctgttcttcaagcaaggaaaatcagccttagaatattatcaacagtataagaaaaacaaatcaaactgtggtagacgtccgcttgttttacccgaggaacaatcagaatatattcaaagaaaggttgttcaaggatggacacccgatgtgattgttggtcgtgcagcgtttcctattagttgttctgctcgtaccatttatcgtatgttcaaaaaggggctatttgattcttctgacttaccgatgaaaggcaagcgtaaaccgaatggacatcaagaaagacgtggaaaacaaactttccgccgctctattcatgaacgtgaaaaggattatagccaattctcaaatgagtttggtcaccttgaaggtgacactatcgtaggtctgaaacataaaagtgctgtaattaccttagttgaacgattatcaaaagttatcatcacattgaaaccgtgtggtagacaagcgattgatattgaaaaaaaattaaatcaatggtttgaatctgtaccgaaaaacctattcaaatccatcacttttgattgtggaaaggaattttcaaattggaaacagatcagtaatgtcaatgatattgccatttatttcgctgatccaggaacgccgtctcaaagaggcctaaacgagaattctaacggattgttacgtagagatggtttattgaaatctatggatttcaattcagtagatgaattttttattcaatctgccgcatctaaacgaaataatattcctagaaaatcactggattatcgaacacctttggaagtatttttgagttacgtaagtattgatgatctgtctaacttaatttgacaattaagataacttaaaaactttaaaaaataagattgaccgtacagaaactgtgtgagctcagaaagagcaataccatgtttgaatacgagtttatacttatgcttctctcttacttgttcttttatacaatattctagacactcggctagactttctagatcgtgaaggatcgttggtgtagtcacccttagagaaatagctgtttgttcgatgtctatttcttggaattcaaataattgttcacacagatacacttttctaaatatatttcgctcgatgtaattttccagcattcctgatacacgcctccagtttttcttatgattttatttaatcatatctgtaaatcgtatttttgtttcctttttatttagaaaagccctttcaaaaaccaataaaaaaagaaactgggacaaaagtcaaacaagctcacaatttcagcctcattgtaggtagctttgagccgtttggacttttaccccagcctctttcaagaatggttattcaaagatgtcagcgtctagttctttgactacatctttcaacaattggataccagctgcgctgttaccaaatggatctagtgccgggctgaagacacctatgccgtaacgatttggcacagctgccatcaacccgccgcctacaccgctttttgcaggtacaccaacatggacggaaaactctcctgattcatcatacaaaccagcagttgtcataattgatttgacgattgtagcactttcttcagtaatgatttgtttgccattccaaggagcaattcctttatttgccagcacagcagctaattttgctatgcctgtagcggtgacattgagggagcattgtctgaaataagcatcgagtatctccggtacgtctccttcgatcatttgattacctttcatatagtaagcaagagagcgattgatatcacctgttcttgattcagaatgatagatttcttcattcaatgtgatattaggatcatcacagatctctttcataaatgacaagattcgctcaaatttttcatctgcatctttaccggcaatcaacgaggttgttgcaatcgctcctgcattaacaaaaggattcattggatgtttgcgatgattgatttccatattcatgatagaattgaaggcaaaaccggttggttccgtgttgattgtttgaaagactttttctattccgttgtctttgattgctaataacaatacgggaacttttgacatgctttcgatggcaaagcgcacatcggcgtctcctccctcaatcagttgttttgtatccaaatcataaatcgccatacctaattgtttgggatccacttcagctaatgctggaatgtaatccgccacttgtcctgtttgataatagtggaaattttttccaatcaattgttctaattcttttacttccatttgaataaccagctttcattttttatttttctgcatgctggaatttatgacggcatgcgtagatcgtaaatggaataactaagacgataagataagaaacaatcagaatcgtttcataaatcccatgctgtccagctgcgatactagcaggtggaacaaatgagatacaaaaagcaaaaagtgaagtcaaaagacctaaacaagcaacgattacttttacaacttttccgcctggaacctgataggctctttcaagactgtcatctttaaaaaccagcttcaaatagcccgcgaaaaacataaagtacaacatcaggtagattacaacagtcaatgacatcgctgcaagaaatgaaagattattccccccgccgcttaatgtaaagacggctgcccagattgttgcaacgatcccatttgcgatcatcaaatgagcaggaacaccgtgtgtgttttcttttgcaaaatattcaggaagtaatccttcttctgctgctacgtgaagtgcttttgaaggagaggttacccaagaagcaatttctccgatgacacctaaacaaacaagaatcgcaagaattttcgcaatccatgcaagatttggatcaatgtgtcttaataggaattctaacgattgaatcacccctgtattaagagacaaaccatgttgaggtactgtagtagcgacggtcaatccgccaaaagtatctaaaatgattgccagaataaccaatacaaacattgctaatggataatcctttttagggttttccatttcatttgcatgactggcagatgtttctacgcccatatatgctaaaataaaggaaacaaaaacaaccagcgtaggcaatttcgaaaaatcaggaatcaatgttttcatagacagtatcgtttgtagtggagcgcctgaagcgacataatggatccctaagccaaacaagactaatgctggcaacaagataccagctacaaaaccgatccgagcaatcaatgaagtgtatttggttccttttaactgtgagagtaaaatagcccagaaaataatcaataggattgccaatttcagatatttattgttttgtatagcaccaatacccgttgcataggataatgcaccagttaagaaatacagcatggtcaagtagccaactgttatctcaaaccattggaaaaagattgcggcaaaaccgaatcgttttcccaatgtgcgactgacccaagtatagacaccgcctttttcccatcctttcaccgttgccatctctgctgcgcacaatgccacagggataaaccatagcaaaccgcctaataacaagaaaaatactaagctgaagcctgaggtcgcgaatgtgggatattcatataatgaaacgaccattgagatggtcatagccaaaaagccaaagaacgttaatttttttgcaggaattttcgttttgctttgttgcatgaatcttcctcttttctatttgaatttgtttcaattgagtttgttgccaaagaagaaaaagtccaatccttcttcttgttcttcttttgtagtagtgatcgttgtaaagtgcatcgccgattttaaaatcactgttgtcagcacataggcatacacggcagtaatgatgacaccaatcacttgaatccctaagaagtaccagctgcttggattcgttagtaaatggctgttagatgcaaagatccctatcagaatcgtacctgtgaatccgcccatgccatgaacaccccacacatcaagtgcatcatcccattgtttctttttacgaaaatcaacagcagcatgacagacgatacccgcaatgatcccaatcagcatggcactttttgcttctacataaccggcacaaggcgtaatggctgccaatccagcaacggatcctgttagtacgtcgacaaaatcaaagccatttccttttacttttgcaatgatcagccaagtaatcatcgcaaatgcaagagcgatgaatgttgaaccaaatgcattgactgcttgttcatctgctcgaagtgcaccaccggaattaaaaccgaaccagccaaaccaaagcagtcctgtaccgatagcagctgccataagactgctatgctgacttctttctcctaaaggaatctttctttgaccaagtgtgaggatacatgctaaagagccgaatccagctgtcgtgtggatgactgctccaccagcgaaatctctaaatcccatctgatccaaaaatccgccaccccatatccagtggcaaacagggaaataaatcagcagattccaaaaaataacaagtataatatagccttttaaattcaatctccctgcaaaagctcctgtcatcaaaggaacggtaatcacgataaacatcagttggtaaagaaagaacattaaaaatggaatcgttgcaccatgaaacatgttggggaagcttgtaacatgtctcatcaaaaagaaatctgccgggtttccaataacaccgccgatatcccgtccaaaggccaatccgaatccaccaaatacccacataatcgttgttatcccaacggagagaaaagattgagacatgatcgttagtatattattcttccgtgctaatccgccgtaaaaaaaagctagaccaggagtcatcaggcaaaccattgctgtacataaaatcatgaatgctgtatctcctgtattgataggtaatgtattcatttttttcgcctcctttctacgattacgagtataaaagaaggtgtagttgtttttttcttctgtttttttgaattaatacttgcatttataaaagacagacaattaataaaagcttgatgtgttgtgctctttttcgtttttcacacaaataaagacaaaaaataaacggtcttctttttatagaaaaccgtttattttcgtctttttttatttttaaagatattttttcataaggaataaagaatacttcatataaaatatataaaaaagaaccgcagcgagtgtcgctacggttctcaaatttgttcttcatttcaacataagtttttcttcaatttgcttataatttacgtgcaaagaatgaaacgactaatactaaaatgattgcaccgatcaatgatggaatgatagccattcctgcaattgttggtccccaagttcctagtaaagcttgtccaattgctgaacctactaaaccagcaatgatgtttgcgatgatccccattgatgatcctttattcgtgattgctcctgcaattgctccaatgataccgccgacgattaatgcccaaataaatcccattttaaattcctcctaactgacttcttacttcttattgtacacgtggttcgttattttctttgactttttgtgcacctttgcctacagcagattttgctttatctgtttggcgtgaagcaaattgtcctgtggattttgctgcttctgttactttgtcttgtactgtttcttgatctttttggtattcttcttgtgttttgatgtctgcaacattcacattcacttcgataacatctaaatgtgtcatattgtttacttcagtactgatcaattctttgatttggttgtaaatatcttcgatgtctttaccgtattctacgatcacatctagatccacagctacttgtttcttacctacttctgtattgatacctgctgttacgttatctgtgttgactaatttttcagccatatttgagaaaaatccgccatctaatgtcaatagaccatctacatctttcaatgcataaccgatgattttttggatgactttgtcttcataagtcaattcaccattcatcatgcggttttctcctttttcatttgccaaaactgatccatttgttgtattcatgtttttgttttccatctttgtttcctcctatgatttaaaaaattgatcaactattcctgactgtttcaaataaaaaccgattcctgcgccaattgctgtcatgattatgatcaacaatgtcttgaaaaatccaatcgttaaccataaaacagctagcagtagtccaagacccccaaagataatagggagcttgtatgctgaaaatagttctttcattatttggccctcctattccactcgagagtgcttgtagtctcttgtatcttcttgttcttcataaccgctgtatgtgactgccactttgaccgtttcttttgttccgagtactttagttacttcttcttcgatatcttgcatcaatacacctgttttccctactaatgaagaagttcgtttcaagtctccgttgacatggatatggattcgatttttcgttgaacgtatccgtactttaggtgaatgaatgaactcttcttcgtgtaaatgggaacgtaccaacccttcgatcgcttttttgtcgattgttagtttgccatcttcccgtttcataacgaaagttcctcttgactttggatagaaaagaacgactagcaagatgataatagcaagaacggcaaatactacagctgcccagaaaatatattgttgcatgtagtaattcgttaaagtaaagaagcgaaatcgttccaattgttcaggcataatatacggcgcattgatcaacgcaatcgctagaaatactgaaagtagcagtaaactcatgataacaccgattatttttaaccccttattcattttccacctcctataaacttatttttaccctgtaaataactctaccgacaatcacagtatagatagcgaacagttagcatagcatcagtaaataaagcgctaccaaacattgctggatcataacggcgttttattgccagtctgatactgaaataacaattgcttacttattctctatttacttttgattgctggctatacttaaaggatattattcaagattaaaaattgcaaagattatgctcagttattattacaagattctatttatttattaaattttttcggagaattaaaaaatacaataaataactttagttactttaatgcgttcttactttatttttatattatcatttttcttattcacttctttggtttatactattcttataaataaaaatgaggtatgtcctatgatgaaaagattgtactattcattgatcataacgattggctatttgattgtatcaaatctaggaaatatggtatttggtatcagtaaagaattcagttggactactacattatgggaatctctattctttttcatcttcgtatttttgttacaaaattatcgaaaaaaataaacatgtgccatctatctgttggcacatgttttaggatttatggtactttttattcggcaatccattttatttttctacttcttcttaatacctctaacacttttgatttataaactaatccaatgcatctacttgcgcttattaagctatttcagctagatagtaccaccccatgcgtcaatgcttgattttccttttgtataacattgtataagcaataaaggacaaataagtggtgattacaccaaaccattgaataagaaaaattctgatacgtaaataaacatgaacttgaaaaaattaatgaatcggttagctactacgtagttgtcttttttctcatacagttctgttaacttacacttctcttcgctagataataaaaaatcctccaactgtattgtccaatataatcccaggcatctaaactagcattatagaagagacacacatagaatctaaaataactggttttaaatgtttcttacaatcaaaaaaagctgttaaatgcactccacaccttcatactctatcattttttataaacgatatatttttattgtttttcgataaaaaatagttgttttacaataattattctgctatattttagctatcaaagataaaagagggataaaaatgaaatttaaaacattgctattaaaatttgtcgttttaggtataagtgccgtatttattttgttcggcgtacttttttatactcagatcgctacaagcgaaaaaggattcaattttgattggcagaccacattatttgtttctgtcatttactttgcccttctcctagggatcgttattgcttatttcttattgaaactattgaaaaaaatcgaagataaccaagctttttccactcaaagcttaaacatactaaaaaaaatcgaacgaaccattttgtttattggtttcgccttttttggcttacttcctaaatttatgaaagtagcggatttagacgatgctccaggtttgatgttggtaggaatcgctgtcgtattcattccttttgcagtatacacattaacaagcgtgctggaaaaactgcttgaacatgcgattttacttaagacagatcatgatttgacagtgtgaggtgcgacatggcaattatcgttaatttagatgtagtattagctcaaaaaaaaatgagtgtgactgaattgagtgagaaagtgggcattacgatggcaaacatctctattctaaaaaatggaaaagcaaaagccatccgtttttccactctcgaaaaaatctgccaagttttggagtgtcaaccaggtgatttgttgacctataaaaatgactcgaatactataccagaagaataaaataaagtagaacaaacagtaaataaaaaataatctgaatgatagatgtgtgagacttttagaagttatttacgtctattattcagattttttatttcgattgaataccgttttatctataaataagatatgtactgactcatacaaagggggccttttcttctccatgtactatcacttttcctgatacaactggtttcctgttacgttgtagttggatctgcttttagtataatactttattcattccaccagactgatagcagtttgagcagtctaaataatcatgtagtattacaggccattctgtttcataccttgaagtgcttaaaacttcagctaatggcccattgtgttaactcttactccattcttttttagtaagctcccatatatactgtaaagccttctatatattatgtcatgttgctttttaacatttactatgtagttttgataaaatgatttgaataacagtgatggacaattcttttttatttttaacattattttgataataatgattatttatttaaaaatacattagataacatttgttacgacacgaaaaagcttcacaaacaaatatcgttattttaaaatgagggcgaactcacacaattaggaggaatagtatgccatttattgtttacttttttctttcattactcgtgatctatattccattaccaacatttttcctgctcgtcaatcgtctagcagagcaacatgatacgattgctgctcttacgaaactttgtttacttctatttgtttgtctagattactttacgagctattattggctaaaacagacaagagtaaaaaagagatattatttcttccttgtctttttcaatctctttgagtttctgatccattgctttttacttcatcagtatcatacgatccatttgtggatcatctgggttttcaaagtggtcgtattattttgtatgttcacctttcctatctcaagaaaatttagggaggcattgttttattaaagaagcttctctgtatcaataaagacacatttaaggaaaaacttttaaaaatctaattgggaatttgcccgcataaataagaggctgtgacaaaagtcttgtcacagcctcttattccgtataaacagtgttcaaaagcttgcatcttcgataatatgcccaaccaaatgaaaaatatgagaagctatttttgtttggctgttcttattacttgatgaagaacagctttttcacgacctctttttaaaagtctttttacagttttcgagcaaagaatgatacgattagtactaaaatgatggcaccaatcaatgatggcacgattgccattcctgcaatacttggtccccaagaacctaataatgcttgaccaagtgctgatccaactaaacctgctacgacatttgcaataatccccatcgaagaacctttattcgtgattgctcctgcaattgctccgataattcctccgacgataagtgaccaaataaatcccatgtttcgttcctcctaatgttttacttccttattactgaacccgtggttctgtattttcttttactttttgtgcgccgcttccagctgctgattttactttatctgtttgattcgaagcaaattcaccggtttttttcgctgcgtcagttactttgtcttgcaccgtttcttgatctttttcaaattcttcttttgttttgatgtccactacgttagcgttgacttcgatcacttctaaatgtgtcatattttttacttctttgccgattacttcttgcatttcttcaaagattttttcgatatctttgccatattccacaatgacatccatatcaactgctacttgttttttaccgacttctgtttcgatcccagccgttacattatctgtattcacaagttttcctgccacattagagaagaaaccaccgtttgcagataataaaccgtctacttgttcaattgcgattccgatgattttttgcacaactttatcttcataattcagctcaccgcgcattgaatcttcctgttcagaatcatgctttccttggttatttgtatgatcagaaccaagttttccttgtccgtttgtgtggtcagaactaagtttttcttgtgctttcgcatggtcagaaggatgtttttgctcttccacaggtttagaaggatcgattgcatcatgttgttctggaactttagattctggagttcctggatgatgaggtgcatgcttttctgcatcatgtttcttctcttctactccttgttgaacgttagggactactggatctggatgtgcagatactggtgctgttttgttcttttcatcgttcacaccatttgattggtttggtgtcgttgggtctggatgtgcagacactggtttttggttgttcattttattgttattatttttgttattgttattcatggatgtttcctcctaagatttaaaatagtgatctaagattttcgtttgtttcagataaaaaccgatagcgacgccgatcgctgccatgatcaagatcaataaggtcttgaaaaagcccacggtgatccataaaacggctaatatcaatccaagtaccccaaagatgatagggagcttgtatgtcgaaaatagttctttcatttttggtccccccctattctactcgtttgcggtcattgcttcgtttagctggttcttcaaagcctgtgtatttcaccgatactttcactggctcttttgttcccaatatgtgttgtacttcattttcgatttctttcatcaatgttcctgttttaccaatgagtgctgaagttcgtttcaactccccttttacattgacggcgatcttgtttttcgttgctttgacatttacttttggtgaatggatgaattcatcttcatgcaagtgagaacgaaccattccttcaattgcttttttatccaacgtcaactccccatcaccatgtttcagtagaaagtttccgattgtttttggataaaacaggaaaacaagtaacgtgataattgtcaaaatagcaaatgcaacggcaagccaaaatacatattgttgcacgtatgaattagtgatggaaaagaatcgaaacttctctagctgaaaaggcaatggataggttgcacttaatagtatcgcaaacaaaagcacagatagcaaaagtaatgttccgatcactccgatcgtttttacacctttattcattttcgcacctcctcataggggtgaaacgatcaacttcttataagttgatcgcttctccaccagttactccgtaaatttgggctgtaacataacttgctttattcgatgctaagaaaacataaactggtgctaattctcctggctgacctgcacgttctagtaaactttgctgaccaaattcagggatcgaatcagaaggttgtccttcgtctagttgtaatggtgtccagattggaccaggtgctacaccatttacacggattcctttaggtgcaagctgttttgctaaaccgatcgtaaagttagcgattgaagcttttgttgctgcgtaatctaataaatgttcgcttggattgaatgcttgaacagaagttgttgttacgattgctcctcctgctgggatatgcggaacagcttctttcactaaagcaaacatagcgatgatgtttatcataaatgtgtctttgacttgctcaagtggtaactcagcaatagactgacaagaaatttgctgtcctgcgtttagtaccatcgtatctagcccgccaagttcactcacggctttatctatgatttctttaggtgcttgttcgtcacgaagatcaaaaggtagtaagacaatcttacgtcctgcatctttcacgtattttgctacttcctctgcatctttttcttctcctgggaagaattgaagagcgatatctgccccttctctagcaaatgcaatcgctgctgcacgaccgatccctgaatctccaccagtgattagtacacggcggttttctagttgattattgccttcataggattcttctccacaatcaggaacaggaatcatattctgctgtaaagctggtgtatcctgatcttgtttaggaaatttctccgtatggtacaagtttcgcgggtcgattaattttggttctgtcattgctgtattcctcctagtttttaaattgtattgccaaaacaaatttctttgtttgatacctgttttaaatagattctttaatttgtataatctttccggtataaatggtaacctaaaactactgctgctatcaaagagccaaagactacgagtataaagcctagagcagaacttttacccggtaatcctcctgtattcattccccaaatccctgcgaacaacgccggaacggaaatgattaatgcagctgaatctagatatttcatgatatgatttagattattgtccatcatcccgttgaatagatcaccaatactctctaataaatctcgatagatctcgatcattttttctgtttgtcgctgtctcaaatggacatcatagagtagctgttcatcgtctaaacgtttgatgaaagtttcagaattccataattgatccattgtttcccgttgatctcttaaggtatgatcgatatatacgatgtctctttcaagatctgcctgtttatacagttcttcattttccgttgttttacgagctgctttatccaaagcgtcaattcgctttttcatctctcttagttctttcacgtaatgggtgtaaatatctaataatgtatacgtgatgatcttttcaaacgagtttaaatgatttccatgctttgtcagcagccgatccacaaattcggtttttctatcgatacaagtaatcaagagattatcggaaagtacaaaagatattggcgttaattttttttcgatacgattatctgactgatctagattaatcactaccaaagaaaatggatgctctagtttcgtctcataaaggcgctccatccgagaaacttcttccggatattcggttcctacgaaaatatcatcaggaagctcgaattcttcgattgcttgctcaatctcttcgggctttgcactatcaagtacgagccaattatattttttttcatctgtttctattacattcttttcttcatccacaaagtagtatctcaatgtatacctcctttttggactttctcgaaactattagctgaagaagcagttctttaatttgatattataatcgagtactgcgatttcattttctaatgaaaagctgtcaagctgtttgttgaagtccatgttcaatcgtttaccgaaataattttgctctaatttagatgtatagatgtccaataatggatgctcgattttagtcgcatattctccaaattccgaaacaaaaggaatgatttgaaaaaagctgccttttgcaaaagcacctttgtcccttagaaatggatcggaatcattgataagcgcgagtgcgatttttgtattttccccaaccttttcaattaacgtctctactgcatttttagacattgtaatttccattcctactccccctcttcagttgttgtcttctattatttaacaactacatctgtttttggttgaacttttgcatattttggatatttagggaatttagctacacaacggaaagccgtcatccctgcatatttttcgtaatatttcttcgttggcccttcaaaatccttgctccacggtttcacatgtcctgaaaaatggataatgtaaggattgttgcgagtttcttcgtattcacgttcacctgctgctgttggatgtttttttgcttttgccatgatatagccttgtgcattccaacgcggatgaagtggtaaccaacggtcatgtaagatagcatttaatgcatcttggtcatggaatcgtaatttttctggattatgttcgatgaaatctaatactttttgcgtaatattttcatctaaccattttttcacattgatcagcatcaaacctgagttgaaataacgcattgatttagctgaaattttcattttttccagtcgttgatggaacccagcgtcttcaacagctgctacgattgaatcaccgaagtcaagacgccataatttagagatatcttgtaaagcgatcatgtcgcaatccatatataagatacgttcaacttctgtgccgcggaacaattccggaatcgcaatacgataataagctgtttctggaatacgatcgctgattaccacatttgtaaagaattctttattgattttcaagaattccacatctgagttcattcgtgcgtttttcactgagaagcgtaaaagctgtttactttcaaaatcgatatcatcgtcaatcacatagaaccgaacaaatttagacgggttgcaattatctaatactgagacaaataatgcagctaaatgtggtacgaattttgtgttacaacttgcgactactgctatttcttttttattcattgatctcgcctactttcgttagagtactgtgtgctaatttttttaagtataaattggtatacggatgatctttcaacgtattccaaggtttatcatgtcctgtaaagtgaacgatcgaaggtttttcatttccttctttatactgacgttcatatttttcatttggtgctggatgacgttcaaaaatcagcgaagtctgcatgttccattttggatgaagttgttcccaatcttcataaagtacagcattcaaagcatcttggtcgtgatagatgattcgatcgccattttcactgaggtaatggatagttttttctgtaatttcttttttattccattgatcaatgtcaatcaccatcactcctgaattgaagtacaagtcatcggaatcgattcctaatctttccaaagctttcacttggcctggatcgataatagcgccgattgtttttccatttaacggctcatcatatagttttacgatatcgtctagtactaacacatctgaatctaagtaaaggactttcttataatcctctttagctaataagtttggtaaagaaattcttaagtaagcggtagttgtgatatggtcactgactaggaagtcttcgtagatatctttttccactgtcaggaattggatacttgcattacttgaatatttatttaccgtttcttccaatccttctttactatattctgatagaccatcgtcaatcacataaaattttatgcgtcttgttttattgcaattttctaatgcagttgcgatcatcacgctcaagtaaggagcataattttcgtctgaagcagttaccacaggaactacgccgtatctcttctccatcaaaatcactcctttttctaatctttttctaacctgttctacatctagaatattcctcatttggttttaaagcaaaatatatgctttgttttcattgaatattttaaaatttttttatcacaaaacgcatcggtaagcgctaactattcgtttttcatggctttttattcaaaggtattgaccaaaaactactatatatagccacctttttcttaagaatgttttttgaaaaaattcataatgacaaagcaagttagtttcatttttttaaattctcatttaatcttaaggtaacaggaaaatagatatgtaaaaagaaagtaggaagataaaatgaaactagcagcgattgatttagacggtaccttgcttgatcgaaatggaaagataccagaagaaaatatccaagcacttcggaaatttgatgaaaatggcggaatcgtaaccgtcgctaccggaaggaacagcatttctgctaaagatattttttccgaattaggaatcggtggctatttgatttcttccaatggttcactgattgctgaaatgaaggatggaaaaatggcgaaagttctcagacgttcaaaaatagatagcgatacactgagaaaagccttcttctatgctcaagaagcgaaaatatccatcattgctagccgagaaacccaagatgatcagctgacattcgatgaatcaaatctagtcaaagatgacccttattatgaacatttcaatttacagaaccattcttttgatcaaattttaaatatgttggaagatccttctcttagctatcttaaattagcattaacagataagagtgaagaaaaactacagaagctacaaagagatctgcaagcagatggtatccaatcagtattctctgatccgcatttcttagaaatcacgcctacaggtatcactaaagctcattcacttgtttttctggcggattaccttggaatcgaatcgagtgacatcatggcttttggcgatcaagaaaacgacattgctatgttgaattacagcgggttgagtattgcgatggggaatgcacagcgacaagtaaaagaaattgcaaaccaagtaacactgacgaatgaagaagctggtgttgcttatattttaaaaaacttctattaaaaagaataaaatgacgatatgaatgtaggaggaaagaaaatgttagttattattgatatgcaaaatcatattcttgatccaaacagcgaattttatattccagagtcagatcaattggcagaacgtattgctcaaagattagctaaagcacgccaaaataatgaatatattctcttcacacgggatataccagttgaactgaaggacaaagaagaagaacgagaagatttgcaattgatccctcttctttctccacaagaaaatgaacgagtgattaaaaagtattactttacgattccacctgaaactttagctgaaatccaggaaactttatttgaaagcaaagaagaacaaaaagagatcgaagtagtcgggattgaaacaaacttgtgtgtactctctaatctgataggcctgcagagtgcttttcctgaagcagacttttttgttgatccaatgttagtctccagtagaaaacacggagaatccgctttagagctgttgaaagatttcaacgtctctatcgtcgaatcataaaaatatctatcttcatttacgatatttaacacacaataaaaaaagcacgcagaactgttttagtcctacgtgctttttctatcaaagtagattggcttttttatgacacagagtgaaacggcaggctcacgacctctttcttaaatggtgttcaatcagctgaccctcggtattagcttaacaaacggcaaaatatgaggaactatttttccgtttgttaagctaatactcaggtcaaaacgctgatttcacaacctcttccttaaacggtattcaaaagcttgcatctgcagtaataagaacagccaagtaaaaacataagaagctgtttttacttggctgttcttattacttgatgcagggcagctttttcacaacctcttatgtaccttgtaggactcgaacctacgaccggacggttatgagccgtctgctctaaccaactgagctaaaggtacatcataaataaaatttatttttgttacttttcaactatagcacgaatgacaaactctcacaagtttcaaaatataagtaaaataatattgttattcttatttcttttacttgtgtcataactattttgttactttaatttttatttgcttattttagaaaaaatgttattcttttatttattctcaatgttaggagtgattattttgccatttattgcgattttattcgatttagttgcggcagcagcttattttctccaattaaattatcaaacctcaggaattctgtttattggaatgatttttcaaggtgtgattacccttttgcttcttgtcatgatgctcagctataaaggaaaaagatatgcccgtattcaaacaaaagtatttgttaaatatgtttccattcgctatgggatcatcattctttcctttttagtgaatgcgatcgtcctctttttatatgtattgaattacttagatatcaatccattgattttttctcgatagataagacacattcagcggaacagttcctgcttatcagcagaaaactgttctgctttttcatttttcattgatctattcttcttttattttcctagcatttcatttgtgatgtatgcaataacatgttatcttttattatatgaatcgttgaggagtccgttacatgattacgttggtgagagttttgttttgggtgcctgcggtcgcactggtcgcaagtattgtttatcttatgaattggaacaaagaacggttttatttagctattttgactcttccggctatctactttatgtggaaagtttttaattacaactactttgaacccgatagtgtttttatagaagaattatcaggactggttttgtctttattgatcgtcattctttatttgatacgtttaaataaaaaacattgagtactattgattgcatgtgtagctttctatagtcattataactattctactataatgaaaggtgattaaatgagtatcgaagaagctattttactggatactttacgttgtcgtctgaatttcttaagaactggccgatctttatctcaagtagctgtttctagcgcgttaagtattcctttattcaaatatcgtaagtacgaagaaggagaagaaattccaagcatcattgaattaatctatatcgctgacttttacgatatttccgttgattacctaattggtcgctcagaaacagcaagcaaactgaagtgattttttccagccttggtgctggttttttcatttaacgtctaaggttaacaatctatatataaaggagacatttctatgcgattatggcatgaaaaattgatttcaaagcttcctcgtcaacagcttttaggacaacatcgggaatgctgtgcattaagaggaaatggctggggaaagaaacatgctactgtggattatgtttttcactattctccttatagattattccaatatcatcagcttgtcatggatgaaatggaaaaacgtggttacagcccagcaccagagtggaaaaatcctatgtatcgtggcaaatcatgcgaagcattttttgatttacctactgtagagcgcaacgtgccgatttatccggaacacgatgaagtttatctagcagaatgtttagcaaatttggagcaaaaaggaatttatcttacctaatataactagaaaagccttctatctcctcttacttcattaaaaagctttaaccatcttagatcaagctaaaatgtcgtaagttttagggttatcttcatcctcacgtgcaaaactaaaagcgtactctagttttggttcatcgccaacttccctagacataaatgaacatctcctgacgtggtttaaaagtaccgcatcttcgacgtctgtatacgatgcacagcacagattgcttcttttgatctttcttttgatttttctgttgcttcttctacaccttcttcgattactacatcgatgcttacaattgcttctgcctaatattcccatgcatcgtcgatttaagcctctgtagtcactgtgatcgtttccacattttaactcctctgtcgtggcttcagttgattttgtgatcagttcagttgctaagccagagtcagaacaacctgccattgctagcgttaatattgatagtaaaaatagtttttttatcataaggttccccccctgaaaatagactaaaataataacgctttctttttttgttttcagacgaaaattaataatttctaaatattctttaaaaaagcttataactattatgccttttttaatatataacacagttatttttaaaaataagaatgctaaatcactctacaataacggcgaaagcacaaaaaataaaaaaattattacgttattaaaaaaacagatgaaagatcaggttttattagatctcattctttcatcacttgaagggatttaatgaactactttttcctctttgtcgtttttatatattcgtattccttcaaacagtaggatagcctctttcaatgcttgatatttgaactgtccgttacttaaaaatttagatgtgccgccctcttcctagaacatattcttttttactttttcattaattgacagaccaatcgaacgaaactgtaaatttcgataggataatgattggtcaaactcattcattttcaagacatctcgattcatattcaagataggaatctttttatcaacatcactttattcgtattttcctctaccataaaagcttcacgctccacaaaattgttttatacactactattcagcccattcaacgaccaatgaattttttcgtacaaaaaaaccgtcttttctttcgaaaagacggttaaaagtcaatttttattaagctttaacaatgtttgttgcttgagggccacgttgaccatcttcaacatcgtaagacactgcttggccttcttctaaagttttgaagccgtcaccttggatagctgaaaaatgtgcaaatacatcatttccatcttcaccagtgataaagccaaaacctttgtctgcgttgaaccattttactgtaccgttattcataaataaattcctcctgatacgtatcaatgtacgttttttcgttgcaataaatatttgataggcaaaaggagttttatctatgtagatatatcgctcaaattacgtttcaaaatagattactcatttaatatatcatgctttttctaataacacaaggataatgcaatgaaatataaaattcattgtcttctattgtcttcgaatcgaagaaaaagttgaataaccgcgattgattcactttttgttttcttgtttatttgcttttatctgcaacttttgactttaaaatttcttaactatgaaaacctttcaattggtggtatacttataaatggaatttcgttatcaacgcgttcgttgcctttcagcaagtatttaaagaaaggagaatggctatgacattctataacaaagatatacaatatcgagtaaccttggatacagatttgaatctatttgtcgtttttgacaaagaaaataccaatcatgtagcgacaggtgttacgatcgaacaagcagtgcaagaattaaaaaaatctgcataaggagtggaaaccctcatatggacgattctcgttcttctctttaaacgcatctactggtagataacagtagatgcgttttgtgtttgttctaaattgttcactacaaataaggtagatacttcaaaataaaaaattacttctttttcatctgttccctcagtcgtgcaggacaataaataaagaggactagaaaatagtcctctttattagagatacaaccctttactttctaaaaatcgttttgcttgatgcaggtcataaaattcatagtctgctttattggattcatataaacttacatctactttcaacttatgcttcccattatgatcgggcaaccctatcaaatgatctttgatgagaaaagacaaaatgcccgctcgccttgctgcttcgatccctgcaatcgagtcttcaaatacaagtgcttcacttggaggaatattcatttttgaacaagctttcaaaaagatctctggttccggctttcctttttttacatcatcccctgaaatgatttgatcaaacaaggcatatagattttccatttttaaatacatttctacttttacccgtgtattagacgaagccacgattgtatggattcctctttcttttgcaaaagataaaatttcttctgctccttttttcgtatatactctcttatcttctttcacgattttttctttatattgattgattgcttctcgccatttgatatatggaacatcttctccgtacaaaatgcccatttgttctcttatcgccatttctgtttggccagttagtaaataatagacttccttacgcatttcataatcatacttttgtgctgattttacataagcacgataagctaaacgtccagtttctaataaaaggccatccatatcaaagatgaagagcttgattttattcataatgctctcccagtggtttttccttacttatcgcctcatatagaccttgcatgtaagtgagtcccattgcacgatcatacaggccatatccaggcatagccacttcaccccacacggttctaccatgatcagggcgtataggaccgtcgaacccttcttgcaccaacgctttcataatatgatacatatcaagggagccttctgtagagggatgtgccgtttctttgaactttctttctcctaaaaactccacgtttctgaagtggacaaaatggatgcgcgaacctacctcatggatgatttcaactaaatcgttttccggatttgcccctaaagatcctgtgcacagcgttagtccattatatggagaatctactgcatttagaattttcttcaagtcgccaagatttttcgtcactctaggaaaaccaaaaagttcccatggcggatcatctggatggatagccatttttacatctgctttttcgcacactggaatcactttttctaaaaaataagtcagattttcaaataattcttcttcggtcattccttcatacagtttttccagctgagcgaattttttcaaccgttcttcttcccaacccggcaatttgaatccctttgactggctgtgtatcaattgatacatttctcctggctccatctgatcgacgattttctgatcgtataaaagagaatagcttccatcgttgttttcattaaacaaatcagttttcgcccatccaaaaattggtttgaagctataacaaatcaatcgaaccccacatcgagacaagtttttgattgttcgtatatagttatcaatatagtaatctcgttcatctgtccctgccttgattgcatcgtggatcgctacactttcaattccaagcagttccagtccttggctctcaacagatgctttcaactcctcaatttctgaaatctcccaaacatctccaggcattttagtcagcaaagttccaattatcccatttattcccggtatttggcgaacatattttaatgggatcgaatcccctttttcaccataccatctaaatccccacttcatcttttcagccttccttctaaaaatcgtcctcatctaattttttttcttccgctgaagcatgccaaacagttaaattatcttttccttgtttgacaatttgttccaccgcttcttctatcggtgtgtgaagcatctgatgattgattgcttctaacaacattggcagattcacgccccctatgacataagtggctgctttcttttcttcagtcagttcattgactgccaagagcgcttgattgtacggacttgcgctaattagatcaacaaatactagcatgggttctgctgtgttgatcatagttaatttttctttgaccttctctccgaatgtttggatgtcctccccagactctaagcacattgtttcaatatggctcgatgtcccgacaattacttccgccgcatctttcagtccttcgctcaacttaccatgtgtaacgatcatgatttccaacattagtcttctcactccttgttttgcactttttacttatcgaaaaagagcaataatctgattggcattttgccaattaaatgttttccctcgtaaatctgttttggtcaaatagaagaactgcgcttgcttttttcttgcactaaaaatataattgacgtttttttctttcaacttatcaacttgtttcagccactgttctttatttgaaaaataatttcccgaaaactgtagcggtgtatctgccccaacagagtctagataaaaaagaatagcctcttttttcatacccgatctcacgctgtctaagcccttttctccataacagccttcatcaacaaacgcatacgctacactcggatcatcaatcgtacggatcatttctagcatcgttaatatggatgaagtatttcgaataaaagtttgtctgctaggccatccgcgagctgcttttcccaataagaaaaagtagctcccaaatgctagtacagtgatacctgtttatacggatagcagatcgaatacgtgatgaggatttttgttatatatcatcattccccaccaacctaaactgaacaacaaaatgaaggacaataatatagagtagattgtttttttcctttggtctttccaatcaaacatgaaataacttcctaatgcatgaacgggtgtatcgtaataagtacagataactttctctgctttttcgatatctccaacataaatattttttgatcggtaggctagcgtatcgtaagcaatgactgtcacatctgttctcatactgtaaatatctgatactaatgctgaaagaaaacgctgtttactcttttttgtacggcgcttacggtaaatatagcgataacgaaattcccaatcacgaaacagctcgttcttcttcattttttcgccctctttatcttttttctaagcatttgtttatgacaaatcaaacttgttcaatacatcttttaatcctgttttaggtgcagatggagtggcttgaaaataaatattctttacgccatattgttcattcatttctttcaatttttcagcatctgatttatttaaataaacagatttcgtcactaaaagatctgtatcaggatttttttgagcaatccctccaatattcaattcttccatggggattccgtgttttactaagtcgtaaatcgtttggactgtttttgcgatcaaaatacaattgtattctttaaattgatattcatcccaatagaatttagctttctctggtgtaatgacaattgttttttgtcctgtacggcttcctgcatttttgtaaagatctctcataaatttatcttttgctacaacttcgtctacaacaaaaatggaattcactccacttttttgagataacgttaccattacttgcccatggatcaaacgctcatccacacgcgctaaattgactacacccatcttattcacgttcccttctttttataaaataccgattcctgctagcacaattaatattccagtcagccataataatgcttgtgtgactttcaatccttttttcgtatagaacaagtacacacccattacgacagctaaaggtaatatccctggcacgatttgatcaagaatttcctggataacaaactcacgtccggatatcgcaaatttcaatgaagattctacttttacatagtttcccgcaagcacccccatcataaacaaccctaaaactgatagcatttcaatcgctgtctgaacaccagtgttttgcattaggcctgtagcattacggcccatagtgaaagcttgtcttgcgaaaaatacccctagtaaaacctgatacaacccaaagcagataaaaggaaaaagtgcgcctaaaggacttccctgttgtgcccaaggtaccgcgattgcgataaaaatatattggacggttcctgaatcgattgcatctccgattcctgctagtgcccccatcaatcccgctttcgtgttatacatcaagtcatcctgcatcaagatctctttttcttcatactcttcttctgctctttgctgttccatagaagacattaggccagtaatcacaccgccaccccagcttaattgagtgttgaagaacagtaactgccgtttatatgctgcttttaaagagtcttcatctttataaagttttttcaagattggcatcattccgtatagtagtgatggcgccaagtaacgttcaaaagagtgaggaatttcgtttgcaaaatgccatctcagataggcttttgttacatcttttttcgtgatttcttcaggagcacctgtttgattatccattatttcagccatttcccattcctcctaaattaaaatccgtcatcatagtcatcttcgtcatcaaaagatgctgaattgttattgcttgtggcaggctgtacttgtttccctttttgcgactggacaaagatcaaagcgataataatcccaaaaatggcataagtaaccatcgtaatatctaaagatttcaaaacaacactcataaaataagcaaggaagaaaaagaccagataatcttttcgaccgataacgtatacagttgtcgcgataccgattgccgctaaccctccacctactacttcaagaatgtggataacgactgttccctctaaagctttgattacatcagcgatcaatggcgcccctaaatataaagcaatgaaaacaagcggaacgaataataaaaatgaggcaaccgttggataaagaataattgatcgggccatagcttttgtattcaaatcttctacagctttgtctgtatatttacctaaaaaagtattgatgaaaaaacgaaactgatacaagtaacttccgagcaatccgactggcaccgcaacggcaatcgctgcttctggcgacagatcccctaataatgcgactggtactgcgatagctgctgcaatagatggttcagctggcattgatcctcctggagaaaaaacccccatataaatcatttgcaaagcggctgtaacaatcatcgcttgtgcaacttcccccatgatcaacccgacgactaatccagtcatcaaaggagaaaaacgtaaggtcaacgtggctcctccacctaaccagcgggacataaccgcggctacccataaagcaatcaacaaactttgtactacacttaatgtttccatgtgtcctcctccttcagatctttctgatataaccttccagttccatcattgactgtatcagtgatttctgtgttacctctataggaatcaaatgcactttctctttcgaatcaataaattcagccattttatctattatctgtttatctttcggaaataatcccatttgttctagagaaaccggcagttctaattcccgatacaaaggatataactcgtctattttttcccagcgaccttctagtgccagttgatagaaaatcccatacgctactttttctccatgtagaaaacgatggctttccggaatatatttactgatagcgtcatgcatagcatgtgctgccgcatttcttgcgtatttatctcctaatcctccaactaaaccagcaacagcaaagataatctctgaaagctgtttgaactccgatgtcagttttctttgtgccatatcttggattgctttagcagaatgattcaaaatctcttctttgcagatcttcgcagtatcttgtgctagcttcaaaaatgattcatcttgcaaaaaatcttgttctaagatgagctcagattcataccattttgctagtgtatctgctaacccggcaatgaaatatggaacaggggaatcaatcactaattggggatctgttataaaaaaagcagcttgtctgtaaaagtgttctgttttcccttctgcttgtccattctccttatacatgacagcaagaggtgtccatggagcacaattactagctaaagtagggatgactccgaaatcgattcttgcaagattggcactataacccactagatcggtcagttttcctccgccaacgccaactacgaaatcgatttcatttttttgatgattgtagctattcgtctggcttcagcataactacattctccagaataacgatgataaaaaaattgaatcgtttcgtcattcaaaaatactaatttaggtagcgccttttcccatgataccgttccgtgggtgaccagtactcttttcgcgccgtatgatttcaagagatcagaaacttttgaaataccaccttcttcatataaataaaattgagggcctgttttcacttttaaaccgttcaccattttcttcatcatccttttatatagttgctctttgtctggacagaacgttcaggaagaaggtgctgactgatctgttcgacatctctgacacatttttcacccattgcttctaaacattcccttgtgtaggccgatatatgtggcgtaatcactacttgttcaaacgctaaatacggatgatcttgacgtcccggttcttcttctaaaacatctgtggcatatcctgcgatctttccgcttttcagaccattaatcatcgcttcttcatcaactagagcgcctcttgcactattagatagataaacattttctttcatctgatcgacttctttatcagaaatcatgtgatagttctcttctgtcaaattcgcacataaacaaatgatatctgattgttccagtaattcttgaagttctactttttttgcaccaaagctttcgatgtataaatctgatttgtaaggatcataagctagaacatcacagcgaaaaccgttacgcaaaatttcgattactccgcttccggtatttcctgcaccaatcacaccaactgttttgttaaacagcgtcctaccgacgaactccgcccgatcttcccatcgatcgtccttgactcttgcttgtgcttgtgtcgtgcgtcgaagcatggacaacaaattagttatattattttctgctacagcatttcgttcaactaaagcaggtatgatagatacgattgtctggtgttcttttgctgcttttaaatcaatattgttgtaaccaataccatgtcgggaaatcaatagcagttcatctttgttttcaaaaaaatctcgtcgaaaaaatggcgtaacacttgcaataatgatattgaatcctttaagtaactccgctagttcttttcctggaatctcttgatcaacagtaaagaaatgaacgtctccaactgactttaatctttccaagtggtgtggaaagactcttccgaaactgctggaattaacgattgctatatgataatctggcattttactcacccttttcaactatttcatgtccgccaaacccatttcttagtgctgaaactacttttgctgaaaaactatcttcttcctgtgaaagattcctcatgaacaaactagttgcaattactggaactggaacagccatttctagcgctgtttcaaccgtccattttgcttcacctgatgcagaaacgattccccgataattacttaaattgggatgttcgtttaactgatcttccatgatttccatcagccagccgcgaatcaccgaaccatgattccaaacacgtgcgacttgttccaagtcaaaagcatactcacttttttgtacaagttggaatccttcaccgattgcttgcatcattccatattcgattccattatggatcattttcaagaagtgtccgcttccggatgcaccagcatacagatatcctctttcaattgctacatctttgaataattgttccacggatagaaaagtttctttatctcctccaatcattaagcaggcttgatgtcgtgctccttcgattcctccagaagtcccacaatccaagtaaccgatttcatttttctgaaactcttctgctcgacggattgaatctttataataagagtttccgccttcaataataatgtctcctggtccgagttttggaaaaagttttcttaacatgttttcggttatctctccagcaggaagcattaaccagatgatttttttctgctcaaaagtagctagaaattcagagatctcttgataagcaggaatgtcattttctcttgcctgactaacagctgtacttgaaatgtcgagtccttgtactttgtgatggtgctcttttaagtttaaagctaaattcaatcccatttttcccaaaccaattacaccaatttccatgatagcgcctccatttcttataccctcattatacaaaaaaatttttttgtaaatagattttacaaaaatattttttgtttgattttttcctactctccttgtatctttaacattaatgagaacggaaaaaatgataatcttattatgaaaatgaggaattctcatgagcgtctccataagactacaaatcaaaacaatgtacaacgacttcagcccaaaagaacaggctatcgccgattatattttagaaaatccaagcaaagtaagtcatagtcctattagcaatttagcaagtgaactgggcattgctgactctactttttttcaatttacaaaaaaacttggttataatggatttaaagattttaaaatggccatgttgatccaagaaaatgatctatctgctatttctatccacgaaaatattcagaaaacagatactgagctcactatggcgcaaaaggtgttcgagtctagtatttcaactttaaatgacacaaaaaagttgttacaacaaaaggatctaaaaaaagcggctactattatcaatgaatctaaacgtgtctattttttcggtgttggcggttcagagattgtagcaactgacgcttatcataaatttttgcgttcccctatcgcaacttctcacagcacggattaccatattcaattgatggaagcttctttattgacggaaaaagactgtgctgttttgatttctcacacagggcaatcaaaagaaacaatccatattgctgaaaccgtaagaaaaactggagcaaaaacaatcgttattactagccaagctaattcttcccttgctaaacttggcgatgtcgtttttatttctatttctgaagaaacagaattccgatctgaagctttagcttcccgtatttctcaactaagcattttggactctctatatgtgattttgatgttttacaacgaaaaagaatcacgtcgttctatcgctaaagttcgacatactatttctgaaatcaaagaatagcaccataacagaaaaagcgaaaaatccataaaacaaaaaaagccactaccaaatatttggtagtggcttttttggttctgcaagggtggtacagaacatcaatagtcggtgggttagaacgtatgtcatcgcatctttggagaaggttgtattggtattattcgagttacttgttagatgcgataacaaagttagtatacagtagtaaaaaatttatcttttcttttttttattatttttgtttcttattttctaaaaaattaaaaaaaattttggtgaattaagtatttccttgataacactggcttttggcctcattttaggttatcatttgtaattttatttcacagttgatatgattgttatgtaaaataaaaaagtttaggatacatcgaatttttggggaaattcttttgggggtatcctaaatcttttctattatattcccatattttctattattggtctagacgtatgatggtaaactttgtacctatctgattgctgaatcattaattgcttatcattagccatctttgtttcaagttcgctagatgatcattttattcacatcctaacaaacttgtcacatttatagattcttaatctatttatcatacaattataaaaaaggaggtgctgcttatgaaagctatccatatttctttgctttttttcgctagtgcattgattttatttgctattcatctttgttcccagccttatatcaataacaacggaatattagtggaaccagcattcttttgcttaccactcggctttttgtcccttcttgcctccgcaggcttcggatttgttgctttttttaaacgatcaaaacaacaaatctgacttataaaatttacgtaaaagagatcgtgacaataatcgtgtgatattcccaaatttcgaataaaaggtgccccttgccatctctaactcctcagtcacaagttacaatattcataaaccatgaaaagcttgtttattgaaattgctccttgtgacttggagctaagtgacagattacaacctcttttgcatcataagactttactccttgaaaaacattactaacttttgatatgtttcttgcgcttgtttattgctgaaatcaaactgatattcatggttcaaaacagcatttttctccgcataatctacttttgtgactttcacccccgctttctcaaatacagaagttacttcttccatttgtttcgtaaacgtatttgtatttccatccgttaagaatgtgttttgcgtccaacgatccgcatgtctgaccaaggctaaacttttgaccttctctgattgttcaaagtccttattatcaaagtaagcccatccacatttttcataaagaaagctagagattttatcacttacttgagtaagtgcagaaggatccaacagaccagacaaagaaataaacttcgtaatctgcttgttctccaaagtcggatcaagatgatcagcttttttaatttcttcattttgaagtgctaacaaatattctccactaatttgtgcacctgccgaatttccaccaatcgaaatattcgaccaatctgcttgatcttttatctcttttttagctgcttgaatggcttcgttcaattggataactggtgtaggatgttttgcttccggtgatcgttcataatctatatttacgatgatttgctgcgtgtctgaacatagatattccaaataatcacgacaatcatttttatcccctcctacatatgcgcctccatgcatccagaaaagaatcggtaattttttcttttccactttcggtgtgtagatatccatattattatttttgtactttgaaggataggatatttctttttttatatcgatttgttcgattttttgctggaaatcatctggtcgggcatatacttgttctttttcacttgtgtcaaattgttttctaacaagcaagctaatcggctttggtgtgatttgattaatcaaaaatacagtgactaaaataactacgatgataactggtactgcaatcactattcgcttgaaccatttcattcatttaccctctctttcttcgccaaatccatgtgataatcgtgctaacagataaaaatccacctgaataaatgagaagcgaatgtttcttttctccagttttcggcaacattcttttttttgcatctgtctttttttgtactttcactgtcatctgaatcggttgcgtatcatcacttgattgatcctctcgaggttcattctttcccttattgtctgcattctctgtcggatcttgcttttttggtggagctactgggatttttttgtaatagaaaataatagttggtatcgtctcattaaaaatcccttcagtcggtccttcaacatttgctaattcgtatccttcgaatgtcttttgctctgtcatataattttctccataagctccgtaaagctggatttcgtcctggtctttgagtagacttttattgttttcatccacatactttacgtttatctgatcatggaacactactttcaaaaagtccgttacatgtttcgtgtaggcagcatggtcaacttcctgtgcctttccatgccctgctccttctactaataaaagatctttataccctcctgataactcatataatttttgcgcgttagacacaggtactacatcatctgctgttccatggataatcaatttaggcaatgaatctgacattccaatcgtgggtagagcagcttttgtatccaaatgcatctcctgatcaaaatagtattgtttcaaaaggcccataaataaatcttcatgctcttgatccccaatgatgtctaactgattttttatggcatccggtagtgcgggggctactgtctggctgtacgtaaaacgtagttgttcatcaattgatgcaaatccgcaattttcaataattcctttgacattgacaggaatatctttcgctaatacagacatcatcgtagctgctcccatcgaaccaccataaagtaaaatcttttgagatggccgctctcgaacttcttgatttatccagtaaaggacgtcatctgactcatattgtccataggtcacataatcgcctccgctattaccagtcgctctggaatcaacaaataataaattatacccggccttataaaaatcattgtattcttctgtaacgatcccgttattccaattccctcgaaatccgccatggatcatgactgttttatctgaaccttgatcgacataatatgcatatacatccatcattttgccatcttgtttgtttagtacagtttgatgaagttgttttgtatttggatagaagcctgtgttttctgtaggcgttgtcccatcatctgtacctccaagcatcgacatcaacacactgttttttgcaaaagcgatatcgtacaatagataagtagcaatcagatgtttgataatctctttatctacaccataatcattaacagcaagctcagtgactaataactctattaattttgacttgatgtcttctgttggtccattaagtatttctgtcatctgtttaccgaagtaattcaaatattctttaccattgaaattttcacctttaccgatatcatcattttctgtcccattctctttgtcacttactttagcagaagaggattcgtcgtttgacatttttgtagctgttgcttcttctgtttgttggttatctgtggtagcggtcgtttcttgatctgtgctagtaacagatgtctcaaccgttgtttcagtatttgtttctgtttgtgaagtactcgatttcgtttcatttccagcatcagtagtttctgtggtttctacctcccgagattccgattcggaagaaatgctctctccatatactgtccattgcgggacgcttgtacttacagcaaataagatgaccaacgctccctttaatacttgttttgttctcaagctattcactcctttttatgtttctaggagaattatatgtaaacgcaaacattttttatacaaaaaataaatggtttatcccataaaaatagaacaggattattttctcattttacgtaataaagcagaatggataaaccagtatccattctgctttttttaaacgaagaaacaacttattgctccaaaaatgtcagaaatcgtttatcccaaattttctcgtaaaaagcgattgtttcctttgctttcataaaaggattatcataagttgtcgttgctcctctacacatcataagctggtatcctaatccatgagcaaacttcacagtcgtatctatacaatactctgcttgtgccccacataattcgatcgaatgacagtccaattcagttaataaaacactcaaattagtcttataaaatgaattcgcatgggtttttctcacaaaataactgtgctcaggaatagataattccgacaatagctcccatggttttgtttgtggcactaattgagcatcttcgtgttgaacgaaaataactggtttcccaatcgtttcgtatgttttgattcttttattcactaatgctgtcactgtttctaattcgtgtatcggcgaagaatcaaaacatacccctttttgtaaatcgatcactactattgcgtcggctgtgtttgacatacttgtgccttctttcttttttcttgatttaatagtatttcttatctagctagttccattatacgtgacaacattttcttattttacacctctaaatggcacttttcgactatttcttcatgttattatttcataaatacttagctattggaggaatgtatgatgattaaattgtatacaggttctggctgctcgtcttcaagacgcgcaaaacgttggcttatcgtccatgatataccgtttatcgaacagaacttaattcgtcaaccactaaccaaaaatgaatttatccacttactaaaattgacaaacaacggcgtgaccgaaatgctctctactcattctattagttataaaaatcttgttcacagaatagatgaactcagtttgagtgaactatatattgagattcgtacatccccttctttattgaaaaaaccgattatctacgaccaatctgcaaaacttttgactggatttagcgaagataaaatcaggatgttcctttctaaaactaaaagaaagcaagagctcaacgaactcttgctttctggtcatcttgtcgattttaaagaaaataatctttttgcaatgtcttaattttggcataaacaatctgcttttcttaattaacgaaatccaatttttccaatatggatctatttttctcattcctgatttttatgatttcagctttcagacgcgcccaatcattttttgtaggttgtccattccagtaaaatatctgtgtattcgtttgatcatatgcctttttgtcgataggataatcgctaatgacaatatcaggtaactgatcagcggatgcactatattttattgggcgttcagtcatagataatatccttttctttgcccataattcctgtgttttaccatactttgattgaatatagaatatgacaggttgttcgtgttttataaaaatatccctgactaacatacagtattgaaaaatcaaccgtctgttcttttcataataagtattaagctctggaattctgcgagctaccccactaaaaaactgttgcatgattggatacatcactggaaatatatgctgaaaatctctgtcttctgctgattttccaaaagcatccaccttcttttttgtcccaaaaacccttgaatacaaatggatcattgccaaattgacatatagataatttttttctgaagttgtaaaacaaatcttgaagtttttttcaaaattttctacaatagacgattcaatccagccccaactttcttgtactttatctggagtatccaacaaatcttcttccaaataggtgttcattacaccaaacataaaataaaggtaagcttgctctgttggagtgatgtgattcatcgaccagaagtttgcttcaaaaaaaggctctagtatgtaatgcgtaaactcttcttttgttatcaatggatgcacaaatttgttcatctcttctgggacatacgtaatcgagtggccttgtttcattcgttgcaacgaaattcttagtaggctgatccatttctttctatctatactacgcgtatatggcgcatgtttcgcaaatttttctaatagttgacgtttattttttatacttgataatatatcagaatgattttcgtcgaatgactgccaatacatcaagtgaaaaaagtatcggatacggtattcttctccttctatcggattaccttttttcaagctgcaagataaatgatagtttttcaaaatagtattaagttctcttaattttctttgaatcgtacgcaaacttatataattttttgactaagattttctaaggattgataagtacctttgtaaagtgaatccagtaaaatataaccaatcgttccctctaaaagtatagaataaactttactcagtaaaaactgagaagaaaactcgacttttatcatcttgttttctgaaagaaaagataatttatattctggatacctttcgcaaaacgattctgcttgttgaatcaccgaattcatcttagccagggtgtagtttagatctaaagcgatatccttcaccacatataatttctcgtctctttcataacaatagttcaaaaattgatatacttgcctttcattgatatcaataaattcttcaaacaaagtacatactcctttttatctattatttagacttattccgacagctacatgaataacgtacaaatagattcgttactgatttttcagagatactaccatgcgcagtgtgcattgtcaattattcttgctcttattttccatttgtgttcctgttatttcctgtttctcaaatatgttagtaaacaaaaatagatctggcaaagctacaacttcgccaggcaatacagcactctcgaatgaaatattcactcaaaaatctatcgttttattcaattttagatctgttgcttttattctttatttcactcgatggaagagagaacgaaaatagcttgctcctacaatcaaaatgagtaacacacccatccatgtaattagcttgttcaaggttctactaccagtttctggtaaatcgctttttctattatctgtttctttcgctttttcttgatgatcaattccacgagaaacaaaatcaggctgttttagcacactttttaggttgctccctgcatttctcttttgttccttagttggtatgataggtaccaaatcaagttcattatttacttttcctgtgctgctttcgctgctcgtgcttcctgtgctactctcactactcatgcttcctgtgctactttcactactcgtactctccgtactgctttcgctgctcgtgcttcctgtgctactttcactactcgtactctccgtactgctttcgctgctcgtgttttctgtgctactttcactgctcgtactctctgtactgctttcaccgctcgtgttttctgtactgctttcactacttgtgctatccgtactgcttggcggtccaacaactgtccaactgcttggtttcaaattctccgtgatcgtcatctgtccatcataaaaaacaatcaaatcaactttatctttactcttgatctcatcaatcgatagttctgcagaaatcattattgtatactcaataccagcggtccattgtacgtcttttaaataaacttccccaataactttttctgaacttccattaccatcccaaccatatgttagaacagcatgtacatcactagcattcacgcttttgtttggtttgactggaatagtaatgacttgttgtgtcatgtcataaacaatccgatcagttttcacagtaaatgaaagattctcatttgcccgttcatttgcagaagtactgattccaatcattgctgcaattatactcagcccaagaataacaaataatacggtcgctgttttcttcatttctatcactctccatataattaccttctatttgataaaggaattatataaaatgaaaatgatgagaacacgacagtcagttgtgaaaatctaacaaaagatgtcgtgtattcgcttgaatttgtttactttttcgtttaatcaatgacagacttaaaaaagcaagaccgatatcagccttgctttcttcatcttttattgataaacagcagtgtatttcttcatccgctttgttttatatgcatagagtaacaaaccaacaatcaagactaacaagaataatgtagttgatatagatgcttcagccccaaagtttcccccagtaattattgtattttgcgattggatcagagtggagaaaaaaccttgttcttgcgttccgctgactggtatacccaaaatagctccttgtgtccaattccaagtaatatgagcaccaatagccgtaaataaacttcctgtactgtagataagtgcgctgaaaaagcaacctgctaaaaagatattgaaaactgccagaaatgtcatgttaggattcaatccgtgcaaaagagcaaataatgcagcagatccaatcattgctattaacggaccaaatctaagcatctgatgctgaaaaaagccacggaataaaagctcttctgatgcccccactgcaataaataaaataaaactcgttatcagcggcacaatgtttgcgtttcctgaatctaaccgatacgcccccgtcaaatataatggactagtaataagcagaaacactccaattccaacaacgagacctcccgctaaatacccccagtcttttcctcgaacagaaacaccataatcttctattctttttccttcgaccttactagcaagaaataaagctagtaaaaaaacagctaaatgtccgaccgtaccggcaattgctccaatccattcactatttccaataaacatatccgcaagtgcattattgacaagaattcctaaaacaaaaccaactaagactattaaaacagatccaatcaaccgaataatcctgatcatctttcatccctcctttatattaagtttaacaacccttttctttcttgtctcgtgaaaactatgtaaatgttctccatcatagagagaatagatttttacgaactaagaatatctacagcaaccttacgaaaatgaaagactgtctccctaattcttctgttagactgtttttaataaggaaaggatgggaaattttttgaaaaaacaactactaattatgtgcctttcagcatgtgcaattttactattctcaggttgtagcaagtccaatgaaacgattgcaacgtttaaaggtggaacacttacagttcaggatttttatgataacccaaaagttaaatcaaataatcaaacactattaaaaaaaatgattgtcttcaaagcatttgatgatgtatacggaaaagagatttcttcaaaggaagtaacaaaagaatataatgaacaaatcaaaaaactcggtccaaactacaaggaacaattaaaagcagttggccaaacagaagagacatataagaaactctttaaacagatgctggctttccaatacggtttgaaagccaatgtaaaattaacagataaagatctagacactgcttggaaagaattctatccagaagttagtacacagatcattctattttcgactaaagaagaagcagataaagcaaaaaaagaagcaaatgaaggagaaaatttctccaagcttgttcaagcttatggaaaaaataaaacattaaaggaaactgatggaaaaatgaattttgattcaaccaatccagagattcctactgaagtaaaaaaagcagcatttaaactaaaaaacggggaagtttctgatatcattcctgtaacagatccaacgacttatcagcaaagctattatctagtaaaaatggtaaaaaaacaggataaaggttctaataaagacaaatacaaatctgagctagaaaaaattgctaccgaagcaaaaactcttgatacggaattcatggataaaacaatccgtaaagtgatgaaaaaagacaatgtaactattaaagatccttatgtaaaaaatatattcaaataaacaaatttgacccaattggggatgtggcaaaatttgagaagtgatttttggaaattccttcttatttttgaggcaaaccacttttgccacaacttcatcggggcctttttttatttgtaccaaaacaaatcactggatttgttacaatcatgaggatataatttaaaaaagttttttatttctatcacatgaatcaatgcgccattaagtagattctttcatgcttccctattttttcacttgccgtatcgcttcaaaaacaactatcataaactcaaactcgactgaaaagttattttaaaaaagactaaaaatatcccttctggacttgttcttcttattctgttatactagagaaacacgaaagatatttttatgcgacacttttcatttgtttttatgaaatttattcaaaactggcgtaacttcagagttacaaggatgtattagaggttagggaatacatcgtttaaatgagaaataagtaatagttagtaatagtcacccaaactttaaattaatgaatattgaatcgtcagatagcctcctcgagttttcgagaaggctatcgtttattttatggagaaattgattcagaagtaatcagcgaccttttttagttcaccaatcgtttctgcttggaaagtttgcacccaatcttcttggaagcccctcactgctttatcaatcgagggcatctctaatacttgatctagtagctctttacctaacgttatcgcatgagctccagatcgaatggctgtagtgacttgttcacaatttttgaaactagctgctaatatttttgttggtctttgcgtacgttcgatctcagtccgcaacgaatcaatcactttcatagcatcaatgccttgattttgcatcctgttataataaggtgcaatataatctgctccattattaatagctaaatacccttgtaattctgtgtaaatagctgtaccggtaatcaaataaccttcttttttcaactttttgatcgcttgaaggcctgcttgattcaccggcaccttgataaacgtatcttttcccagttcttctatgataactcgagcatcctctatcatttcttcttccgttcttcctattgtctgaatatggataggaatctgtccgattatttttttgatttctttcatatgcgagaagaagtttgacgctccttcttttttcagaattgtaggatttgttgttacgcctgttaaattcaaaaactgttgacaagaataaatactttttgtatttgctgtatcaagcatgatttccatatagctttcccccattctgatcctcttgatcgattttaatgattgtcccctttcttaaatgcggcatttccttatcttctacatacattgttcctggaagttccggctcatgagatccatcaaattttatcgtgatatgtcctaattcattcaaattagtttggacaacatctcctactgctgtgattacatacatttgtttatcaaaacagagcttcatatcacaagttatttcttttcttacctgattcaattcaatcttataacaataatctgttaatgtttccggtgcttcatctccaaataaaatcattattttttctttcctgaatacttctgcttctataccaacatctgttacaaccgtttcaaagatcgtcatctctgttcctcctcgtaaaatatcatttgtctaatagtttttattcaaaatgtttctagattataaaatttattgaataacacattcctaacggaatttgtttcgatattgtgtgatttctcagagtacaatggatgtatggagaggatccaacgggaatttgctatttcctcctgtagcgtttgtctaccctgtttagtctgttacccgaaccactgttatcactaccaactcattagctgtttcgataatggactagactttcaaatagtagtttggaaggcagcttctagctcttttatcaccgtattctattaggcgaggttgtggctatacagtgagtttctgggaaatcccacagtatcgaagcattttccaaaatttatatcgaaaggaggtccttcttccatgaaattatttgtcggtattgacgttagctctgaaaaactagatgtttgttttttaacagacgacaatcaattgtctatcttatctgaaatctctgttgccaatgacatcgaaggtgcttcattcatacgagaaacaattcttgaattcaataacagctaccactttgatcaaattgtgattggcatggagtcaacgtccatgtacagcttccatccttccatgttttttcatgaagatgagaaactaaagaagctcaacacacttgtaacgattgaaaatccttttcgggtgaaacaatttagtcgcatgtttgatgagaataaaactgatcgaaacgatgcattaagaatcgctgatttcttgcgtattcaacgattcacaacttcccctatcaaagaagagaaatacatggccttacagcgtttaacacgtactcgctatcaacttattaagcaattgattcgtacaaagcaacattttcttgaaaatctaacgtacaaatgtaatacgcttgctcgagaaatgcgagacgaatcgacgagtctttttagtgcaaccctcatttcactcatgacggaagatttcacattggatgaacttgctgagcttcctttagaagctttctgtgatttacttcaagaaaaaggaaaaggccgtttcaagcaaccagaaaaaatcgctaaagcaattcaacgtgcaattaccatgagttaccgcctaggtgctcgtgcacaagaatcaattaatgttgttttaagtgttctcgtacgagaaatacgagcacttgaaaaaaatatcaaagaattagataaagccatcgaacaagtaattgttgtcattccagaatatcaatgcttaaccagtattccaggcgttggtaaagtctatgctgccggtttaatcgctgaaattggtcaaatcgaaagatttgaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaggttccaaagcatcaacacaaacgtgcactcgtcctaaccgcaagaaaatttacgcgtctggtggatacgctactacgtaaacaccaactctatacgccaccaaggagtgtgatagagaaataacaatccgttattgacgcaaatccttgaatcaacccgaaaaaaatttgattttgatcgggtctagtttcgtgcgcttcaaaacatattactcaataaagaaaatcttaaatttcatcttgacttatcaccattagactaaactcagctatataatccaaaacttgctacccaagcaatgataactcgtgggatgccgttaagaaatcttgaataaagaactgatggtacacctacttctactgtctcagcttttgcttcttccaaacctagaccgactggaataaaatcacatgcattttgagtattgatagcaaatagtgccggtaatgctaattggggaggaatatttcctttcccaatctctacaccgatcaatgttccaatcacttggctaataactgcccctggaccaagcaaaggagataaaaatggcagtgaacaaataaagccaatgattgttaatccaactgcatttcctgctaaaggtgccataatgttagcaaatacattaccgatcccagaaccttgtatcacaccaatcaaaagggaaacgaaagccataaaagggatcactgtccggatcatcgtatctactgcttctcttgctgattgattgaatgtagcaactacttttcccgcgcccattccaatttttgctatccagttttgctgctctgctttttgctcggttatctttttagaagtatcatatttgtactttttatctggagatgcagtatttactgtttctttgttatcatcagtttccattagtggctgtatttgttctaaccctactgctgaaacataaatatcttcagtgatatattgtgctaatgggccactttttcctgtgggaacgatattgatggttggtatcccttttttaggataaattccacatctaagagtccctccacagtcaacgattgcaagcgcgatttcactatcaggtattgatgttttgaacccattgatagactccatacctgtcagttcttctattttatctacgatcattggcctctcacctccacctgtgacatagatgaacttgtgtttatcttttgtcggcctaataatcaaaggacctccatacccgccgtttcctcttacgatcttaatatcaccatacatttaaaactctcctttctctaatcaactgaaagctctacttttttgctaagaacgattccttgctgtctgcatacaaatccagtagtaaaatcagttatccaaccaccaataaagttcatcagcagtcccacaagcaagtatcggatagccagctccatcgaatttagccctaaggtttcgatcccttgagcaatccccatccatacaaacaattctccaggattaatatgggggaatacaccattgctcgtatgacaaaattgagcttgagcagcataatagcttggtttgtagtattctggaaggaaacgagccattgtaaatgacataggatttcccaacataaaagcagataagaacggtaacacaaggtaacgagtaagcggatttttcgctgataatttggctactttcgttactcggtcttcacctaaaaaagcaatcagcgtattcattgcaaccatcagcatcaagacaactggtacgattcctgtcatccagcttatgaatgtttctgcacctgtttggaacagcctcataaatccctcagcaaattttgttatgatatccatcgtttgtcactccttttttctttgatcgtacttttccatatccgaaaattattgagcatagcaataaaaggcaatgaaggttgttcacttttttcatttcctgcctctattcgtaagtatacttctctggcattttctaaagctgcttgtgtcaaacgatcttccgctcgaactgagggatggtaacgatcgatgtaatggatatcttcacccgcatagacaggtaatgaatgaaattttgccaaagatgtaaccccttgcatttttctgacttctaaaacttgatcatgatcgtctatagctagcataacaatcgtgcctgaacggattttcccaggtcgtttaccaatcgctacttttccttttcttcgcagttcgctatatgtttgattgaaatgctttagttgcttccaactgataactgcttgcagcacataagctgaagctgcgaaaactatgaatagatacatatcattcatgaagtctctctcctttacttttgattagttttaaaaatgattcttgtgtcggtgctaattcaataaactcatctattcccatttttatgagttcaaataggatatcgtatagctcaaataattcattctcaacttcagccgtcatttcttcaggtatggcaaataaaaaaataactccatttcctcctgtttctgctaaaccttgatcagttattagccctactgataaaacaatgtgttgagatagctggttggttgtgtgaggaaaagcaaattctttgttaacaaatgtgctttgctgatattctcttttcaagatccttttttcaaattcttcatccacataatagcctctgatcaaaggagcgactaatttgtttaaatattcttgatacgtctttttttctttccatatttgatagaaaaaaacagtagaatgaaacccggctaatcgctttttttttgctttttgccattgtgcccttaaccaagagtcatcaaaaagattagtcaaatggatcaccggtgtctcttcatttacattttttaacggaatcgttgtaaaaacagcgaaatatttgtttagatctactttttcatattgttcttctgaaacatgtgttatttgtatatccctccccaatatccttttgatttgtctttggatcattaatgctgttccttttcctgtcgtatgaacaatggctacttttttagaggaaaaatgctctttttgatatcgaaatgctaactccaaatacaacgttaggtagctgatctctactttagagatcttatgttgcaagatagcttctaatgcttgtatgcattcgctagcgatttggtaagaaaaaggatactttttttctatctcaccataaaataaatcagtcaatcgataacgaaaaattacccgatttatcaataaagagaggtgctgtttcatctcttgatataagaaggactcatccagatcaatgagatctaatcgtcgaatacgcatcatcatggggtcgaaatataagcgcaaatcagagttagctttccttatcatcgttatacttgtgttgatgatgttcaaaggaaaactgataaaatctttttcatattggctcaaagttagttcatagatttcttccaactgattgatcagttcattgaattcttggatatattcaaaacacccactgtaacgattgatgggcttcttcaacagatagttactagagattctattcaaagaaataccgataactttcgttaaaagggtgatttcttgtttactagcattcgtcttcttctgaaaatgtttgattgcttgtttttcttctagaaactgttctgttttcgtctctgaaaagtagggagaaacaaaataaaataaaagtagtcgtaattctagctcatctcctattattcttagtcctttatttggtgtgcctgtaatctttacatcaaaatcattgatcatctcttttaatgtctttagatccttgaccactgttcctctgctgacaccgacttcttcagacaaatcatccatacgtaagaaatcctctgtttcgatcagcctatttagtaaataagcgattcttttggatgccgaattgaaatcactggctgttttcaattttccttgcatgatctcatcaaaaaaatcaaaatcataaatttcaagttcaaaatgtttgtttttttggatgatttttgcaataccggcaatttcttcattcaactccccaatatctttttttatggtttgattactggttttgatttctttttgcacttcctggattgaaactttcttgtgagtgactagtaatttcaataattggtaccatctgtttactagcgtcacgtgcgtcccccctatcctttatcctcttgttttacctcctgaaatattagtcgtgactccagtgatataacttgatctttctgaaagataatagcagactagatccgccacttcttgcagcttaccactccttcctagagggatcgtacttgttcgactgtaaccgtttctcagctgttcgacgcttatacctctcgtataagaaagagcttcttcatattcttgtgttctcaaaccggtttcttccagtatccctggtgcaacacctaccacacgaacattcctctttcctaactcttttgcccaagaacgagtaaaactgttcatcgctgcttttgtagcagcataacagctctgtccttctgatccttccaatcctgattcagaagaaagattcacgatcactcctgatcccttttgcaccaagattcttccaactgcttggctcatcaaatatacacttttttgattgacagcgatcatcttatcaaaaacttgttctgataattcatacttgctttttggatgatttctatctattagaagagaaggaatatttattcctgcattattgactagaccatcgatcgtcttgaaatgtttcattactttatatatcccttcttctatgtccgttttagaagacacatcgacttttaaagatagtaggttttcatgctgtatacggcattcagttacatcaaaattcgctacttgtgcattctgcttcaacaaattttcgacgatacttcttccaattcctgaggaacctccagttacaattactacttttcctgcaatatccaaccaatccgacatatgtgatcctctccttcttttttcttacaaatccagtataaaagctcactaaaaaaaattaagacatgaaatttacagcttcagctaaaaaatgtgtactaatggaagagcaaaaaaaattttcatctttttgcatagattgctaaaattcctgagcgttatataagcaatgtttctctttttgatatataattgttttatcatttaagaaaggagaattctaatgaaaactttagatgctattgcattaactttattgattgtgggagggttgaactggctgttggtaggcttgttcgaacttgatttagtagctatgattgctggtggttcaacaactatttttgcgaagatcatttatatcgtcgtaggtatttgtgcgatctactgcttgaaatttttcccaatgattactagaaaagttgatgaaagatattagaaagctataattattaaaaaagttattatcttcatgaaccttccctttattgggaaggttttttcattttaaaccatctgcttttctttgtttaagtgatatactgaataaagataatctattttaggaggagctatcatgcataaagggatttacgcaggcttgttgggaactgtaatacttttttctgcctgtggatataaaacaaagaattctgttaaagaatcttcagcagccatttcaacaactgaggttggttcaactaaaagtacttctactacttccattactaatacttctactggtaatgtagattcgcaacatagccaatcaagtattcagtcgtttagcatttcttcaacatctgaaatgcaagaaagcactgtaccttctcttccattagaaaactctgacaaagcacttctatttcttattgcccaccgttccgaattacaaagtgacgatattgttattagcttttatcaaaaaattgatcgagattatttgttcacagcttccagcaaacaaatccgttcccaaggaggatctggaagcgttggtttttatcgagtgtcacccgaaggatcgattacgatgacagatgcaaatggaacaccattttgattagatgatattatacggatttacagtactagcaagtcattattggtatcattttttctgagaaagttatacggagtataaataagcatttgcattaacctaataattcgttacagctatttctcttatgaatatactcacttctctacttgctctcttgataaatttttggtatctacttcattttcggtcaactgagttaatgaaatttattgtcgggcggttttctagattcaatttttctatatttggatagaagaatttacttttttaccttttgacatattttcttcttattattttaatgatccctttttcaaattagaaagatagcctttgtatcgtattagatgaaatattcacaaagctaaccattatacttgcatttttttcaaaatagagttattacgtaaatagggataaataaaaaatacttattgaaaggatgatcaaaaatggcaaatgtacctagcattcgcgacatgttccctgatttcaatgacgtgtttagtccagcattcaatgattttttaggtgtttcaagttatccaaaagtagatttagtcgaaaatgaaaaagaatacaaactaactgctgatatgcctggctgtgacaaagaagacacgacagttgaatattcagataatactttgacgatctccgccaatcatgagtcccatacagaagataaagaagatggcaactatgtacggaaagaaagacattcggtctcttacaaacgttcattctatcttcctaatgttgatgaagaaaaaatcactggaacctttaaaaacggtgtgctgaaattggtattacctaaaacagcttatcagccaaaagaaacaaaaaaaattgagttaaattagaacttatcgcctctcgatgaatgaggggcgatttttatatatttggataagaacgagtatgtttaaattttcaaaatgagcaaaaaaatattttgtttttacgataaagatgttatgatctctcttggtaaaaaatatgggagttgatcatttgattgtcttaagtaaacttttgttttggataccatttatcataatgaccagtgctttcttttacttattcaaaaggcctaacaaatacttactcttatctgcttgtccgatgatctattttatccataagattagaggattttattattacgactctggtatctcattgttttgctacgaaatcggcttattagcttcggccatctttttcatatttgtgttagaatatttcagaaaaaaataaacttccagtcagttttggctggaagttttttatttggtgcagatcttttcagctgttattcatacaagttgatccatttttctattattaagtacataccattgttactctttgaatgtgggggagaaaaaaataaaaggagctggtattttgttagttatgagtaaagctttgtttttacttccctgcacgttcatgtttattgttttatgttatttcaaaagaagaaaaaaatggtgctggatcgatgttctactattccttccctttttcccgcttatttattttcttgaagaaatatgggatgatatggcatgtgattctgcttttctttttagtcattcattggggcttatgatctctcttacgatctttgccattgtgctattttttttgaataaaaaataatgtattaaaatgtattaactcgtttgtcccaacttccaaaacatatttttgaaagttgggtgttatcttttttgaagtataaaaagatctcaaatcaatccactttactttcttattatgttattcatagtaacaaaagagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaaccgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaacatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctccctaacaaaatcccacctactttatcttataacttgattttttgcataaaaactaaataaagagtgcggcatttcgcacttttttattatatattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaattccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatcttttttcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaattggagtgtaacataaatggcttttttatttgtctcgcttaattatacaaacggcgaagatatcaatgatgatggctcaagaaaaaaagtggagaaagttggcggagacacccgaccagaggccgaagctgctttacgaaaagttttatcagatattgacgaaacaggacaatactttttaggtacggatactcgagtaaaacaataccttgatttttggatggaggaatacgttaaactaaatctaaaatacaatacctatgaaaactaccgatttaccatcaaaaatcatataaacggttatttaggaaagaaaaaacttacggatctctcccctgctcttttacaaaatttcatcaatgctgaatttaaaaagggttactcgaagaaaacaatgactattactcactctgtccttaagaatgcgctgaatatggcggtttatccttggggattaatcaagcaaaatcctatgctgtatgtaaaaataccaaaatatgaagcacgaccaacgactaaaaaagatctaaaaatcatttctcttgaggactttgatcatatgctagaaattactcctgaaggacatcctttctatattcctttgaatattggattttatacgggaatgcgcgttggcgaagtttgtggtctgacgtgggatgatgtcgatttttcaaatggaacaattactgtagagaaacaaatggtaaagaatgacggcgcatgggtatatggtacgccaaagacaagcagttccaatcgaacgatttttattggacaaaccttgctagcaattctgaaaaaacataagaaacaacaattagaaaatcgaatgaagtatggaaagctctacattgattcaaatgcagtatgtacgaaggaagacggtgagctagttacgccaagtgtagtgaaatggaatactaggaggatatcgaatgcactctccctctcttttaacttccattctctcagacatactcatgctacacttcttctcgaaaatggcgcaaaaatgaaagaaatctctgaacgattgggccacagcagaatttcaattacgatggatacttactcgcatgtaacagataagatgagaaatgaaacggtcgatatcatggaaaatcttagaaagaattcttgatttttgccaccgaaaaaaaccaccggtggcaaaccggtggcaaatccatgtaaacatggtttattttttacactgttttcaaacaaacccttgctatttcttcggttcgtcctcgtccattttcagaacggccatgaaggcttcttgcggaacttcgacggagccgatttgtttcatccgcttcttcccttctttttgtttctctaagagtttacgtttacgagaaacatctccaccataacatttagccaagacgtttttacgcaaggctttgatgtctgaacgggcaacgattttttgtccaatagctgcttggattggcacctcaaattgttggcgtgggattagttttttcagtttttcaacgattgcttttccacgttcataggcaaagtctcggtgaacgataaagcttaatgcatcgactttttctccattcagcaagatgtccatcttcactaacttgcttttttgataaccagacatttcataatccaatgaggcatagcctttcgtgcttgatttcaatttgtcgaaaaagtcaaagacaatttcagaaagcggaatattatagacgacatttactcggtaatcatctaaataatccatcgtaatgaattctccccgttttcgttgagaaagttccattactgcaccgacaaaatcatttgggaccatgatctgtgctttgacgaatggttcttctacatcctgaatcgttacaggttcaggaaaatctgccgggttatctactgtagcagtcgtaccatccgttttattaacatggtaaataacggatggtgcagtcgtgatcaattctagattgaattcccgttccaagcgttcttggacgacatccatatgaagaagtccgaggaatccacagcggaacccaaaacctaatgcttgagaggtttctggttcgaattgtaaagcagcatcattcaattgcagtttttctaaagcttcccgcaaatcgttgtaacgagaagtatcaattggataaagaccacaataaaccatcggattcatttttcggtaacctggtaaagcttcagcggcaggattgtctgctaacgttactgtatcccctactcgtgtatcttggacagttttgatacttgctgtgatataaccgacatcaccgaccatcaaaaagtctctagcaactgcttttggcgagaagaccccgacctctgtaacatcaaatgttttgccattactcatcagtttgattttgtctccgggtttgaccataccgtccgtgatccggacatttagaacaacaccgcggtaactatcataaatagagtcaaagatcaaagcttttagcggtgcatctaagtctccacttggtgcaggaacatattccacgatctgctcgagaatatcttcaatcccaatccctgatttggcactggctaatacagcttcactagcatcgattccgattacgtcttcgatttcttgacggacacgttcgggatctgctgcgggtaggtcgattttattgatgactggcaggatctccaaatcattgtctaacgctaaataaacattggccaatgtttgtgcttcgattccttgtgctgcatcgaccactaaaacggcaccctcacaggcagcaaggcttcgagagacttcataggtgaagtcgacgtgccctggggtgtcaatcaagtgaaagatatatgtttctccatttttcgctgtgtaattgagttctacagcatttaatttaatcgtgattccacgttcacgttccaaatccatcgagtctaacagctgatcttgcatttcgcgagacgtcacagtgtgcgtcatttctaaaatacgatcggccaatgtagatttcccatggtcgatatgagcgatgatcgaaaaattacgaatctgctcttggcgttctttcattttctttatatccatagcgtctcctcttttcatataatcagcactttccattataccaacgaaaagcagtaatttaaagagtttttaattagtcagctatagaagttttttttgtagaattttgctatactgttatcaagctaataaatggagatgaaaaaatggatcaaaaagattttagagaaaatcttgaattaaaaccggtcactcaagaacatatcgatcaattcaatgaattgctttcctatgtgttccaagtgactgaagcagacatcgaggaaagcgggtttgagaataaacgagcttttatccgttccaaaaaaccgattttggaagtatcgaaagtgttcggatggttccacgaaaataaactgatctctcaaatcgctatctatccttgtgaagtcaatattcacggtgcacgttataaaatgggtggtgtgactggagttggaacttatccagaatatgctaaccatggattgatgcaagatctaattatcgttgcattggataatatgcgcaagaataagcaatggatctcttatttgtatccttacagtatcccctactatcggcgtaaaggatgggaaatcatgtctgataaactttcctttaaaatcagagatacacagctacctaaacaaatcccagtaagtggtatggttgagcgattaccagttgatcatccagacgtattttccgtttatgacaaatttgcccaacaaaaccatggtgctttattccgcagtgattttcattgggaagagtattggcgtttcgaaaatgaagatgagcgcacagccgctgtctactacgatagcaaccatgaaccaagaggtgttctgttctactgggtagctgaagaaatatttcacgtaaaagaaatgttctatcttgatcaagaagctcgaaatggcttatggaactttatttccgcacatttttccatgatctactgggtacatggagatatttataaaaatgagcctttagcatttttgattgaagatagtcagatcaaagagcagatcgaaccatattttatggctcggatcgttgatgtaaaagaattccttcaacggtttccgtttgttggaacagctgatgcttttcatttcatcattgaagatcctgtcgctccttggaataatggtgtcttcgctttaacatgggatgaacagggacaagtccgtgtcttaaatgaacctataggaaaatccgttcgactggatatccaaacattgacttgcttgatgatgaattatcgccgtgcttcttatttggcaagaatcgaacggttagaaacagatgaagaaacactgaagtcactagagcgtatcattccaaacatggaagcttactttagcgattatttttgataaaaaggatgatgtttagatgaaaatttattttgccgcaccaatgtttgctaaaagtgatttgttatataaccaacagttagttaaagaaatcagagagctctcttctgagctttcgatctatcttcctcaagaaaatgaagcaatcaatgacaaaactgcttatgcagacagtcgaatgattgctcttgctgacacagaaaaagtgttggctagtgatttaatgattgctttactagatgggctgacgatcgatgccggggtagcatcggaaatcggtgtggcttatgcgaaaggcatcccagtgatcggcttatatactgatactcgacagcaaggcggaacccacccgaaaaaaatcgctgcactacaagaaacagctgaaaatcaatttcactacctgaacttatatacaataggtttgatcaaattgaacggaaaagtggtttcttcagaaattgagttgctttcagaagtaaaaagatttttagatggagggactttcagtgattaaagaaatcaaaaaggtgcaaatagctttacttgcttttggtgtattcgttgtctgctataatttttatgaatttatcacacaaaaatattcgacttctcaaggaatcacatttatcgtggaatctttattagggattgcattgattttcatgccacaagtcattttgaaagttttcaaacttaaaataccagcagcaatcgttttgttttactggtttttcttgttcatctctgtctttttaggcacagggatgcatttgatcagtatcatctctttttgggacaaaatcttacatgcggtgagtccaatggtcctgacagctcttggctatggattgattggttacttgatgaaagatgctgagatatcaaaaaccagtccttggttgttcctcttattcggctttgcgtttgctggactttgcggcgtgttttgggagttctgggaattcttatgcgaccagttcttaggcatgaatcttcaacgttttgctgcttctgatggcacactgtttgtcggacgagcagcattgatggatacgatgggcgacttgctgacaaatacgataggtgctgccttaatgggattgtttgcatggtctcaaagtaaaaaagatgagcgttactttgaaagttataaattagaaaaagtgaaaaatacctaataaaagaggttgtgacagaagcgggcagcttcaagaaatttcggcttatttttcgaagaaactacttctggaacactgtttatttgaaaaaaggaggtctgacactagttgtgtcagaccccttttttcttttatagtctcaatggaagattagacgatttcttctagctcttctgttttgaaatgaagttgtccatcaagtaaagtaatcgttacttttgatttaggcataacatgtcctgcaacgatttctttagctagtggtgtttctacttccttagtgataaatcgtttcaatggtcttgcaccatatgctggttcataagcattttcagcaatccacgttttggcttcatcactgattgtcagcaggatttcttgatgttccagacgttgtgccaattgcgccaccattttgtcaacgattcctttcacgttgtctaggctcaatggtgtaaataaaatcgtgtcgtcgattcggttcaagaattctggtttgaagtttccacgtaatagcgtgttgacttgttcagccactgcttctggaatcgttccatcagcagtcacgccttccagcagtaactgtgaaccgatattgctggtcatgatcagaaccgtatttttgaaatctactactcgcccttttgaatcagtcaagcgtccgtcatctaggacttgtaacaagatattgaagacatcgggatgcgctttttcgatttcatccaacaagacgattgtataaggatttcgtctgacagcttccgttaattgaccaccttcttcgtaacctacatagcctggaggagctccgactagacgagacacagcatgtttttccatatattcactcatatcgatccgtaccatatgatcttctgagtcaaacaagttctcagctaacgctttcgctaattcggtttttccgacaccagttggtcctaggaaaaggaaagaacctagaggacgatttgggtcttgcaatccagcccgtgaacgaattaccgcgtcactgaccgcatcaactgcttcatcttgaccaatcactcgtttatgaagtgtttcattcaatttaattagtttttctcgttcaccttctacaagtttcgttacggggatacccgttaatctgccaacgacttgagcaatctcattttcggtaacggactcttgaaccatcttaatctcgctgtcttttgctttagcttctaattccttcaattctttttctaattgaggtatcgtaccatgacgcaatacagcagcgcgttctaaatcatagttattttctgcatcttctaattcgtgttttgctttatcgatttcagcacgttttgctgaaacagaattgacttcttctttttctgtttcccactgcatcttcatcgcatttgcttcttcacgaagttcagctaattcttcttgcaaatttttcaagcgttttttacttgcatcatctgattcttttttcagtgcagcttcttcgatttccaactgcatcaaacgtctagtaacttgatctaattccgttggcatagagttcatttctacccgaatcgttgcactggcttcatcgatcaaatcgattgctttgtccggtaagaaccgatcagtaatataacggtcagataaagtagctgctgctactaatgcgttgtcatggatgttaacaccatggtggatctcaaaacgttcttttaatccacgcagaatactgatcgtatcttccactgttggttctttgactaataccttttgaaagcgacgttccaacgctttgtctttttccatatattgacggtactcatctaaagttgtggcaccgatcaaatgtaattcaccgcgagcaagcattggtttcaacagatttccggcatccatacttccttctgtttttcctgcccctacgatattgtggatttcatcgatgaacaagaggatacgtccatcactttttttgacttctttcaagactgcttttagtctttcttcaaattcaccacggaattttgctccagcgatcaatgcacccatatctaatgaaaaaatcgttttatcttttaaattttcaggcacatctttgcgtacgatacgttgagcaagcccttcaacgattgccgttttccctacaccgggttctcctatcagaacaggattattttttgtttttcgtgaaagaatacggatgacatcacggatttcttcatcacgaccgatgattggatccatttttccgcttttgacttgctgtactaaatcaacgccgtatttttctaatgctttgtattgttcttcttggttttgtgaggtcactctttctcctcctctcatctcttcgatgtttttacgcaattctttttcagataatccgtttttattcaaataaacagttaacggataattttttaatttcatcaacgctaaaataacgacttccgttgaaagaaactcgtcgccgaagctttcacgtatttggtctgcttcattcaataatcgaaagaaattctggctgaggttttgtccatattggacgtttccaccagaaacaactggatactcatccagtagacgatcaatttcatgttcaaaagattcgacatccaatccggcatccgtatagaaatttcgaccaaaatgattagattgtaaaaagattttccatacatgggcaatgtcgatatcttgatgttttcgagtgaccgcaatctgttgagcttcagcaatcgcttcttgaagcgtcgtagtcattttctcaatattcatacaggtataccctcctaattaaaggtaagatcacttatttctttgatctttacaaaaactattatatcgctttggtcaattttggtcaaaatatacacatagttttttgactttttttctcgacttatataaatcttaaaaaaacaaaattgattgtatgtatataaaaaaagagccaaacaaacgtaaaattatcttatccataacgtttttctttgatttgataaaaagggtagatcttataaaagacctacccttgattttctttattctctttttttacttctattatttcttctttgatcactcttcgccgttcagcaatcacatacacaaatccatagagaaatggcaagataaaggaactgaaacgatacagtaaaagcgaagaaactgcgtcaactgttccaacaactggtctgaataataacaaatagacaaattcaaaggaaccaataccagcaggcgtaggaataacccctgaaagcactactgcaaagctgataaacgaaatggtcagtagaaaatctattttaggatggttttcaatcagaatcaaataaggaagtacataccaaaatacaagttttaacatattccatagataaatccgcaatagcgcagtcctgtcttggataatggtttggaccgtttcccttaaagagtagatctgctgattgcatgtatccacccatttccgcaaacgctcacttttaaataacttattcgataagctgacaaaaaatatttgaacattcaagctgacggacatcgccaataaaaaggcaacaatcacgatcgtcaaaaggataccagcgatgataaaccagatcattgatggaccattagaataaaaaagagagaattggatgaccaagccagctaatgcataagtgatcactgccagtttgtacataatcatatggagtgctgtcacccctgctccctgggatagcttcattccttttttgttataaaaataaatctccgagatcagcgttcctgtaccaaacgaaacgattcggtaaaacgcaatatagctagaggtcaagaacccatctttcgttgtaaaattcggcgcgaaaggttcagcaatttctttgattgagcgcccttcagcgatttggtaaactgtccctaatataacagccgctgccaaaacaacaacactggtagacagcaattcggcaaagatatctgcaaatgattgattgattaaataataaataatggcaaaaatcacaatcagcaaaagcagattcagaatgattttagttttcgttcctttagacgacatctcctgctccttaatggaaaaaataaatgagaatcaaatcaacaagtacacctgcagcgaatcctatagtaaacttctttttccgagttttatgatggaaaacttttcgagagatcaatcctcccaaaccaccgcctaacaggctgacaaatatcaaattattctcaggaacacgccagccgctagttctagcctgatgtttatcataccccatcagacaaaataagtaaaaattcacaatgaaaaggtaaaaccacaaaggattgtgtaacaatacatccattactcttcttccaactttctgttaactactatttctaagctttttcttctttctttggtgaataaactgttaatccttttgatacaacagataattcaactggaagatcatctgtcgtgtctccatccgttcgagtgcccacagatttttcctgcgcttggattttcatgcgtttggctgtgaaataagtaatgccggggatcgtatagaatttgcctctcatgattctaggcaaataaaaaataaatcggaaaatatctaaggaaggtacgatcgttacatgaaattttccatcatctagggtcgctgagtcgtcaaaatttgtaaaaccgcccacggagttagacatcgtgactgtcaacagttgggattttcctttccaatgctcctcgtctgtttctaaatccaaatgatattttttcttcttcagcaataacttaaaaaacttcttgataaagatccacgagccgtaacgctgtttttcttcttgactgatccaaactgctgtatctgctaagattccgattgtcagtgtagagataatgacttcatcattgacttgaccatagtctattttccgtacattgccttccaggatcacgtcagcagcttcttcttttttgaggggaatctcaagaacacgtgcaaggttgttgacagttccacctggaagtaatccgacatggtattgagataatgttttttggaacgcttggacgatatgatgaatcgtgccgtctccacctataattactaaagtatcagcttctatggcttctgctttcttgactaattccgcatcatcaatcgatgggccagtttcagctagttctacatataattctggctgcttttcttttacataatcttgaaaccagcgtgctaatttctcaccctcatctttccctgaacttttgttataaaaaactagcagcttttccattctttacctcctatttactcttcaaaaaagagggcgggacaaccaattccattgtcctgccctttagccttagacagatgacattccatcattgggacgaacgccttgtcataagctgttctttttcgattttaactctttgtgttcaattctgcaatttttacaatcacgtctgttgctttttccattacttgtaaagaaacaaattcgaatcgtccgtgcatattttctcctccggcaaatagatttggcgtcggaatacccatgtaagagatttttgaaccatctgttcctccacgaactggttcgatcactggagagataccaagctcgatcattgcttgtttcgctaattccacgatgctcatatctttttcaatgatttctttcatgttgtaatattgatcatacatatctactttgattcgttcttgatcaaatcgctgattcaactcttcttggatatgtgtgatttgtgctttgcgtgcttcgaatttttcacgatcatgatcgcgaatgatataactcatagaagcttcttcaggattcccatccaatgccatcaaatggaagaaaccttcgtatccttccgttttttctggaacttcatcggctggaagctgattatgaaaatcgattgctaactgtagagcattgatcattgtatcttttgccgtccctggatgtacatttttcccttggatcgtaatatttgcttgagcagcactaaacgtttcatactgcaactcacctaaaggaccaccatcgactgtataagcaaaatctacatcgaattgctcaacatcgaatttatccgctccgacaccgatttcttcatcaggaccaaaagccactttgatggtaccgtgagggatagaaggattattgatcaagatctccattgcagtcatgatttccgcaatccctgatttgtcatctgctcccagtaatgtactgccatctgttgtgatcaatgtgtggccttcataatttttcaaatttggaaaatcttttgtattcaatgtatagcgttcttccgcatctagtacgatcgtagactcgccatcatagttttcaatgatttgtggattgactcctactgcattaaaatctgctgtatccatgtgggaaataaatccaatggaacgcacttcatgatcaacattgcttggtaatgttcccataacgaatccgttatcttcattatagaaaacatcagctaagcctaactcttctaattcttttttcaattcttgcgcaaaagcaacttgtgtctgagtcgatggagtcgttttgcttgttgcatcggagcgtgtttctgttttgacatatcgtaaaaaacgtggcaaaagattttcgtacatagtattctctccttttaattaaattgaaatgggtttgtatttgtttcagaaacgaaaaagttaatatcccaattttcttcttgtttccaagattcaaatttctcgataaatcgttgcttgcataacgattcaatataatgaccgggatcaattgcaatcaacccagcgctttgcatatcatgagccgtatgataatagatatctcccgtgatatagacatctgctctttgggcgattgcttgcggataaaatttttcaccgcttccaccgcaaatcgcaatgcgcttcacagaggattttgcattttttggctggactattctcagtccatctagttggaacgcttcttttacttgttctacaaatgcctctatagaaatttcttgcggcaattcacctactcgtcctaacccaaacatttcgactggttcatctatagcgaaaagatcataagcaggttcctcataaggatgagctgaccgcatggcttgaatcacttgtttttcgatagtttccggcaaaataacctcaacttttgcctcttgaacttgttctgtcttccctactttcccaatcgctggttgtgcaccagcttccggagtaaatcgaccgtgtccaatcgaggtaaaacttgtaccggtataatcaccttgtgtaccagcaccagctgcagctaatacttcacgcattttctgtgcatgatccacaggtacataaacggccagttttttataatgaatctcatgagtctttactaaataactctccacttcaataccgagaagttcacaaaaccagtcattcagtccatcccaaataatatccatgttcgtgtgtgctgcatagacggcaatatcatgtttcaacaaatctgcatacattttttcttgtggctgatcagtaaccagccgttttacaggacgaaagattggaggatgtttagcaatcagcaaatcgatttttttcttgattgcttcttcgaccacttctggacgaacgtctaatgtcatcattactcgttggattggcttatccaatgttccgatatgcagtccgactgggtctccttcttcagctagccactgaggacaatagctttcaaacttttggatgaaagtgcgtccgctgattgtcatggctttaaaacctcctcaatcatttggatttcctgctcgatttgtttttgacgtgcctcttgattagctgcttgtttgagctgttcacggatagcttttctttgttgaagctctcttgtccattttgatttgaagatctcacttttctcttcaagcagaaatggcccgaacatcagctccatttcattgtaagtaactggtttttgttctttttcggctacaatgatttcatatatttttttattttcttcaagtattttttctgattggattttatactgattttcttgcagccaagatcgtaatgtacgctctccgatgtttggctgaaggatcaaacgttcttgtccgcttaagcgttgattcaacttgccagcttctaggatatctcggatcagtgaacctcccatacccgcaatcgtgacagctgtaataccatcttgtggctggatagcatctagaccatttgcaaggcgtacggtgatacggtcttctaatccatcttttttgacttgcttacgtgctgattcataaggaccttgaacgacttcaccagcaactgcatattcgatttttcctcttaatatcaatgcaacgggtaagtaagcgtgatctgatccaatgtctgctaaacgagcggattcagggacaaagtcacccactgcggctaagcgctgagataaatctaaatggttcatagcttcactccttctagataattatagcattttccaaataaaataaggagactaggaataaaaaaattcccatatctccttaaaaaatataccttttcgttctataaaacaacattttcttatttttgaaaaaatgttattggttatttgttcaatgaaacatcaataatcgaatctccaggaacttgcggtgggatagacatcgtcatgatcggcatctcaactaatgtaaattggactttgtcaccgattttcaattcatttatgtccacgcttattttttcagcagtagcatttaagatcactccgtcattgctgaatgacgttcccatattcgctggatcttctttggccatgacatcgacgagtttcaactgaagcgtttcttcttctgcttctacttgagtgatactttcaatcgttccgacaaatatgctttgtctctccgttttcgtactgcttgtttttactgtttgacccgcatcaatcgaatcaacagaacctgtgttgctatctgcgctaccgcagcctgctaaaagaaaaaatagaccaactacagatatactagaaaaaatagccctcataaaaaatcctccgtttaagtttctgcattacttgttgcggtgattgtctccggtcatttctgtccatataatgattcgctgacctgcttttactactaggtcaaatgtcagttggacttgtcaactgttcaaccattgcgtcggttgcgaccagtcatttcgatttcttttgtcaaataacgtatgcgttccattatccgtttcgcttttagcggctcttcatctccacgttgagtgacggacaaatgctgttccaattcatccattgtaaaattcgatgagaagaaggttggtaactgttcctgcatccgatattgaaggataacaccgaatacttcgtctcgtatccaactactcatcgcatctgcaccaatgtcatcgatcatcaaaataggtgaacgtttcactgcatctaacttttctgccacttgatcttttccgattgcctgtttcatctcaacggcaaatgtcggaaaatggactagcgtcgtggtgaatccagcaatcgctaattctctcgctgttgctcctaataaatatgtttttccaataccaaaacttcctactagatacagtcctttatgatacccttttggatcagcagtatatttctctacaaaatctagggcttctaagctcgcatatcctcgtccatctgtacgttcaaagttttcaaaagaagccgattgaatatcttttggcatatccattgcttttactcggcttctgatttcttcttgtctttgccgtgctaacaatgcttccgttggtacataagtgacatccacataatgaaaattcaacgtcagcttcggctcatagccgggagcgatcatcgttggatcgtttttttgatatttacgcttttcttgcacgaattcatacaatttagcgtaacttttttcaatatccgcttgtgtcaattcttcttggtgtgcgcttagaaaagcttgaacatccgcatcatttaagacttcagcgatcatttcagcatacttttcttgataattgcgtttgctgatgatcctcttcaattctttgcctacgtcttccactagatatcaccctccttttttgccaggtattctttaaaacggcggtcaatctctgcttttttctcgctgctgatctgtttttcatcttttggctggttgacccaatcaggaagcttttcccgtcgaacatttcgcttgccagtttgataatttgtttgcttcttttgttttgattgttttgcttgattacttatttgccgaatgtgctggatcgcttcttctgctgtggcgattttcttttgtgcccattcatttgccactgtatttacataactggcatttaagctagcattattcttgatcactagtacataattcagcaaaacattgatcacgctactggaaagacctgattgagaaacaagatcttgcagtaaccagttttcttgtttagaaacatatccgcctttttctgacttgattgcttccagatatttcatcggtggaatgctctgtgcttcttttatcagctgaagcgctgcgtttgtcaaatgttcgtttgacgagggttcattactgttttcagaaaccgcaactgtttcttttgtttgcttcaccggacgtctctgcattgccaaaatggctttttgcagttctttttcagatactttttgttcactaaagtcataagattgactgatcagttcgccaagtgtcaattcatcgaaaccgtaaagctgatgatacatgtcgacttgtttgatgattggatcatcaagacttgcaatatgtttttttgccagccaatcattcaaaaactgccaatcgaatgtcgaatctgcttcaagtaatgctactgattcagattcttcaaaagatttattcagcgattcgatgttttcttgattagcagcgtacactgcttcattgaagcgataaacatctaaaaatttttttgtgattttttgatatccctctgctgtatgccttttaggttcaaagaattgggtaagcttctggaatcgtcgttcaccaactttttccagaagaagaaaagccagaacagagtctttgaaaaatgctttaggaatgagtggttctaacagctcataaataaaacgaggtcccagatcactatcttctttaaaataaacatccagtaagccgattccttctagcttttttcttgcatcataaaattgcgggataccgcagcctagactactaagcagatctgcatgcatcccttcaggacctttgccagattcttgagagatttctgataacagggtgaaatagatactcaaggcttctccgccgattagtggctgataaagatacagcaaggcgttcttgctgtcttctctcagcggagccgcttttcttccttggtaaatattttttggttgaagctctttccaagcattttccaaggaaatgcctcctttttgtttcttaattgttttctttattattctctttattattttcttttgctttatccacgatatcttgcaactcttttaagaaaacagacatatctttgaactggcgataaacacttgcaaaacgaatataagcgatttcgtctaaatcaactaaatcttccatcacatattcaccaattagattcgtcgatacttcgttttctccgagactgcgtacgcggttttcgacatggttgacgatttgttccatttgttccatagctacaggtcttttttctgctgaacggatgagtcctcttaaaattttatcgcgattgaactcttcgcgttccccgtttttcttgattactaataacggagcagcttcaattcgttcaaatgtagtgaatcggaacgaacaattctcacattcgcgacggcgacggatcgcacgtccatcatctgcttgacggctgtcgattactcgtgaattattatgttgacatctgggacatctcattttgtctcacctcttgcatcgcattttatataaaggatgtgtctttctttacaactagttgtattataacacgaaacaaatcacaaacgcgactgtcctacccaaaaaacacggatataagaacaattttttctactttcatgcgtaattgtgtcccctgtccttactaaatttcaattttccaatactgatcaccttgattactgagaaataacttacacaaaagctgatttagtcatctagcacaaaaaacttgaagcagatgaacaccttctcatctgcttcaagtcacatctcgattttttactattttataacttctcttcgattcctgtatagtgtttcattcgctgttcctcgattttttgctcatcgggaatgtggtcactttctgggagcggtgttttactacgatcaggtgtcggattttttcgttcttgagtcaaatcttgccgcttcgcttcttcttctgcctgctggtcttctatttcatcgattcttgcttggtactgcttttctttttcttctgctgtttctgattgcgtacgaccttcatcgattagattttctttattgagcatctcgccgattttttcttttgcgttacctacgactttatccttttgattttttaatgatcccatcgctatccctcactttctatatactcaggatagcaaaattgacacagatactcaaagaaagcgattagcaaaaagccaattttcgatttgtcccacaagtttttcttttgttccattgttgtcgaacaaaatatccgcacgctgctttttttcttcgattggaagttgactactaattctctgctgcgcttgttctagcgtcagttgattacgtttcatcaaacgctgaagctgagtttctggcgtagtataaacgacagctactgcatccatatagtggtcataatgaccttcgtagagcaatgggatatctacaattactaaaggatgattggaacttagagaggcgatttgatcttttatcgcttttcggataaacggatctaatagctgatcaagtttttgccgtttttcctttgatggaaaaacaatcatcccaagtttccctcgatctagttgcccatcaggctgcaatacctcttggccaaacactgatacaattttcctcagagcaagcgttccaggctcaacagtttctctggcaatcacatcgccatcgatcaaaggaaatccatgagactgaaagactttggctgccgtacttttaccggtagctattccacccgtcaaacctaaaacaaatcctactttgcgatttttagcctttgacaattcggacaatagtgcgtccccctttgtgccacttttgttttcacgatcggcgttccacaacgtatacatggtttgccagtttgctgatagacatgcagtgctacttgaaatccgcctgattctcctaatgcattcaaataactgcgaatcgtggtacctccggcttctattgcacgatccaaaacatcaatgatcgatagacgtaattgttctacctctttggggcgcagtgtgttcgccggttgttctggatggatcttcgcttcccataatgcttcatctacataaatattacctagaccagtcactagacgttggtctagcagcaatggcttgattgctttgtgggactttttcagtccatttgcgaaatctgctaataagaagctatctggcaaaggctcaggtcccaatttcatgattcctcggtaagttgcacttgctcctttttcgacgattgtcatacgaccaaattttcgtacatcgttgtagcgaagttggcttccatcctcaaaaaagaaaagtacatgcgtatgtttatcgattggtgtattttctttcgtaaattgatattttccttccattcgcaagtgtgagatcagttcacaatgatcgagatgaaaaattaaaaacttccctctacgtccaatggattggatggtttcgccaacaagagaagcctcaaagatgggtgtctctggttgctcgatgatcttgggccacaagacctgaactttttgaatcgtttttcctactactaaccgttccaatcctttacgaacggtttctacttctggtaattctggcattttttcttttcaccttcattatattgctctgtcttaaacaatgtttattttgcttcgtaccacgtttttccccaactgctgtcagtgatcagtggtacatgaagagaaacagcttgttccataacttccttcaccaatttatctaatgattcaagttctttttccggtacctcgaagacaagttcatcatgaacttgtaacagcatcgtagcttgaagacctgtttcttttaatcgtttatccaattcgatcatcgcgattttcaaaatatcagcagcacttccttggattggtgtattgatagctgttcgttccgcaaaagaacggatattgtaatttcttgaattgatgtctggcagatatcgacggcggtgatacagcgtttcgacgtagccttggtcttttgcttcgcgtacgattctttccatatattctttgacacctgggtatttttcaaagtacgtatcgatgtattgctgtgctgcttttcggctgattcctagattttgtgaaagtccgtaatcagagatgccatacacgataccaaaattcactgcttttgcctgcctacgcatatttggtgtgacatcctctgccttttcgattccaaatacacgcatcgctgtgctggcatggatatcttgaccttctaggaaggcagctttcaaatgttcatcatttgagatatgcgcaagtacgcgtaactcgatttgtgaatagtcagaagaataaatcagccagtctttttctctaggaacaaatgcctgacgtatctttctcccttcatctaatcgaatcgggatgttctgcaaattaggatcaacagagcttaatcgtcctgtttgggtcaatgtctggacataacgggtatgcacttttccatctgattggatcactttcagcagtccctcgacataggtagattgaatttttgcaatttgacgataggtgaggatatcctctacgattggtgcttgttcacgaagctgttccagtacatctacggctgtggaatatccagtttttgtttttttgataacgggtaatcccattttttcaaataagatcactcctaattgctttggtgaattcaaattgaattcttcgccggcttcttcgtagattttttgttcgatctctcttaagcgagcagagaactcgcccttcatttcttgtaagcgagtcgcatctactttgatcccgcttatttccatctctgccaaaatgatagacaatggcagttccattttccggaaaagatcttcttggtttttttctgccagttcttggctcaattttggtgtcaacgcattgattgcagctacttttcgcgctaaatgagcaaaaaagagttcctcttcttctggtaaaccttttttcgcccctttgccgtatacagcttcatctgattggatatcgttgtatccgtaatgagcagctattccttcgatatctgtgcttttttcattcgtatcgagaaggtatgcacctagcaagacatcaaaatcgattcctttcgtttttccagtatagcggtttaaagcaacataagttcgtttcgcatcatatacttttttcagccgagtcggatcagtgatccaagaatggaacgctcggttttcgaatacagatagatcgttcgtgacataaattttcttttctgtcccccacgctactccgacgatttcctctgtatgataattgtcgcccatcatttccacgtacaacgccatatccgtagtaaacatttcctctttgaattcatgaacgacttcaaacaaaatatcatccatttttacttcttcttctacgatattcaatttagaaaggaactgattgaaatccatttctttataaaacggaacgagtttatcgagatttttcccttcatacttcaatgagtcgatagagacatccacaggcgctgaagtattgatggtcgccaattttttcgataagaaagcctgctctttgtcatttatcagattttctttcattttgctttgcttcatttcatcgatatgttcataaattccttcgactgagccatattgtttcaatagcttgatagctgttttttcaccgattttagtcacaccggggatattgtcagaggcatctccggctagtcccttcatgtcaataatctgttttggcgtcaacccatcatatttttccgctacatgttctggtgtatagctttcgatatcgctgacaccttttacagtgatatccacttttacttctttactagctaattgagtcaaatcccgatcacctgaaagcacgacgacatcaaattgatctttgtctactttttctgccaaagtaccgataatatcatctgcttcataattgggcaattcgtaatactgtacccctagtcctgtcaacaaatcacgtatatatggcatttgttctttgaattcgccaggtgttttggatcttccacctttgtactccgcatacatttctgtccgaaaagtcgtttttcctgcatcgaacgcaaccagaacatgagtcggttgctctttttgcataacattttcaaacatcgtattgaatgcatagattgcatttgtatgaagaccgtttctatttttgaaacgttcaagagaattgtgaagcggaaagaatgcgcgaaaagccacactgttcccatcaacgagtaataatttattttttgtcatcttcttaactccttactgtaaagttcttattcattctaacaaagaatcctgcggaatgcgaaaagaaaaagcgggaccataccaaataattcggtatagccccaactgatgaattttttctttttagttgttccgtccaaagattctcagaaacgccaagaacaagttgataaagtccaaatacagcttcaatgccatgaatacagcaattccactatgtgctgttccgtttgtctggacatagatattacggatgctttggttatcataagctgtaatccctgcaaagatgacgactaacagtagggagatgaacagctcaactacgctacttctcaaaatgaagatgttcaagactagtgcaatgatcactccgattaaagctgcctgtcctgctcttccaaccccgctaagatctctttttgttgttactccgacaacagacatccccatgaacatcaaagtagctgtcaagaaagcttgcgttactgttccaatatcgtagtatgcaagagtaaccgctaatgttatgccattcaaaagagagtaggcaataaatccaccgattgctaagctcggattcttttgtgcttttacgcctagaaccattactaaaatcagttcaacgatccacagacccacaaagcctagtggaaaattattgataaaagttgctaattgcaaaggaaatacccaaagagccaagtaagaagtgactgcactaagggcaagtcccatacctaaaaatccataaacttttgcataaaaacgattgatacctgacattgatgtacttggattattcattcaattcaccttcactttcgattgctatttccaattcaggaacttgtggcggttggaccataacgacagcatccaacacacgatcttcgttcgtattctccgcttctacagaaatcgtcaccacatccttcatcttatctacttttatgacctcaaactgaaaagtcagtgtttcataatggaaaaccggttcaataaaattgacagaaaaattgacaacatgtgatcctggtccaggaagatgctttgaaattgcacttgtgatgatccccatcagcatcactgatggaacgattggctgttgatattctgttttttgtgcaaagtcatgttggatatacaaaggatttgcatcattcgtcaatcccaaatacagcaaaagctggttatcttcaatagattctgttaaggataacgagtcgccttcctcgatttcatttattgtttttcctagttttctcggcttacctatgttcaagatagaaaccctccagtttatttttaatcatacattattgtaccaaaagtagcgtaaaaggcaagttctgctcccttgatttaacagattcctatagtttacagaggtcgtgaaaaagctgtcctgcatcaaataataagaacagccaagaaaaaacagcttctcatgtttttgatttgattgggcttattaccgcagatgcaagcttttgaacaccgtttatcataagttgcaaaaaagggggcttggcaagatttttgccactccccctctttctatttttataaggacactgcagtaattgtattacagtacatttttcgtcgtgctgcttaaaagtttttcatacgcttgttcaaatttttgaacatctccagcacccatgaagattactactgcatcatgataatctaacaatggagatacattattttctttgatgacttctccaccttttttgattttcgctccaaggtcttcaatcttaacgtttccttgttcttcccgagccgaaccaaaaatatcgcataagtaaactttatcagctaaatcaagtgcttctgcaaattcatccatcaatgcaatcgtacgcgtaaacgtatggggttggaaaactgcaattatttctttatctggatatttttggcgtgcgccatcaatcgttgctttgatctctgcagggtgatgcgcataatcatcgactacggtcatgtctgctacgatcttttcactgaatcgacgttttactcctgggaaagtcagcatttcttctgcaacttctttcagatccagtttttcgaaataagctactgcaataacacctaaagcatttaagatattgtgtttaccgaatgctggtacagtgaagtgcccaacaaattcatccccatgatagacatcaaaagcagaaccagaagttgtgcgttcgatgtttcgtgcttggatatcatcgttttctgtgacaccataataataaatcggcacatttgcttttaatttgcgtaaataagcatcgtcaccatacgcaaaaatagcttttttcacttgtccagccattgtttggaaagctgtaaatacatcgtcgatacttgtataataatccggatgatcaaaatcgatattggtcatgattgcatagtctggtgaataggcaaggaaatgacggcgatattcacaggcctcaaatgaaaagaattccgcttgcggatcaccatgtcctgttccatctccaattagataacttgttggacggacaccactcaatacatgagagagcagtccagtcgtacttgtttttccgtgagagcctgttacagcgatactcgtataattttggataaaatgaccaataaagtcgtgatagcgaatcacttccaaacctaattcttttgctcgctggatttcttcatgtgaatcaggaaatgcatttcctgcaatgatcgtcatccctggttttacattatctgcgttaaatggcagaatcgtgatatttgctttttctaaatctctttgtgtaaagaaatatttttcaatgtctgatccttggacatttagaccttgttcatgtaaaacaagagccaaggagctcattcctgaacctttgataccaacaaaatgatacaatttattttgattttccatttgaatcctcttctcttatctagcgtccattcttttagctattacattcaacacgctcctcattatcttataaacgattgaaaatttcaaccaaatttatttggaaaggaggattcgcttgctaaaatggtcaagtacgagaaaaatccgtttttattgactctttaattctggtgtaagaagaccaaacttcctctgatatatcaatgtgaggaataaaatcttttcctttcggaccatagccgttctcatcgtcatggagacgttccatttctcctaatactagcgcatggaaatattccttaggccattgatgattcagttcttttgctgtaaagatgatctcttcagaaaagtgaaggatttccggcacaaatggcacagcattcgcgaaaatagtttgttcattttgccatactttctcaaaagttgctcgagtcctgcgttgcagtgtcggatcattcatcaataagattttttctggtacagctcctaaggaatgaagaatctccagtgaaaaagtggcgttctctccagaatttgtagacttcgattctatcagaaaagccttatcgggcaaatcatagacttcttttagatactgacgacagatttcactttcactcatgccatcttcaaaatgaaatccttgcttttcaaaattctcataaaggattctagtcgcatgccccacccctccgaccaaaaacaattgatctacttggccatttaaatacatttgtgctgctttatcagctaagataggaagacagtttccagctaaaataagtgtaggtgccgtcagttcctcaaaatttccctcttcaggtgcggctaaaaaatttaatagctgattccagtcttttagattcctctgctcacttttttccaaaggccttctatcctttcatctgattttttgtgcttcattaaagtcttctctttttgtctcaatccatttgatttctccatgacatcttccacaacgatatttgcgtacatcgattcttctcttgcggcagatcgtggcagaacaatcttggcatcgataatactccatctttatctgtttcttcgtcaaggctggtgcatagcgcaaccctcctgtttttttcaaaagatacttgaaatccatatctttatgctgataccctcttccagctagatgaagatgataatggcaaagttcatgtttgatgattcctgcaatcgtctcttcgtctgactcttcaaatagcttcgcattaaaatctaaatgatgatcgtttaaatgatagcgcccgccagttgtacgtaagcgtggattgaacattgcttggtgcttgaaaggaagctggaagctttttaatgatatctcttctactaactgctgcagttcttcttgtgtcaatttttgttactcctcattgttactcttcataaggggaaagcatcgtcaaactgattctgccttttttcgtatcgacttgttctatccaaactgttacgatatctcctactgacacgacatctgtaggatgcttgacgaattttttgctgagtttcgatatatggacaagtccgtcttgcttcacaccgatatcaacaaatgcgccgaagtcaatgacattacggaccgttccagtcaattccatccctggtttcaagtcttccatactcaatacatctgtacgtaataagggcgctggcatctcatcacgcatatctcgtccaggttgtgtcagcccagctaaaatatcggctaacgtttcttctccgactgataggctttcagccagtttctctacggataatcgtgtcaatttttctactgcttcttctgtaccaagctctttttctgaaagttggactgaagttaatatttcttttgcaatagaataactttcgggatggatacctgtgttgtccaaaatgtttttcccaccagggactcgcaagaatccgattgcttgttcatatgcttttggtcctaagcgtggcacttttttcaattgagttcgtgcggtgaattctccgttttcttcacgataaatgacaatgttttgggcagttgttttattcaatcctgatatatgctgcaagagctgcgggcttgctgtattcacatccacacctacttggttaaccgctgtttccacaacaaaatccaattgttcagccaaacgtttttgagaaacgtcatgttggtactggcctactccgacagctttaggatcgattttgactaattcagctaaaggatcttgcaggcgacgggcaatagaaacagcacttctttcttcaacttgtagatgcggaaattcttttcgtgcaatttcgctagcggagtaaacagaagcgcctgcttcgttgacgatagcgtaataggttttatggtcggcggatttcaactgctcagccacaaaaagttcagattcccgactggctgtaccatttccgatagctaccatatctacttgatatttattaattaattggataaaagctggtccagcagcttctctttttgcttgcgctgcaggtttatgaggataaataacttcgattgctaaaactttccctgtcgcatctacgactgctagtttacatccagtacgataagccggatcaaatcccaggacaactttaccttttagtggcggttgcaacaaaagattacggaggttttcgccgaaaatagcgattgcttgctcatctgccttttcagtcaattcattgcgcagttctcgctcgattgctggctgaataaagcgtttataactatcctgataggcttctctgacgaatgaagaagaaggagaggcaggatttttgactatttggcgatccaagtaagctaaaattgctgcttcatctacttgaaagaatactttcagaatatcttctttttctccacgattagtagctaatattcgatgagaaaccattttatggacgggttctgcaaagtcataatacatttcatatacgcctttttcatctgcttgctcatccttgacattgctgacatacatacctttgttatacgtataagaccgaatccaagtccgaaattttgcattatcgctgacttgttcagcaataatctcatgagcaccgtgcaacgcttcttcggcagaagagacttctttttctttgtcaatatatttttctgcttcagattgcacctctccatctgtaagctgcatcagccacttcgcgagtggttcaagtcctttttctttagcaatcgttgcttttgtccgtcgtttttgtttgtatggacgatacaaatcttccacttgttgcattttcacggcttgggtgatttctgcttctaactcgggagtcagtttcccttgttcatcgattagccgaatcacttcagttttacgtttttctaagttttcaagataggcataccgctcttcgatttcacgaatctggacttcatcaagacttccagtcatttcttttcggtaacgcgcgataaaaggaacagtgtttccttcatttaacaaattaagtacagtagtcaactgcttaggacgatagtctgaaagttctttttgtacaagctgaatgatcgtctggttcaaattttccgtcattaaaatgcctcttttctgctaaaaattgcttctttattctatcatactttttatcctgggttaaactactgaaagaaacaatattctctataaaaataaaaagagccgcaacaaagtcacagctccttcattctttccattagtcagattccatgccaaggtccttcgttgttctgatattcaatatcttgaagaataccttccttgtcaaaaacaaccccatgcaatgaccctccgaatacagccccaccgtccattccgattttatgatcctgaatccagaggtctgttgtctgcatatctccatggagcattggtgtaatcgtatgtccaaatacaattgtcttacctgtattgtttttcccttcatgaaatggttcccttatccaaataaagtctcttagacttgtcttacgccagtctttctttgtcaaatccacaccggcatggacaaaaagataattttcccattcataatacaaggggcgctggactaaaaatttaatcagttctgaatatctcgattggatcatcatcgagatttcagttggggagtattcctccgatgcccctgggtgaatcaggctttcaaacgtttcttttccaccatttctcatataaggcgcataccagtcctccggtgattgcagaaattgcaaaaaatattcttcatggtttccccggaggtaaatggctcctgtttcttcgactaattgctttcctaataaaaaacattcttttgtacgaggacctcgatcattgagatcccctaataaaacaagctgatggatctttggatcataatagtgaataagtttttcaaaaagctcatgtttgccatggacatccccaatagcataaatcaatgatttcatgtggatcaccatcctcaacgctagtatagcgcatattggaaatggtcgacaatcaaaactattgttttctatttaattaaagctgtaaaccgcagttctgcttcttctggagagattccatggtcttgaacatagcgattgcgcggatgtttcgcacactctatgctacatgctcctaaatgtttttcttcattttcaatggaagcaagaatctgacgattgcactcaggattgctacaattgatatatcgttcacatggtgttccgtcaaaccagtcgcgaccgacgatttgtttatctacttggttgatatcgacagcgatccgttcatcaaacacatacatcttgccgtcccataattctccttggacttcaggatccttaccataagtagcaataccgccatgcagctgtccgacatctttgaatccttcacggacaagccaaccagaaaacttctcgcaacgaatgccaccagtacagtaggtcactacccgtttttccataaattcttctttgtgctcgcggatccagtctggaagctctcgaaaactgcgtatatctgggcgtacagcccctcgaaaatgtcccaagtcatattcataatcattccgtgcatcaatcaccactgtctgttcatctaaaatagcttctttaaattcttgcggtgaaagataggcacctgtcacttggtttggatcaatgtcctcttctagctttaaacttacaagctctggacggtatcttacaaacatcttcttaaaggcatgtccttcgcttggatcgatcttgaacatcgtatcagcaaatcgaggatcagctttcattgctttcatataggcagtcgtgttttcaacggttccagacacagtaccatttattccttcttcagctactagaatacgacctttaagatccaaagatttgcaaaaggctaaatgatttttggcaaattcctctggttcttcgatttttgtataattgtaataaagcagtacttgataatccatgtatttcttccttccttcttttcgttcctaaacagtataaagaaggcgttcgcatttgacgatttatttgcttgtgtataattacgcatggaaagttttttgtttacataatattattatttgaattaaaaagacttcgctttcctgtttcgcacagaaaaacaaagtctttatttctattatttacctgtaaccgcaaagtagttgccatcgggatcagcaaagttaaagacatattcttctccaagctgtaccatatcacctaatgtgactgattgcgtctgcatttttttatatagtccaaagatatctttactgtaaaacatcaaagatggggcactagtagctgtgccaggtgaatgggactcaacaaatgctcgatcatataacagaaatgaggtttgactgtcctcaactcctacttcaattataagcgtcccatccatttcttgacgatctttttccgcaaagccaactgctctccaaaacgttgcatttttttctacatcgtccacataaagcatgatttttatttcattcgtaaacatctgtttcctcctaaacgatctgttctaacattctcaactttgtcagtttaccataggaaaatgggaaaatctacgaaagctctcaacagaatcgtcctacttaaatacgcttttctttaataataaataagttggttgtttttgttatttgcgctttcacttttcggaataaataatgtgtatttatatggaataaataaaaaaagaggtcgtgactaaaaacaagtcacaacctctggtaaacggtgttctcctgacaactcctcggtcacaagacacaatattcaacaaacatgagaagctattttttgaaattgctctttgtgactcagagtgaaacggcaggctcacgacctctttcttaaacggtgttcaaaagcttgcatctgcggtaataagctcaaccaaacgtaaaatatgaggaactatttttgtttggctgttcttattacttgatgcagggcagctttttcacaacctcttattcacggtgtttcagaagtagcttctcggaaataagccgaaatttcacaaaaatttgagaaactatttttaggaaacttcttcttatttcttaaagctgaccacttctatcacaacctctttttgactatgcattcacatcgatcactttagaatcatcattgatgacatcgcgatctaaatctttgatgcgtgcacttgtcacgataccagctaccatgctaccgctgacgtttactgctgtacgtgccatatcgattaatggttcaacagagataactaacccaacgattgctactggcaagttcattgcccctaaaacgatcagtgaagcaaatgttgcgcccccaccgactccagctacaccaaaagaactgattgttacaattgccacaagcatcaaaataaattccaaactaaagacattcactccagctgctggtgcgacgatcgttgccaacatagctggataaacgccagcacagccgttttgtccaatagacaaaccaaaacttgctgagaaattagctgttgcatcatctactcctaaagcttttgtctgagtctcgatattcaatggcaaagctccagcacttgaacgtgaagtaaacgcaaagctcaataccggaaaggcttttttgaaatagttgattggattgacttttgcaccaatcaaaatcagtgagtggacaatcaaaacagcaagcaatgctacgtaagaagcaacgacaaatttacctaaattgacgatagctgcaaaatcacttgttgccaaaacgtttgtcatcaaagcaaatactccataaggtgtcaaacgcaaaacaagcgtcacgatccgcataatgattttatacagactgtcgactaaatctgaaaagaatgctgcttcttttggcgcttttcttttcacgcctagataagcgattccgacaaatgccgcgaaaataacgactccaatcgtacttgttgcacgactacctgctaaatcagcaaaaacgtttttagggataaaggataaaatctgctgtggaatcgataagttttcaactgtttcctgacgtgttgccagttcagagattcgtgctgtttctgcagctccttgtgtgaatttagctccttggagtccgaacagcattgttgaaccaattccgatcaatgctgcaatagctgttgttccaagtaaagaagtcaatacagtcgcactaattttccctagcttttcagaaactttcatttttgtgaatgcaccaatgatcgaaataaacactaaaggcataactagcatttgcaagaatgatacatatccttgacctacaatcccgatccattccattgattgagtaacgactttgtcgtctacaccaaagatcaattgaagcagaccgccaaagacgataccaactcctaatgctgtaaagacgcgtgttgaaaattttgtatggcgcttttgcatacgatagaacacatataataatgccgcaaaaactagaaccactaaaactgtgatgagtgttgtcatttttctcctcctcatattattaatgacaagtccatcgaaggaagtaaaggttcccgagaatgattcttcaaccatcctcctgaaaaaatttttttcagtgacttttatattttagacgatttttatcgaaatgacattctttttgcttacaattagtaataaaaaaacatacctgtgatagctttaatctatcgcaggtatgtttttactgtctattcttgtttttctgattgaaaattcaattttaccccaggctgatctaaggcgatctctgtcacctcataagacattcggcgtacgatatcgaataacggtgctactagctcgtccacttcttcttgtgtgacatcattttgaccttcaattttccgattgaggatatgattgatctgactcacacttccagataaaacatatgtatcaaacactaaacggaactctaagcgtgctcctacgatgctatgttctttcggatagttttcgatcgtttcttttaaaggcgagaagcctactttcaaatctgtttctacttcttggttcggcaatctcatatcataatgaaatgcttctacaacttctttttgtcttctgatttccatataattttatcactcctttatgaaaattataacatatctcctttgaaaggggatactactttttaatgatgctctgcaaggtaaggatttcattcagatttcctaccacataatctgccgggatctcacccagaaaatgatcgatgtcgtaaagacaagtagcgactcctgcatttttccctgcttcgatatctaaacgacgatcgccgatcatcatcgtgtctgttctttctaaatgaaaagtatcgatcaaataatttaaagatgctggatcaggtttacgaggaaagtcctgatcgatccctactacttcctcaatcagatgtgccaatcgatgttcttttaacaggccccatgttgattctgtcaaacggtgggtcaggatgaaatgacgaccgccgttgtcttttagcatttccagtacttgtttcgtttctggaaatggacgggaaacttccgtactttctttttcatatcggtgaaataattcattaaactctctggcattcaagtttgattcattgatcaaataactagtagaatactttttcattttgaagtagatttcttttttgtccatactgataccaaaatcttttagtgcttgccatgcaccatctaccattgcgggatacgtatcaaacaatgtaccatcaaagtcccatatataatttttcatgttccttttgttccattcctttgcttcttttttctatctctcacttttagataaaggtgttctttaaagtatttttttgtccagaattgtcaaatcatctgctaatgtatactggattggttgtgcatttgggatatcgatcgtatccatttgatcttcaggaacatcttctaaatattttgtcagtgctcggatgctattaccatgacccacaactagtaaatcttgccgatcttttagttttggtgctagatgatcttgccataagggaatgatccgattcactgtcatttccagactttctccgtatgggatcaaatgcggatccaagtgatcatatctgcggtcaaatctattttctgcggttaacggcggaacttccgtatatcctctgcgccatgtttttacttgatcttttccgtatatttctttcatcttatctttgtttttacccacaagatccccataatgccgttcatttagacgccatgtttttattataggaagccataactgacccatttcttctagtgcgacttgtccggtaagaatcgcacgtttcaaaacagaggtataaacggcatcgaattgaagtccggcttcaagcattttttgaccggcaactgctgcttgttcttttcctttttctgttaaggcgacatctagccatcctgtccagtaattttcaaaatttgcttcgctttcgccatgacgtaataatactaatttcattcttttctcccttaaacattcgtttcgaattttataccacatgttttgcatgtcacacgtattcgtccttttcctttaggtgcacgctgcttttgatgacaattcgggcactcaaaaaaagtataactttttcgatccattttgacttgctttttgttttttatctgatgatatttttctttgactctatcaagatatttcaaataacgttgattctcatttagtctggggtagattttttttgataggaaacgaaatatcatccatccgaaaaagacgatgaacaacaattgtccgattctatagggcaaccaacgacttagcaaactaaagacaagcgcagcgatcaatagaccgcgattcaactgatcaaatttcgcatatcttccctgcataagtttgtgatagttctgctgaaatcgtattagcctttctaaccatgtttgcatcatattatctcctccatcatctaatatttattatgacaaaaaaatccaaaaagaaaaagccttaattggccttttccattgcaacttggtgaaggacattccgatttctggtaaagtcaatcacaatcactttctttttatcttctctgttgactactcgaaatgtgtccgtcaatggaagaaacagcttcttagatggtagctgttgcatacgtataaaacgatggatcatcgtaatcaattgaggaaattgaatagacgtgtgaagcagacctggatattttttcaacagctgtgtcgttttgatcagattccgttttttactgatcacttttaaaaagctttttagaatcttttgctgacgtctaaaaatagaaaaagaattttcgtcatctatttgataacgcatttgtttttgcagttctgctgcagtcagatggatcttcccatcgtttgtatcgatcattaaaccttctggaaacagttcaaccactgctcgatcccaagattcaagagaaagctcgatataatcttttactggtaattccaattctaccttaaaaaagtgcaaaacagccgacagcccttctgcttgatagatttctcctaatgttagcccctctagatggaactctggtgaaaaatgcagcaatgttttattttcctgcaattgaacatatagaaatgtagatcgctcaatcagagtatcttttaaaacaactaaaaaattcatttttctcccccttttttcatcatttttaaaatagcatattttgaaaagaaagtctgatgcttagagtagaatttcataaaaatttactatttcataagtattcacgagaaaaatacaaacaaaaaagcggaaataacgctcatccgccttcttgtttgtgtttatttcctcttcaaacgcttgtctatgattcagacttttctctatcgttattttcatctaaaagttcttgcattccgataatttctcgatattgatgaatcttagtgataccaatgactttgtctacatcaatactaaaacaaataccattacctggaatatcgatgttgatgccttgaccaatcgcatccattactttattcgtcaaactatcgggtactaatgtcaacacaatatctttttctggcgaaatgtccaaacctaaaaatttccctgaatcatgtacaccagaacctcttccatgtaagatcgttccgcctgctgcacctgcttcttttgaaaagtcgataacatcttcgcccattcctccgtcaacgatcgtcacaatcatgtgaagattcaatgctacaagatctttcatttgctttcccccaatttttgcaatctttctttttcgattctgtctttttcatcttttcgtttataaatatatcctagtactaaagtggataatattggtgtcaatgcaatcattgcaaccacaccaaacccgtcaatgatcggatctcttccttcaatttgtgcagcgattgccacgctcattgataaaataaatgtcgaacacatcgggcccgttgctactccaccgttatcaaaagccattgctaaaaagatcttgtccacttttcgtcctaaaataaatgctagcccgtatcctgggatcaagaaataataaagagagaatccgacgagcaaacgccacatagacaatcctactgctgcgccgatcccaattgaaattaccatcagcatgattttcgatcggattctcccctcgctcaattcttcaacctgtttgatcattacatgaatcgccggctcagcaaaccctactaagaaccccattaaaaagccaaggggaaccagtatataattgtaaggcaatcccgcaatagcactgcctaaatgctgtcctaccggtacataagccatattgactccgtgcaggaaaaggatcaacccaatagtcgttatcaagaaacctttcataatgtcaaagaaacgctttttgcgcatacgaaaactaatgatattcattaaaacaaataggattacgataggtgccactgccaaaatgacttccatggtaacgatttcgattccatctatcacttgctgccagaaactcattggaagatcacccccaaaatcatcacggcaagaatcggccctaacgaagcaataccgaccattccaaaactgtcattttcatttttcttttgtttgatcatactagtcatccctccggcaagggccaagataaatggaacagttactggaccagtagtcactccccccgaatcaaaagcaatcggcataaattcggaactggtgaaaaatgaggcgatcaaaacgcctatgtagcctatagccatcaattgataataggatagcttgaatacgacccgaagcagcgcaaaggctagaaatactccagtgccgacgctgacgatcccaatcagcaacactctgccaatctctccgtcagatatatcatatacttgttgtcccaaaacttgcacggaaggttcagcaatcgtgatcacgatcccgatagcaaatcccaaactgaccaaaacggtcaaacttttctttttgatcatatatttccctactagatctccgacttccatcatagaataatctgctccaaacaaaaagagcgtcattccgatcatcatgattgccgcaccaaccagaaatgaagcgaggtcttctccttctaacggtgcaaaaacaaacgttaaaatgacaatcaggacagtcatcggcaatatagcagcaatcacttctttaaaattttttagcatgtatcctcctcctttactctttaagtttaccttaaaatgaaagagttttcgagcacaaacttaaaacgttatcatttaatttttctcaacataaaataacacacgtcccaaaagtatctttttacttggaaaaatgactttgaaggaacgcgcttattgtgtttttttattttacagagccgatcattccttgaacgaattgcttttgcaaaacaaaaaatacgatggcagttggtaaagtagcgatgactaatccagccatgatcattccatagtctggtgtataggaagcacccatagcagataaaacaagcggaaccgtccgtttatcaggagattgcaaagctactaagggccataaataattgttccagctactcatgaatgtgatgattgcagccgcggcataggtatttttagccgtcggcatatacactctaaaaaaaatacttagttcttttagaccgtctaatcgagcggcttctactagatcttttggaaaagatttaacattttgtcgaaagaagaagatcaaaaaagcagtgctaacagatggcaggatgacaaccaagaaactgttgattcccaaaaccgttccgttcaattgtgaaaacattcgatataaagggatcatcaatgccgcaaaaggaaccatcatcgatagcagtagaatattgaaaattaggtcttttcgtttactttgataaatctcaaatccatatcctgccattgacgaaatcagcaatgcaaacacagtggtcaccaaagcgatcatcgctgaattccaaagggaacgagtaaaattcagctcattggaaaacaaattttgaaaattgatgatcaagttactgccaatctttatttttcccgatgtgatatccacgggtgtattcgtcattcccaaaaccatccagacaaaagggaaaatggaaataaatgataggatgcttaatgctgtatactttaatactgacccaattgtcgaacgaagttctaatgcttgttttttgacgttggggcgttcgattgtttctttttctaccatatttttcatcgactttctcctcctactttcgtttggattatcgacaatatcacaataaaggaaacaataacaaaggaaactgctgccgcatatccaaaattaggcgtgaatttataactcaaattatagatgtattgagatagggtggtcgttgcatttgctggtcccccgccagtaatattttgtacttcatcaaaaagctgcaatgtcccgatcgtcgaagtaatggaagtaaacaaaatgattggttttaaatttgggatcgtcactttgataaactgctgccatttagaagcaccgtcaatagatgctgcttcataaatctccgaatcaatattttgcatgcctgaaaggaaaaaaatcatattgtatccagtccaacgccaagtgatcgaaagaatgatcagaactctcgcccaaattggatgagtcaaccagccaatcggtgtgtcaatcataccaatgcccaacaacaagttgtttacaaggccagattgagaaaatagacttttcatgatcagagaataactgaccatcgaagtgatacatggaagaaagatagcggttcgaaacaaccctttatatttcaactttttatcatttaaaaggttggaaataaaaagtgctagaaacaacatgatcggtacttgtacaagtaaatacaggaatgtattaaaaaaagcttttttaaaagttgcatctgtcaacatccgctgataattacctaacccgttaaatgtcatattgacagggggaccactttgaaaagacgtgatcaaagccaaaaccatcggaataaaaaccatgattgatatcaaaatgactggcaagattaaaaaagcatgcccgtttttgaataaatctttctgcttcattcttttccctccaattctatcattgattatctacatgaaaagacaagaaagacaatatctgtaaggcagacgtgatcttttttgtcttttcgtttgtctgatgaaaaagcgaagaaattcacttttttaccaccgatcaattagccaattgtgcttctacttgtttttgtgtatctgctagtaccttgtctgtctcttctccattgatgattcgatgaagagcttcagctacgactgcttcaattgcataggtctcatgtccgtaattcacttctggtatttcagatgtccatgttgaaaaatcgtcaaagatcttttgaccactgtaaaattcagaagcttcttgataagcttcttgttcattcgcgctaagcatcgtagatactagtccgatttctttcgcaagagtgcccatcagttcttcattcgaagcaaacgttgcttctaggaaatctttcgctgaatcttctccagctactcctttgatcacataccagccagcgccgccaaggttagaagcttgcgctttttgcagattttctggaagtgcaggtattggtgcaatcttccattttccagattggttttctgctccttggatcgttgaagaataccaagcgccagttgggctagaagctactgctcctgattgtatcgcagttactccagcattccagtcagaggtttgttcgactagatcttctttcaaaagagtggcaaacaattcaagaccatactttaaagatgcattgtcttggatcgtgactgtctccccatcttcagatgtataccattctcctgcctgttgcataatcatccttactcgaccaaggtcagaaggattgacttcagcgattttctttcccgtcttttctttgacatctcgcgctacttgaatatactcgtcccacttcagattctccatatcctcttctgtataacctgcttctgccatcagatccgtacgatagaagtttgctgttacgcccgaatcgaaaggaacaccgtatattttatctcctactttgtttaccgcaaatttatacggtgcaaaatgatcttcctttacaatagcagacaaattagcgaatgcatctggataagaagtcaaatagccttgtatcctataatcttcaatcaagacgatattgggcaatccttctgtattcccgctcgctaaagcggtgttcagtttctgaacgatatcatcctgagacatcgtaacaacttctatctctgtttcttcgttctcataaactttttttgcttcattcactgctttgatattgaatgtctcatcccacgcccagacagtgactttttcttctttgtctgctgtactactagcacttccgcatcctgttaagaaacctgatgctgccgctaaacaaacgactccagcaattaactttctgatgttcatttttatccgctccttttccatccattagttgtttacgtttgctacattcatcataccaaaatttgaaaacggtttctttattattcagatacttcaaaaatttctcctaaaataataaaaaaatacaaatcaactatgacaaaaggaataatcttagcatctagaccaaagatcgaaatggtgaggtttctttaaaataaaaatatccttgcattttctcctagaaataagtatttttaaattacaagactattcttaaggcgggtaaaaaaatgccaatacgcgtaattcttatcgatgatgaacagacgattttagatggaatgaaacagttgatcaattggtctgagcacgggtttcaattaatagggactttttccagtccgctgaaagcgcttgatttttctttggtacatgcaatcgatatcgtggtcacagatgtaatgatgcctgaattaaatggaatcgaattatcgcggctattaaaacagcaacaacctgaaacacagatccttatcctctctagctatgatgaatttgatatggttaaagattcttttaaagaaggcgtcgctgattatcttttaaagcctcgattgagtcctgatttttttctaaattccttaactgccgtttcacaaaaaatcaaaaaaaagcccaacaaaagcccaatcaccaatcgttatgagcagatctgcgagaatctttcacagcagattgctggacaaactcgtccattgcttgaccctcttctttttgaacacaccttgtttttctgttatataccgaaaaacggccattcagttcaaaacaaggctctaaacaaaaacagtcgatcacccattcattgatggatagcgacgattcgtttactatttatcctgtttctaccttttcggaagaatccggctatgtaatcaatactgattccaaagatacacttaggaagtttgttcaaaagtttcgtcaagaagtttttccaggtgatttttttgttgtttctgattcttttgcaatccaagatatcaatgaaatattccaagagatcagaaattgcaccaaaggacaacgtttctatcataagggaaagaaccttgcttatcagcatgaacttcttccgttattaaccaaccacgagcagcaagcaagtagttatttaacaaaaatcgttcataaagactacgctttagctgtcaaagaacttgagaatttcttcacgacgatattggaacagcctattgatccagcttatttgaaacatgaggcaatcaatcgtttctatgcattactcaacgctttggctgacgagcatgttgggaatgaagaactttctttgctcaagatcgcccttccttctttattagccgatgctgagtatttcgaagatttttctattcttgtcaaagaaacacttgagaaactcacccacttttctgcaaatgcaaaaaaagacaatttcgatatcttgactttgatctacgagttcgtccaggaaaattatgagaaagaaatcaatttacaacttttatccgaaaaatatcatttttcatatagctatctctcagccatctttactgaaaaatttggtatcaacttttcaaaatatctaaaaaaagtccgtatcagtaaagccaagctctttttgacggaaacacggcttactttgacggaaatctgtgagaaagtcggctataccgaactgggttatttctccagagtttttaaagaagagacaggaatgacaccttctcaataccgtaaaggaacttttgtaaaatgagaaaaaaaatcaaagagcatgaactctttgccaaacttctgttcattttgttcatcggtctttttctgcaagccatcgtcatttctttgtttatttatcatcgatcaagggatgcctatatccagctgttcaatcaatcgaatgatgtggtactaaaaaagattcaatctgaatttgaaagtttgaatgatacaatcgagaatacattagccgcttttgattctaatccagctgtcaaaagctatttttccaatgatccagcccaacatatggaacagcttcagcaactaagaacaatccaaaaaatgaatgactctctttcaaaaatccatccaatgatcgattacgatgtattgatctttggagaaaatggaagaacttttgtcggaaacgacatgctcactgccgtatctgccgattctttttttcaatctgcgattgctcagagagtgaatgaacgtgctgctgatacacaaatgctttttgcacaccacggattgactcttcgcgataagaaagcacccagcgtcttctttgtcaaaaaactgaaaaatacattgaatcacgtttacggatatgctgttttatcgatctcatccaagcaactagcgaatctttttcaatctgtagtaaatcctgagatatcgaagatctccttcatgaacgaagaacagacgatcatcgcatcaaatgaagaaaatacaattgggagccgatcaatgattttcaaaaaactaacagtaggtgaaacaacgatttcaaatggacagcagttgacccgtcttcctctgtaccgccaggattgtacattactcagtcaagtcgatcttcattctttatctaaccaaatgggcgtgatttttccgattattttgtataatatcgtgacacttgcttttgctggctcattggtatttatgtatttggatcgacacacaaaatcgatctaccgcttgattgattcgctaaaacggctagaggaagatggcttaaaagctactgttcctgtacaaggaagccatgaagtccaattgctagggaatacgatcaatcaattgctaagtaatgctcagcatcattatgaacagacgatccaagacgaaaagaagaaacgttcgcttgaaatccaaactatgcaagcacagatacagccccattttatttataatacgctgactagcttgaaatttttgatttggcagaaaaaaacagatgaagcagttcaaggaatcgacagtttcattactttactaagaagtacgattgggaaaaaagaagaagtgattccagtcaaggaagaaatcaaaagcgtacaaagttacatcgatcttttgagtatgcgatatggcgaaagaatctcggctaaaataatgattcctgatgaactgcagtcattatctatgccgaatatgatccttcaaccaattatcgaaaacgcctatcttcatgcttttcacaataaaacgcaaggattcatcacggtgtacggcaaaacaaaaaatcagcttcttttattcgaagtgattgataacggcgatggcttcgatactgaaaataccaaacaaaaaaatgatcatttttcaggaatcggcatcagccatgtagatgagcggatacgcctaatgtatggcgatgcatatggcttaacgatccaatcagtgattgggacaggaacgactgtaacgatttgtctaccgcttcttcctaaaaatcaatcagaatatcaaaaataaagaatagccaagcgctgatttttttattttaagttaaataaatcaatcagtattcttgactttcatctacgcgtctcttctactgtcagcactggataacagcccaatatttgactttctcctccgagcatcttgatttcttggagcgcattctctactaatgtcattggacggtccaacaacaaatcgatcacgaaaaaatattctcccaagctagttttcaatggtcgggattcaatcttacttaagttgatttcccgccagccaaaagctgccagcattttatgaagcatccctggccgattagcaggtagtgtcaagatgacactcatttttactggagctgactgctggctggtcatctttcggtcaccgacgatccaaaaacgtgtctggttcaactcattatcttggatattctcagctaagatctccaatccaacatgctgtgctgtttctaatgaagcaatcgctgctgcgtcttctttcggatgttctgctacatacattgctgcagcagttgttgattctgttgctactaaaggaacattaggataatgcgtttctaaaaactgttgtgattgtgctagtgcttgtggatgtgaaaggatttttgtaatctttgttgctggattgcctaaaagctgctgcttgataggaagaacgatttcacttttaacttcgacttctggatgtttggaaagaagatcgattgtgtgatgaacagctccttccaatgaattctctacaggaacgacagccagatcgacttgtttgcgaaacaaagcgcgcaaacaaacagggatggaagcatacgcagtcaattgttctgtaggaaatagctgacaagccgcctgataagtgaatgaactttctggccctagatagctgacgttcatatgcttttgatcctttctataatggtatcgatgatcttttctggtgtttgattggtcgtgttgattcgatgtgtcgcactttcttcataccaagaaagtcgttgtgccaataatgcttttatttcttctcttgtttttccaagagctaaaggtcgaatagacgtttcatcttgttggatacgatcaactagacagtccgcttctgcctctaagtaaagaacaatcggctgtgtttttaaaaaacgccgattttctgcactttggacaatccctccaccagtcgcgataattttgtcttcatttgacagctttcttaaaatatctgactccacttttcgaaagcttttttcaccgtaatagtgaaaatattcggcaatcgacaattggatatgttcctcaatctttgtatctaaatctacatactctttttgtaaacattgagctaaccctttaccgattgttgtttttccagcgcccatgaaaccaatcagcaaaatgctagccatgagcttctcctcctgacacaagttctgctaaatcgtcaaaaaatgccggataagagattgaaacagcttcagctccttctagttcgcaaggtccatcagctatcaaagcagctacttgcagcatcataccgattcgatgatcgcctctgctggacacttttgcgccatgcagaggtgtcggcccatggatgatcagaccgtctgctgtcgcttttatctttgctcccattttctgtaattcttctgccaccgcatcaattctgttggtttcttttacttttaattcttctgcgtctttgatgatcgtgattccttctgcttgagtagccactaaagctagaatgggcaattcatcaatcagacgcggaatgatttctccaccaatcgttgctttcttcaaatgactcgtcttgacacttaaatcagccgattggttctgttcattgtgattcgtctgggtaatcgctgcgcccatctcctccaacacatctaagataccagttcttgttggattgaccccgacattttttaacaacagttggctttccggaacaagaagtcctgctgctagaaagaaagcagctgatgaaatatcacctggaacagttatctgttgaccagttaatttttgcggtccggtcactatgatcgttttatcttccactgtgatccttccgccaaattgacgaatcatttcttccgtatggttacgggaacgttctttttcaacgattacggatgtgccttctgcttgtaatgccgcaaacagcaaagcagatttgacttgcgcactggctacaggcatattgtatcggataggtgataaagagcgggttcctgtcacagtgattggtagatactggtcattttcttctccttgcaagtcagcgcccatctcgcgtaaaggttccatcactcgccccattggacgtttagacaacgaagcatccccgaacagagtagtcgtaaaaggctgtccagccaaaatacccatcaataaacgtatggtcgtaccggagtttcccatgtcaattgattcggttggttggacaaatgagtggctaccgcgaccatgaatcttgatcacctcttcctcttcttcgatctcgacacctaattgttggaaggcatgtaaagtactcagacaatcttctgcgcgcaaaaaattttgtatagtcgtcgttccttcagcaattgctccaaacatgatgctgcgatgggaaattgatttatctgctggtatcctaacagtccctcttaatccatgtatttgttgtaataattgcatttatccagcctcctatttgatccagcaatgataactggtattagacataatgattctttttgcttgtaacaaatcctgttggtttttaaaactgatttgcagtattcctaaaatatcttccctggtctcttggatcttcaaattaatcaaagaaactcccgcttttccgatcagtccagttacttctgcaataacgccaggttcatctggcacatcgataaataaatcaaaaaaggcaggaatcgcgccttgcttatggacaggcaactggtctcgactttcttttgcccgattgaaaaaagaaaagatttccgattggttctcagtcatgatccattctgctatttgtgtcatttcttgttgccaatctgccaatcgttccaataatatctgcttattgctcaacaaaatatctgtccacatgacaggatctgaggaagcgatcctagtgatatctcgaaagcctcctgctgccagttgtttggctcgcggatactcttgattgaattgttctgcctgattgactaagccagctgccagaatatgtggaaaatgacttagcattcctgttatacggtcatgttctcttgctgtaagagttacatattttgctttggttccgcaaaatagttcttgcagtttttcaacatcttttttcgtcttttccaaaggtgtaaagatgtaataggcattttcaaatagtttagcatctgctgcctgtatacctgatttatgagaaccagccattggatgtccaccgacaaaccgaagatttttctgctcagcggatgtcacgacttgctgcttcgtactgctgacatccgtaatgatgacgtgatcagacaagttgattctttcaaggacatcaagataagctaaggttgtacggacgggaacggctaataagataacgtctgcttgttctgcacctgtttcaaaatcacttgcaacgtaatcaacgatctgctgttctactgcttgctcacgggtttttgactgactatcccaaccaactactatcagttctggattggtctgacgaatacaaagtgccatagaagcaccaatcagtccaagccccacgataaaaacatgttgtgccatcttatttgccccctttttagtaatgtttcaagtagtcacggtactccttcactgcagctttcaactcaacaagcgaatcacttgggaattttgacaatagctctgtcgctaccacagtggctacaacattttccgcaacgacgctagctgcaggaactgctgtactatccgaacgttctacacttgctttgtaaggttcttttgtatcgatatcaacactttgaagtggcttgtacaatgtaggaatgggtttcatgaccccgcgaatgacaagtggttcgccattggtcattccgccttcgaagccgcctagattattggtacgtcggaaatagcctctttcttcttcccataggatctcatccatcacttctgagcctggtaatgaaccagaagtgaatccgaccccaaattctacgcctttaaaggcattgatactaaccacagcttgtgcgattttggcatctagcttcgtgtcccattgtacgtagcttcctaatccagctggaacgcctccaacgagcacttctacaattcctccgatcgtatctccatttttctttgtctgatcgatcaaatcttttattctttgctcaactgctggatcaacaactcgtacttctgacgcttcagaaatttctttgatttcttgaatcgagatatttccaggtatttctgcttggattccaccaagacaaatcacgtgtcctgctacgatgatgtcaagttcttccagaattttcttggcaattgcgccgattgctacacgcatggtcgtctctcttgcagaggaccgttcaagcacattccgaagatctcgatgatggtatttcataccgcctaccaaatccgcgtgtcctggacgcggacgtgcaactcgccgcagtgattggtctttttcaggcacttctgctacagacatgacagttgtccaatttttccaatctttattttctaccactaaagtgacaggtgaaccaattgttttgccgtgacggatgccagacgtgatccgaacacgatctttttcgatcttcatccttcctcctctgccgtaaccagcttgtctgcgagcgagttcgtgattgatttcttcttctgacagaggtaatcctgctggtagtccttcaataatggctgttaattctggtccatgggattctcccgcagtcatataacgcatcttacagtcctcctaagtaatctttgaatgtctctgtgggaacaggaacgatttttgcttgcccaatcttttctagcaagatgatattcaattggcttcctcttgctttcttatcatgggttatcgcgtggaataattcatctggatgacttagatcgtacgtaatcggcagatggaatttttgaagtatcctttctaaagcagctgtcgatccagttggagacaagccgattttttctgcatgagaagtgatggctaccattccaatagctactccttctccatgactgactaccccatatcctgctgtattttcaattgcatggccaattgtatgaccaaaatttaaaataagtcgatttccttggtcaaagacatcttcttccactacttttcgtttgatttccaacgtagcagtaatgattggaacagcatgttccagaagatctttttcgtctttcagctcgttcagctgtttccaaagcgttgcatctgctatagctgctgatttgatgatttcagcgattccttctcgtaaacgacgtaccggcaaagtttttagaacctcaggatcaatcaatacaccagctggctggctaaatgttccgacaaggtttttcgctttgtttgtattgactgctgtcttcccgccaatactagaatctacttgtgcaagtagcgtagtcggaatttgaacgaaatggatcccacgcatgaacgtcgaggccacgaatgctgctagatcacccaccattcctccaccaagtgcaagtatcccatcgctgcgggtaaaatcattatctgctaaaaaatcgtataactcagctgcttgttctaaagatttactggtctcacccgccggtacgattgaaaggactggttcaaaattagcttgtctcaattggaacatgattttttctgcatatagtggagcaacgtttgtatcagtgatcacagctactttttgaggtctccaaatcgtttgaagccatgatccagcctgttctagtgcgcctttttcaatatgaatatcgtatttttggttatcaacatgtacagtaagcattcgtttcacttctttcttttaaaaagctggaattaatcgagtgtctgaatcttttccattgcttctttcatgatcgcaacttctttcatcatgcgtgagtaagtcttttcattcaacgattggggaccgtctgaccaagcatttgcaggatcaggatggatctctacgatcatgccatctgctccgcttgccacacccgcacgagccattggtggtacaagttcccaaattcctgtaccatgacttggatcaacaatcacagggaaatgagttaattttttcatcaatgggacagcacttaaatcaaacgtattacgtgtcgctgtttcgtaagtccgaatcccacgttcgataaaaatgacaggagatttgtcttcgactgcaatgtattctgcagcattaagccattcattgatcgtaccggaaattccacgtttcaatccaacaggtttacctgttttaccgacagcagatagcagtttaaaattttgcatattacgtgcgccaatctgtaggatatcgctgtactcagccaccatatcgatatgcccttcatccatcacttcagtaatcactttcattccaaattcatcagccgcttgacggatgtatttcaatccttcttcttctaaaccttggaaagcatatggagaagtacgtggtttgaaggcaccacctcgcagaatttttgcgcccccggctttggccattcgcgcacattctctgatttggtctaatccttcgatagaacaaggaccagccatcgtcacgaaactgccgtcaccaatttttactccgtctacatccacgactgtattgccaggatggaattctcgagaagtcaatttgtatgtgtttaaaatacgcacagcattttctactccttcatagcgtgtaaatgctccttcttgtaaacttcgcgtatcaccttttagtccaatcactactcgttctgttccttgatcgattgagactttgaatccttctttttcgatatgatcgacgactttttttatttgttcttccgttgcttcttttttcataattactatcattgtttttcccgctttcttttgtttacttatctatcttggctgattttctctactttttcaaggtggttttacattaattcctactaaatgaccgtgtcctgttgttctcattttcgctccttctttcctacttatgacccagataatcaacaaaaaaagatgtccctgtaggaaattgcctctacagtgaacatcttcaacgagccttaaaaagcgctgcaaaaatataaaatagccactatagatgaatttctctacgtggctgtaagtcgtgtttaaaaatctttagccatcatagatacaaacctggtttgtttgtacccacgaagtcatgaatacaaacctatctaaaatagctaaagtaatacgtattcagttttgtaagttttctagatttcataaaaaatcgctccaaactgatgtaagaattgtacctagtatagacataaaaaaatcgactgtcaatcatttttatgaaactttttttaattttctgatagttaactttgtttttcagaaaaataacaattggttttattgaagaaaatagtcatgaacaaaagtatctgagaacttttttactctcttgttcatgacatatagaataaagcagctttgtcttgtaaactccgtttttcaaataataatctaaagattgctactgaataataaagccgatttcatggtcctcttcgctgctgattcggtaaggtgactcaacatccgctccccagctattgatacccccgactcctcttacttttgcaaaaatcgtaagaaccgttcgtctttctggcggtagttcttctatatgtgttgcctgttccagttcttctgctttgaatggtaaagcggaaaaagcaaatggcgtatcctgctgttcaaatcgcaacgaaaaatcttcttgatctttatccgtattatccaacgtttgatttcttgttagttctacccatttcgtttccatatgcatgccgcattcttggggaacaaggtatggggaaacggggagtcctgccactttataaataccttcgacaccaccagccatccgatccggatatgtttcccctgataggccttcatactcaaaaaattttgctttcgttggcataatgaaccttaaacccaatgcgggtaattccggtaatcctttttgtccataataatgcatattgacaagcattttaccctctccagcgatttggtaggaaattgtcacttgggtttttggtactgtgttgatttccagtgtaaaaatgatttcaaccgtttcagcgtattcattacttgaatattgattatttactggagcaatcggcaaatcgatctttttattgtccaccagtacttctatttctttgacttttggatacaatccggctcctaaccacataccggatttaaatccaaatccgctacctctgtcattatcggtcgttgctcgccaaaaaactggaagtgtttcccggtatagccattcttttccgtttttattgagcgattccagtccgcctcttgtataagaaaaaatataatgcgtattccccgatttgacacctaatgtacagtcgccgaagacgattgcaactttttccgtatccatatgacttttatttactgtatttttcataataatatcttacctcctgcatggcgggtttttcttgtccatctgcaaaaacgatcccattccctgagaattcatagtcacttggtttatcgtcaaagtcaccgccatagcgcatcacttctctgcctgtgattggatcagtcacttggatcgcctgatctttaaaatcccatatatagcctccttggtacatttcataacgatcaagcaacgtcatgtaagaatccattccacctaacgaattccccatgtcatgcatatattcacataagatgaacggtttttccgctttattttcaaggtagtcaatgatctcttctggtggcgcatacatgcagctttttacatctgaaatcgaatcttcgaatgctggatttggaaaattcccttcataatggacaagtcgatcggggtctacttttttgaagtaatcgttcatttgtcgaatgttttcttccgcataagattcatttccaagagaccaaaaaagaatacttggatggttttttaatgtttcgaaattcgtttttgctcgatcaagaacagccgcctgccactgaggtactgcacctggtacgttgtaagaaggctcaaatgcgcccattttttgccatgagccatgggattcgaggttcgtttccgccatcacatggattcctgcttggtcgcataaataataccaagtgatctggttggggtaatgagatgtccgtacgccgttgatctttgcattttttatgatagccaaatctttttccatatcttctatagtgatggcgcgtccttttttcggatgccactcatgtcgatttaccccgttgataatcatccgttttccattgaagtagatgattttatctttgatttcgattttacgaaaaccgaaggaatagtcaatatactccgttactcttttttcttcgtctatcgtctccaattcaagcttatataaattgggctgaaaatgcccccacagtgccacattttcaaatccatcgatgcgaatcgtcatttgctcttttaacggatattgctgttgatagatttccttcccatcaggatctagtatcgctacattcagctgactgtttttggctacttgctcaaaagacaaatctacttcaagtttgccattttgacatttgtcatctaagcgaggtttgatccaaagatcttctaaatggttttgtcctcgagcaactaagaagacatctctgaagatcccaaaaaatcggaaaaagtcctgatcttccaagaatgcagctgtacttcttttgtaaacctccacagctagaatattttcttcttccaaataaggtgttaaatcaaattcagacggagtgaacgaatcttcggcatacccgataaaatgaccattcaaccaaataaacattgcttgttctacaccagcaaaatgaatcgagatttgttttccctttagaccttcttctaatcgaaaagtcgtcaaatacgaaccaaccggattgtctttagcagctgaaaagatcccttccgcctctttctcagggcttgtcgtgaaagggggacggcgaaatacatgtccctcccacggatacatcgtattgatgtaatggatcttgtcataatttgctaattcaatatgactaggaacagtgatttcatcaaaagaacaggcatcaaaatcttttttataaaatgtttttggtcgtaccgaaggatttggcgaataacaaaaacgccatgatccatttaaagactgtttaagggaggatgtggtttctacttcttcccttgttgcataacaaacatgatcgctatgtgcatttgattggttcactctaaaaacttgtggatcatctaaccattttatatttgctttcatacttttttccttctctctcataactttttgaaatgaagcagttctgtttggaaatcaccttgaaaatcggggaagtaaagtccaactgtcatcaattcggcccccgaaaatatccgcttcgaggtctgttcctgataaagtgcctcatcatctaaccccatcagatatacttcatggaacgctggttgagctgaagctagtatcctccctaaaaacacaatagcttcatcttgtttaggagacacaaacatccatgcggcaatattttcttcaaaaggactcgccaaacgataataatggccatactggatcaccggacgaatcgtttgataggatataatttggtcttttacttgctttttttcttcaggagacagctttgtcaaatccagttcataaccaaaaacagcgctcatagctgtttctcctcttgttttcaacgaagtagatctgtcggtctgatgatttggtacagctgatacatgagctgtgatggacgaaatcggataagcaaggcttgttccatattggattttcatacgctccactgcatccgtgttatcacttgtccatgactgcggcatataataaataaacccggcatcaaaccgtccacctccaccagaacagccttcccataagatttccggataatcagttgtcaaatgttcaagtagttcataaagcccgagcatataacgatgcgctacttctccttgtctctgtgggtcaagggtaatcgaatagacatctgaaagcgaacggttcatatcccatttgatgtagtcaagaggaatcgtatctaaaatctttctcatttgtttctcaatcgtctgccgaacatctaaccttgtaaaatccagtacatgttgtgatctggaagcagaaggcattctacctggctcctgcataagaaaatcaggatgtgttcgatacagttcagaatcaaccgagatcatttcaggttcaaaccataaaccaaatttcaatcctttgctatgagcataatctgctatttcacgtaatccatttgtcaacttgccttcatactcgaaccagtctcctaatgaagaattgtccgcatctctttttccaaaccagccatcatctaatacgaacatttcgatgcctagctcctttgcttcatcaatgatcgccttgattttttcactattgaagtcaaagtaagtggcttcccagttattgaccagaatcggccgttcagcaaattgatgacgacctcttgcgattctttcacgtagcaactcatggtggatctgactcattttgttcaatccctgacttgagtaagaaaggatcatttcaggtgtttgaaaagactggcctgcattcaattcccacgaaaaacgatggctgttgatcccaccgacgactctcaattgattgatctgatctttttcaagttcgaaagaatggttgccggaataaacaaattgaagtccgatcgcttctccagtattttctgtcgtatgatgatgaactaaagcaataaagttattcatatggtgactgctcgttcctcgacggctttcaaatacttttgttccagataaaacagattgccgtgaaatctgtctttcattgacatgtgctcctggcaaagcaatgacttcatcaaatcgcctagtatgggcaaagtctagctggaaactagccgctttttctagtttgattgtttctccggtttcatttcttatctttacagatcgtgtgatcactgctctatcagtaaatatggtatagaacaaatcgaaataaatcgctgtttctctatccttaagtgaaatcaccaacgtttgtgcctctgacttgtccatcacataagtttgaggcaagccttcgatctctggcttcccatctgtaatataatggctgtcatatctcagatccagtaagtctgatccattcttgcgctgaatgatcgatgcgggcgttcgaaagtccatgctgccatgagaagagtattcttgcggtagtgtatctttcgacagagaccggtcaggatttaagggaacatttcctgaaaatccacgatctcttcggggataatttttattgtctttgtactgcttgactggtttgccaaaataaatatgcgccaatacattgctttcttctatctttatcagataagaaagaaatgtatttcgtaaatggaagactcggctcttttcatcaaataagatgaaatttttatctgtttttctatgcgtaatatccatcatttcactcccaacaaaacggaaaccgtttacttttttttataattcctgtatactgtttactaaacaattttgtcaataaaaattttttatttttttgaggagtgtgtaaaaatggttggaattagagatgtcgcacgaaaggcaaatgtctctcctgctacagtttcccgtgtgttgaataacgatcagacgatccatgtggctcagactactcggcaacggatagtagaggcagctgctgcgttggattatgacatcagtactcgtaaatatatcaaaaagagaatgccttcgattggtgtgatctctacgatcggcaaagcgagcgaagaacaggatatctattacaaacatttgcgagtagggatggaagaagaagctcgacgtctgcatttagggatgaatcgaatctataatctatctgataatcctaaacaatgggaagatctagatcagttaggtgcggtgatcgttgttgggactgttacgaaagaatcgattaccgccttgttaaaacaaaacatgcaaatagtcgtcgtggataaccctgacatcccagcaagaggtcgatatggtgtatgcagatcttgaacggatgactaaaaccgtactggaattgttcttagaaaatggtcataaaagaatagcctatatcgggggatataaagtcgatatggatgaattcggtgggaagcagatttctataaatgaaaagaggatgcgtgcctatcagcattttatgatcgatcatcacttagaaaaatatatgtcttatcatctaggtggctggacagaaaaacaaggtgaggtacttgcgactaatctattagaaaatgaatcccctcttcctactgccattcttgtcgggagcgatccaatggcaattggtgtctatcgggcattgaaacaaaaaaatatccaaattggagaagagattgttgtagcaagctttgataatatcgagacaatcgcaaacctctcccctggcttgaccagtgttcaaatcaatgcgaaatcaattgggcaagcagctgttcgaatggcattggagcgaattgacggtatacgggacgaaccaatcattttgacttatcctgcacgattgattgttagggaaagttttatcccaagaacaaaaaggtattgaaagagaggttgtgaaaagccgcttcgtttcttcatactcaaaacgaaacggctttttcacaacctcttacttatacttattcacaaaatccaatgtctgctggtaacaattttgcgattcttttagcgtgtaatcaaattggtattcatgggtaatctctttttttgtatctgtataaaacaaggattgcacgggtacctttaattctgtcaaccgattttctaatgcttgaccttgctcctggaatgagtatgcatttccgtcagttatatacgttggcggaaattccttagaaacatggtcagccacactagcttctttcaattgctcactcgttttccaatcttttgttccaatcaacgaccacgcaacggttttgacgaaaaacttcataaatcgatcatccgaatgctgctgtgctgttagcttcaaatcaacaggtccgcaataagaaatggttcctttcagactatcttttggaagtagctgtttgattttcatttgtttagcatacgcatcattcgtttgtatagctgcatattgcaatgcgatttgtgaacctgcactatctccaccaaaaaataattgttccatgtctagcaatttgtcgtctttttcttcagctaataaatctttgatcagttcattcacttgaagaacttgattagggtattctgaatcaggcgctaattcataattcatcgcaaccactgcgatgttggcgtctgaaactaattttgtcgcaaattctttgacacccgatttatctccgccgacgaatcctccaccatgtacccaaaatagaacaggaacaggccccttgctgttttttggatagtagatgtcataagtattctctttatacttggactcatacgtcaaatctgtttttttcgccacgtttttttctgcttgatcgaacgtttttttatcagtgatttgaacagtatttgaaaacatatggttgatcaagaatgctccaggtctgggggaaagctggaaggcaagaaagattgcaaacgcgatcccaagaatgattccgaagaaccatccgataaatttaagaattttctttttcataaggctccctcagtagttagtattaagcattctgattataccatagtgttatttcctatcaagctctcctagatgatttaatgattttccccaaacttcttctgcaatgcttttgacaaaagaaattttttccattgttcttcaaacaaaacattttcttcttctgttgaagcaaatccacattgaggacttaagcacaaacgatccaaaggcagatatcgtgtcgcttcgtagatccggtcaatcacttgctggtgctcttccatttcgccatttttcgttacagtcaaaatctaagacaactaatttatcttcagagactttctctaaaagaacaaaactcccagcacgttcactatcgtattctaaataataggcacggacattttcttgagtaaaataatgggtctgctacgtcgtcatcccccctgatgccgccaaaatcgaataataatttccgcgtcaaacatgtatatttagtgttgaatcatttgagaatatgaaaataaaaatctttttgatcaatcagttaatcaaattgaaataacgaaaaatctgagacagaatgacgttcattctgacccagatttgattttgcacaactcaacagtccttattggcaaatcgccaaaataatgtagactaactaaaaagactaagaaacaataacaaaagttaacacttcttagtctttctttagcacgtctatttattaaagattttagggccttttctcatgtttttacgatcattcttaggtgtttccatttgtttggatcggcctccaccttgtttctttttgatcaattctttcattttttctttttggtccatttttattctcctttaacgaatgaagcgactaattcgatatgatgggtttgcgggaaaagatctacaggctgaactttcttcacggcataacctgcttctgcaaataacttagcatctcttgcaaaagttgccggattacatgagatatagacgattcgttctggtgacatttcgattgctgattcaataaaatgatgatctaatccttttcgtggagggtcaactacgatcacagatggtttgatccctttttcttgccattttttcataactttttctgcttttccgacttcataatgaacattttcgattttattatttaaagcattgaactgtgcatcttcaattgcttctggaataacttccatcccatacaccttatccactctgtctgctaaagacaagccaatcgtacctattcctgaataagcgtcgatcacaatgtcttttttatctaactcggcaaactcgatggctgtttggtacagatactctgcttgttgagtatttacttgataaaatgactttgctgagattcgataggtttttcctaatagctgatcttcgatatagtctctgccatataaaactttttctttgtctcctaaaatcacatttgttttttcttcattgatattttggatgaccgaaaccacttctggcaattcttcatgaatagcttcagcaatttccttggatttaaagaatttttctttacgagtaactaaaacgaccatcatttcatgggaataatgaccacgacggataatgatgtgacgaagctgtccttcatttttttcttcattatatcctcgtacttggaaccgttgcaagatatctctgactactttgattgcttgatcgatgacaggatcttggatataaaaatcttcgatagggactagatcatggctattctttttgtaaaaaccggtggctaactgtccatcgatacggcgaacagggatctgtgctttattacggtagccgaatggttctgccattccgaccgttggaagtacaggaacttctggcatcttagcaatcttcgccattacatgctctacttgtttttgtttgaagacaagctgttgttcatacttcaaatgggctaaaggtgcgatacctatgcgaagtaatgcattgttttctacaggctgacgatcaggtgattgtgtaataaatgtttcgacttttccatatccaaacttattgcctgcttttactactagtatttctacttcttctccagggagtgcattttcgataaataatggataaccatcgatttttgctacccccattccttcataactcaagtcgacgatttcgactgtatatcgttcgtttttctttactatttgctgttctgtcatattttgctcctttaagcctatttttcaatcctactgaactctactataaatcagctaattacacaactaaaaccggcactgaccttactacgttcagcaccggcttttgattaattcttttgattaggtgtttcgtctgctatttttccgtcaccgtcgatatcttcatccgttaaacgttcgacttcttttacgaattctttgctgacaacctctaattcttcttcatctgtacctgtgattgcttcatcaggaatctgatcggtattggcaaagaactcaatgtgttgatgaagattttggaaatgcatcggtgcttccccgccgtattcaccatctaagttgatcattactggtcgattgatatcatcttctgtttcaacgaacaaactgcttgttttggtatagattattcttggatcatcgacatgtcgaccgccattcagcatgagtgctgcaatatgcaagatctcaaagatatttgctgtcttcacaatgattaaagaaaacttcccatcatccaatttggcatctggcgcgatctgttcgaatcctccaacagagttcgtcagccctaggaaaaacatcgaagcatttccgatatattccccttcatcatacttcaagcgcattttgattggctttactcgagggagcatctctgctcctttcgcaagataagcaagataaccaaaaatactctttagttctgatggaacttcataagtcaattctgtcaaatagccacctgcagcgatattgatgaagtaactgttatcagaaaggccgatgtccatttttacggtttggtgtttttttatcacttctgctgctgctttaatattatctctaggaatttttaatgctcgagcatagtcgttcgttgtaccagctgggatgatggccattttaggacggtgttcaagcggagcgattccattaaccacttcgttgattgtgccatcgccaccagctgccactactagatcaaaacctagttctgcgactctacatgcttcattcttggctgaatctggttctggtgtagttgcataggcgctggcttcaaatcctgcttcttctaatgcctgtaggatatccgccaaattttttttcaataattcttttcccgaggtggggttataaattacgcgtgcttttttcattttcagcctctatcgtttcgctaattcatctttaagtagcttattcacgacaccaggatttgcttgtcctttagttgctttcatgatttgaccgactaggaagccaaccgcacgatcttttccatttttgaaatcatcgacagattgttggttgttatccaaaatttcattaatgattggcagtagtttgttcggatcagataattgcacccaaccatttttttcaactacttcttgggcttctccgccatttgtgatcaattcacggaagacttttttggcgatttttgagctgatcgttccatcggcgatcaaacgaatcattcctgctaagttctcaggtgtcaattttgtctcagctaattccagtttctcactgttcaagtaagcagaaacttcacccatcaaccagttagatgcttgcttggcatctgcaccattttccaaaacagcttcaaaaaaatcagacatttcttttgtaagtgtcaataccattgcgtcatactctggaagtccaaactcacggatatagcgttcgcgacgagaagctggcatctcaggcaaactagcttttactttttgaatccattcgtcatcgatcacgaatttcgggatatcaggctctgggaagtaacgataatcactagacccttctttgacacgcatcaaaactgttttattcgttgtttcgtcaaaacggcgtgtttcttgttggatttctcctcctgaaagaagaacttttgcttgacgtttttcttcaaaagctaaaccttttttcacgaaagataaagagttcaagtttttcaattctgctttcgtaccgaactcttcttgtccataagggcgaagagaaatattggcatcacagcgcatagagccttcttccattttcacatcgctgacttctgtaaattggataattgatcgcaatgcttctagataagcgtatgcttcttctggtgaacgcatatcagcttcagaaacgatttcgatcaaaggcgtgccttgtcggttcaaatcaacgtaagaataaccgccaataccatgcatgttttttccagcatcttcttctaaatggacacgttcgatccggatttttttctttttaccttctacttcgatttcgatccatccgtcatgaccgattggttgatcaaattgggaaatttgatatgcttttggattatctgggtaaaagtaatttttccggtcaaaatgagtatctttagagatttcacagtttaatgccaaagctgctttcatcccgaattccagcgcagctttattcattactggcagcacgcctggataaccccagtcgatcacgtttgtattgctgtttggttctgcaccaaaatgagctggcgctggagagaaaatttttgagttggtttttaactcgacgtggacttctagtccaatgactgtttcaaaattcattcgtctttccctcctaaaatagctggttgttgtttatggaattctgttgcttgttcaaacgcatatgccgcttgatacatcgttttttcatcaaaataattaccgatgatctgcaatccaactggtaatccttctgataaacctgccggtacagacatacctggaagtccagccaagttgacagggatcgttaagatgtcactcatgtacattgtgattggatcgttaatgttctcaccgattccgaatgcaactgttggtgaagatggcccgatgatcaagtcataatctgcaaagactttttcaaaatctcgtttgatcaatgtacggacttgtcctgcttttttgaagtaagcgtcataataacccgcgcttaaggagaatgtacctaacatgatacggcgttttacttcttcaccgaatccttctgaacgtgagttgacatatacatcatctaatgatttcacattttcagagcgataaccgtagcggataccatcgaatcgttgcaaattggaacttgcttctgatgaggcaatgatataataaacagccacaccgtattttgaatgaggcaagctgacttcttccacaacagcacctaatgaacggaatgtttctgctgctttcaatacagcttcttttacgccaggggccacaccttcgcctaagtattctttaggtaaagcaatcttcattcctttgatgtcgcctgtcagtccctctgcaaaatcaggaactgaaacgcctgaagaagtaccgtctttttcgtcataaccgctgatagctgtcaatgctaatgcattatctttcaccgtacgggtcattggtccgatttggtcaagagatgaagcaaaggcaatcaaaccaaaacgtgagacacggccataagtaggtttcatccctacgatgccgttaaaagctgctggttggcggatacttcccccagtatcactacctaaagaaactggaatttgtccagctgcaactgctgctgcagaaccaccagaagagccaccaggtacttttgttgggtcccaagcattttttgttttcttgaaataagaagtttctgtacttccacccatagcaaattcatccatgtttagcttaccaacagggatcatatctgcttgatagattttatccatgaccgttgcatcataaattggttcaaaattgtaaaggatcttagatgcagcggttgtcaagatatcttttgttacgatattatccttgataccaattggaataccagcaaggacgttgctttcatcaatccctttttcatctaaagcttttgcctgttccaatgctttttcttcgttcaatgtaatgaatgcctcgacctcaggctctgtttctttgattcgttcaaatgttgtttttgtcaaatcttgtacagtgatttctttcgatacaagcatatgatgcagttcttctagagaacgattgtgtaattctgtcattatgcgccagcctccccattatcgatgattgcgggtactttgataaagccgtcttctgtttccggcacatttttcaataattcatcgcggttccatccagcttgcgcccgatcttgtcgcatcacgtttactgtttcaaccacattcgacgtaaatggaacaccttccgtatctacttcttccagcatttcaaccatatcgatgattttacctaattggtcggtaaaacttgcaagttcttcatctgcgaacgcaagttttgctaatttggcaacgtgtttcacttgttcttcactaatcgccatactaccccttctttctaaacgagttaaaaactttgctctctattttaacacaagagtgccgtgtctgaaattgtttattgaaatttgtctgaaaaaactcatttttcattcttctactgagcgacttttagccaatgcatctgccatttgatcttctgtccaaacttcgattcctaattcttgtgctttggtcagcttgctgccagcatcttctcctgctaccacgatatccgtttttttcgatacgctaccagtcactttcccgccaagattttcgatcgtctcttttgcttcttcacgagtaaatcgtgttagtttaccagtaaggactactgttttttctttaaaaggagactcgacttcttgcaattgggcatttcgaagccctttgtattcgaaattgacgcctgcttgttttaattcattcatcaattcatggacttcttcgttactgaaataagtgactacactgtcggcaatgatatcaccgatcgtatcaagcgcaataatcgactcatagtcacttttactcaatgtttctagatcaccgaaatgttctgctaaaatttttgctgctttcgctccgacatgtcggattcctaacccgaaaatcaaccgctcgaccgaattatctttgctgttgtcgattgctgtcaaaatattatttgctgatttttcttttattttgtccaacgtcaataactcttcttctgtcaatttgtaaagatcagcaacatctgctactagttttttatcatacatctgttctagtacgcgcggccccaacccatcgatattcatcgcatttcttgaaacaaagtggttcaaaccttctttcatttgagcagggcatttaggattgatgcaccgtaaggctacttcttcatccaaatggacaagttcacttccacaaactggacaatgtgtaggcaattggtattcttcgctgtctttaggtcgtttatctaacacgacttgcgaaacttctgggatgatgtctcccgctttataaatcagaactgtatctttcaagcggatatccttcaacttaatataatcaccgttatgcaggctggcacggcttactgtcgttcctgctactcggactggtgtcatgatagctgttggcgttactacccctgttcgaccgactgtccattcgatgttttcgattagcgtttcaacttcttctggcggaaacttgtaagctgctgcccatctcggtgctttgatagtaaaaccaagttgatcttgtagcgagaattcattcactttgatgacgattccatcgatttcatagggcaaatccacacgtttgtcatgatattcttcaatgtatgaccacacttcatcaatcgaatgacatagacgtttttcccgattcgtgtggaatccaattttttctagctcttctagcgcatcatactgggtttttgcttgcataggaccgaaatcagctactgtgtataaaaaagtgtccagatttcttttcgctgtgattttagaatctaactgacgcaaagaaccagctgcggcgttccgaggattcgcaaagatatcttttccctctgcttctctgtcttggttcaattggacaaatgaccgttttggcatgaaacattcgcctcttacttcgatgttcattggttcttttaatttgattgggaccgaccggacagtttttaggttttcagtgatgttttctcctacagttccatccccgcgagtcgcacctctcacgaaatttccatcttcataacgcaaagaaacggaaagtccatctatttttagttcacagcaatagtcaactacacgtcccactgctttttgtacacgttgatcaaaagctatcagctcttctttgctgaaaacgtcgttcaaactgtaaagcggaatatcatgagtgactttttcaaaaccttctaatacttttccgcctactcgttgagtgggagaatcagacgtgatcaaatcaggatattgttcctcgattgctactaattctgcgtattctttatcataaacatagtcttccactgttggtttatcttctacgtagtattcgcgagaccattggttcagtcttgtacgaagttcttctgctcgtttagcagcttcgtcaatcgtcatttcatgttccatcatttaccctccactactaagctttttcaattggcgcaaaggcagccaaaagacgttttactccttgacttgggaaagccacatctagttctagatccttcgacgtcccgcttactcggacgactgttcctagaccccattttttgtgtttgactttatctccaggtttccagctgttattttcccctccagtagcacttttagagggaacaaccgctgtctctggctgtttatagctatatgctgtttttttagcgaatacaggcgtttttttaggcgtaggacgcatgccttcgatttccagtaactcctgatcgatttcttctacaaaacgagaaggtcggttatattgcgtccgtccatataatgttctggagaaagcatttgttaaatacaacgcttcttctgctcgcgtgatccccacatatgcgagacggcgttcttcctccagttcgctttcttccatcaatgctcgagataaaggaaaaaccccctcttctagaccaatcaggaatacaactggaaattctaatcctttggctgcatgcaaagtcatcaatgtcacttgggaagcatcttcttctaaattgtcaatgtcggaaacaagtgccagatcatttaagaagaccgttagtttttcttctggtgcatcagcgtcttcttcattttgctgttcgaattgtttgtcgaattcttgtgtgaccgttaaaaattcctccaagttttcgatgcgtgcttgtgcttctaatgtattttggatttttaagtcttctagatatccgctacgatccaaaacctctttcgtcaattctgtcactgtcaagtatgggatcatctgagtgacttcttggatcatctctccaaatgcacctaattgctgtcctgcttttccaccgatatttgccagatccacattttgcgctgcttcaagcagtggccattcatgaagagaagcaaaactgcgtagtttttcgatagatcctggtccgatgcctcgtttgggcgaattaacgatacgctcaaaactgattgaatcttgaggatttaccagcacattcaaatacgctaaaatatctttgatttctttacgatcgtagaacttgtgccctccaaccattttataaggaatatttgctttcaacagagtttcttccattacacgagattgtgcgttcgtccggtacaagatggcaaagtcgccgtaattccgatgattgcttcgaatctcttcttgcatccggtctacgataaaacgggtttcgtctcgttcattatctgcacggtagtaagtgatcttgtttccttctttgttttctgtccacaagttttttggttttcgattgctattgttttcaatgacttggtttgctgcgctaaggatgtttttcgtggagcgatagttttgttctagcaaaattactgcagcatctggataatctttttcaaaatccaagatgttctgcatatctgcaccgcgccagccgtaaatactttgatctgcatctcccacgacgcacaggttcctaaatctacctgccaataaattgactagcgtatactgtgcgtgatttgtatcttggtactcatctacatgaatataatggaatttgttttgataatacgtgagtgaatcaggatgttcttcaaataatcgaatcgtattcatgatcaggtcgtcaaagtccatacattgattatattgaaactctttttggtaagcagcataacattttgccgcaatctcttcgtaataactgccttgcatttttgcaaaatcctgaggggtctgcaggctgttttttgcttgagagattgttcctaatatacttcgaggatcatattttttcggatcaatgttcagttcttttagtatccgtttcatcaaggtcagctgttcagaagaatcgatgattgtaaagttccggttatacccgataaaatcaacatctcttcttaaaatacgcacacacatcgagtgaaaagtcgatacccagacatcttcgcctccagatgcgagaatcgcattgacacgttctttcatttcttttgcagccttattggtaaaagtaatcgctaggatgttccaaggattgacttctttttcctcaatcaaataggcaatgcggtgtgtcagcactctcgtctttccacttcctgcacctgccattagcagtaatggtccgtcagtgtgaagaacagcttctttctgacgggggttcatcccgtttaataattcagctttggatgacattaacaacatcctttcttttatcaatcttgttaattatagcattttcttggctttcattaaactagctagttcaaaatcatttgtttctttttatggatttttccttgtcaattcgttgatttcgcgctaaattaaaagaaagcgaggcgtttgaatggaaaaaaaaggaaaaatcaagaaattagataagactcagatatattttattctaaaaggaatatttgttggactgctgacaggaatcgtcgttagcctgtttcgattatctatcgaaaagctaagcgatttagttcgaagtatctatgaaatgagtcgggaacagccgatttacttaattggcctagctatttgctgcatccttgcagcatttttcgtgggttatctggtcaaaaatgaaccggatatcaagggaagcgggattccacaagtagagggacagcttcgcggggaattatcaatgaactggttctctgttttatggaaaaagttcattggcggtgtactttcagttggtgcgggcctttttctaggtagagaaggaccttctatacagcttggcgcatccattggacaaggagctggacaattgtttcggagtccatcttcagaagaaaagattttaatttctagcggtgcaagtagcggacttgcagcagcattcaatgctcctatcgcaggattactctttgttttagaagaaatccatcactccttttctccacttgtttggctgacatcatttgcttcagcaatcactgctaacttcgtctctctttactttttcggcttgagacctgttttatatctaggtgaccttccttctttgccgttgaaatattatggttccttagtgatcttaggagtacttctaggcatcttaggttttatttatcagaatgtcttgctggctttgccaaaattttacaaccgattgcctttaccagcttattttcacgggttcgttcctttcttgctgattttgccaattggttatttatggcctagtactctaggcggaggcaatcaaatcgttttagcttttggacatgcttccttgccaatcattatgattatcggtttgtttgttcttcgattcgttttttccatgatttcttacggtgggggtcttccaggggggattttccttccgatattgacattgggggctttaatcggtagcttttatggaaacattatggttgatttcgggatggatccaatctacatcaaggattttgtcgttattgccatggctggttatttcacagcgattggaaaagcaccgctgacagcaattattttagtgacagaaatggttggctctcttaatcatctgatgcctttaggattggctgctcttgttgcttatatcgtcaatgaccttctcggcggtaatccaatttacgaatcattattggaacgtctacttggaaatactcagaccgcctcactaaaaggtgcaaggacaacttttgattttccagtaacggcagagagttctttagacggattaatggtacgagacttcaattggcctaaaaatatgctgctaatctctatacgcagaggaaatcaggaaatcttgactcacggtgatacgatcatgaatgtaggagatattttggttatcttgactgatgaagcaaacttgccaagaatcaagcaggaaatcgaggctaaatcttctatcacaaatttgaagcaatcattttaacgaacatggaaaaactattttacaacaactattcatctacactacttgattctatatgattctataaaaaaagaagaggctgggaaaacccagcctcttcttttttatttctatgcttctgctactgcaggagcttttctcaataaaccataaatcacaccagatacgactgctccgatagcaataaacaccaaatacatgaccgggtgactcagtaagaatacaacgaaaatcccgccgtgaggagccagtaatttgattccgaaagctccgactaatccgccagttaaagcagaaccaataataaaacttggaatggcacgaatcgggtcagctgctgcaaatggaatcgatccttccgtgacaaacgatagtcccatcacgatgttcgtcaaaccagcatcttgatctgttttgctgaatttattcttaaacaaacgtgtagcaacgaaaattgccaatggaggtaccattcctccagccataacagaagccatcacgacacttccgccagttgcaacagtcgtagctaaagttgctgtaccaaacacataagcggctttgttgattggaccgcctaaatctgccgccatcattccagctaataatgcaccaagtaaagcagcattcgaaccactcatacttgtcaagaaaccgttcaatgcatcattgattgctttcatagggacattgaccagcaacatcaagaaaccagtaatcagtaagccaaacactggataaaagaggatcgttttaattccatccaatgattttggtaagttcttgaataatttacgtaaaaatacgatgacataaccagctaagaatccaccaatcagtgcacctaagaatcctgcaccgcctgtattagctaatgcaccagcagcaaatccaacgatcaaaccagggcggtcaccgatacttgaagcaataaatcctgctaataccggcagcatgaaaccaaatgcagcttgtccgatttggttgaaccagctagcagcttgattgtaattccctagatttgataattgatcatgtggcacgccaataaattggtcgatcatgaaagaaagcgcaatagcgattcctccaccaataacgaaaggtaacatgtgtgatacgccgttcatcaaatctttgtaaattctttgtccgatagtaccatccgcatttccttcttctgaactgctttcttttccatcaccatggaatactggtgcagtaccactaagggctagattgatcaactcttctggtttacggataccatcactgacaggacgattgatcagttcttttccgtcaaagcgattcatctctacttttttgtctgctgcaacgattacaccttctgcacgggcgatgtcttcagcagtcaatcggtttttgattccttctgaaccgttcgtttcgactttgatctccacacccatttctttcgcttttttcttcaaagcatcttctgccatgtaagtgtgagcgatccctgttggacaagctgtaacggcaacaacgaattttctttctggatgagcagaagcttctgcagcttgtgtttcttgttctgctttttcttctgcttctttttgctcttcagctgtttggaacaagtcttggacttcttctggtgtatttgcttcttttaattttcctacgaaatctgcatcaatcagcaatcgagatagtgctgctaatgcttgcaaatgtgtgtcgtttgcgccttctggagctgcgatcatgaaaaacagataagttggctgtccgtctaaggcttcataatctactcctttttggctttttgcgaataaaactgttgcttctttaactgcactgtttttcgcgtgaggcatggcgattccatcaccaagacctgtagaagtttgtgcttcgcgggctagaattccttctttatatgtttcgatatcggaaatccggccggcatcaaacattttttggaccatttcatcgattgcgccttttttatcagtcgcttgcaaatccatgatcatcgcttctttgaccattaaatccttgatattcatgattatcctccttgaaactaatcaatttttgtgatttcaacttctggcagcaactcatcaatcaattcgcgagctgccaagtcatcagaaaaagctgttgcgcttccgcaagcaactccccatttaaaggcttcgattggatctttcgtacggctgtaagccccaataaagccagcaatcattgaatcccctgcacctactgaatttttcaatgggcgaactaatacattcgttttataagttccttgttccgtgaagagcaaagcaccgtctccagccattgagatcagcacattctgtgccccttcagctagtaattttttcccatacggaatgatttcttctacagattggaaggttgtgttgtaaagctcagctaattcgtgattgtttggtttgatcaacaacggtttcttaacaagtgcattttttaggtcatcacctgttgtatcaatcacgaaatctgcacctttttctcgaatgatatcaatcagttcttgataaaatccttttcgcaggctagctggcgcgcttcctgacaatacgacgatatctccttgtcctactgttcctaatgcttgcttcaactcatcgatttcttcatctgaaatagatgggcctaagccattgatctcagtttcagtgtctgattttagtttgatattgattcttgtatcttcttttacggttgtgaacaaagactggatttgttctttttcaagccacttcgaaataaattcgccagtgaaccctcctaaaaaccctagtgctgtagattgagaatcgatccgtttcaaaatacgggaaacattgatcccttttcctccaggtaacttgaagtcttccttcattcggttcaaatcgcctagttttaacccatctacgcgtacgatataatcaattgatggattaagtgttactgtgtaaatcattgtattgcctccttaattgttgtcttttcacggaattcattaacgaattctaatggacaacgctcggttatgatcgtggctgcttccaaaggtgcaacagaggtgaaggacaactggttgaatttggtatgatcaatcaatacaaatgtctcttcggaatttttcatggctaaacgtttaacagctgcctcttctggatccggagtcgtgaatccttgttcaagatgggcaccgttcattcccataaatgctttattaaaatgaaaattttttagttgttctatcgcattagatcctaaaacagcattagttgccagctttatcgttccacctaaaataatggtagcaagctccaaatcaactaaatttgccgcatgttgaacggaatttgtcactactgtgatctgttttccttgcagaaaaggaatcatttctaacgtagtagagccagcgtctaaataaatgacatcttcgtcattaatggtttcagctgccgatttggcgatttgctgtttttcgtgaacgtttttgagtgatttttcactcatattctgctcaaaattcaataattgctctttcttagctccgccatgaactctttctagaaacccactattctccagctcttgtaaatcacgtcttatcgttgattcagaagcattcaaaaggtttacaagatcttgtgatttcacgattttctgctgttcaagcaagtctaggattttttgtctgcgttcctctgtaagcattttcacgatcacctcaatacaaataatagcatattttttttctactagcaatataaatcagtcaaaaacgttcataaaaattataaatcagtcaaaaaaaaaataaaaaaccagtcagaaagactggttttttatttttttgtctatcatcaagccgttttatcgttttttattttcgcttcttgtttttttcatataaacagaagcaggttttctttccttatgaagaagataataataaagtcccatcccgccaaacatgaccaaaaaaccgatgactgatcgaataggaaaattaggaacaaaaaagagacagacggataataatgatgccggaaccattattcgataatagagttgtttatccattttcttcacctcatattttttgtaaagtaatcaattgttctaattctcggtaatctaaaaattgcacacgcagatgctgctcacctttcttgacatcgaattggatacttcgccgctttttctttattcgtttgaaggtaacatcagagagtctatgtttgatttcctttaacggtaattctgacagggattctgaaggaacatagattcttaaggataaaagatactcttgatatttttcatctgttacctctacttctagatattccctaatataataacaataagcttcgattccattatccaaagcaacagtcggatcgataactttatagcacatcatgcgtgatcgattctcgtcaacccaaggaaaatacgcctgagcatttagtgttccgcgaacacgcctttctttataatctccttgttggatatcataactttttgttacaaaaaatgaagcattctttttaggaacaggttgcatttgtgcattctgatactggacagattggatcgtatggtcagtgtaaatgtattcaacgaatggcggtttcaataaaccgacaccattgtcccaagcaagatgatcaaacccaagctggtccctaaaataggattgaaacatttgattgtttggcttttgccagttaaaggggtctcgataaagctggatacatatgacttcgttttctaattccttcactttttctacttgttggatgtcgagaaaaatcggtttagggatgatttgatgataatagcgactataatacatttcccaacacgaagtgaaacataaaccttggtaaaaaagatcgtatcctggaaattggttgcaatcgactactacttccccgttttgttgtttcattttaggtaaatgttcgatttcatcctttttctcaaacaatagccgttgagagatctgttttgtattgtgatagataaactcgctataagctcgcatataggcgaacaccccatgagcaatcatttttttctgaatgaagtctcgaatcaaaaattgcttttctttgaaaacagagatagacaatacattttttatcaataattgattatcttccaagcgaaaactacattcgttctcgtcatttcctacaactaaccaactttcgtctcttaccgatgctagcattattttttcttgaagctttcgaagatcatacggatccgcttgttgtgtgaaagagcggataaatgttggctggatcaacagacgtgtcaaaatagcccaatcgcttatttcctgttttttttcttcttcatttaagtctgtgagctggatagtcatcaataatttatcttcgccaatcattttctcacctctttcaaatctttttataatttaattataaccaatgataaagaaaaactaaaactttatgtcttagaaaccaatttggacgattacatgatagactaagtaaaaagaaacaaagaggtgtttacaatggggttgaaatttgaacgtacagataatttagataaacttttcgaatcatttgctgtcgatccggaaaaaacagttgcaccaaaagaagagatcgatcgatttctaaaaccacagccacaaaatgaaaagaaaaaagacaagaaacaaaagtaagttaagctcaaaaaaagacttaccagccaaacttttatgaaagagtttgactggtaagtcttttttattctttttatgattcaattgcttgttcgattgctgcccacgcttcttcttttccctgttttgtaacggaagaaaagagaataaacgtgtcattgcgatcaaaatccaacgcttttttgatttcgctctcatgcttgttccatttaccacgagggatcttatctgccttagtggcaacaacaattacagggatatcataatacttcaaaaattgatacatctggatatcttcttgagaaggcttatgacgcaaatctactaaagaaacgaccgcacgtagctggtctctagtcgttaaatatgtctcgatcatctttccccattttgctcgctcagttttggatacttttgcatacccatatcccggaacatcgacaaaatgtaatgcgttctcgatcaaataaaaattcaatgtctgggtctttcctggcttaccggaagtacgggctaaattctttcgatcaatcaatgtgttgataaaagaagatttccctacatttgatcgtcctgccagagctatttctggcaattgtgtatctggatattgttttggtgccactgcacttatgataatttcagcttgatggactttcatggtctctctccttaacaaggtgatgaataaagcaagcggctgtcgcaaaagccaaaatgacttttacggcagcctcttttcatcaacccgcttttttctctgaatctttatagattactgttggctcaccagacaattcagctgcttcttttgtgataatcactttttcgatgttttcatttgaagggatatcaaacatcacatccatcatgatttcttcaatgatggaacgaagtcctcgagcaccggtattgcgttcgattgcttttttcgcaatggctctcaacgcttcaggttcgaattcaagttcggtattatctagagaaagaagtttttgatattgtttgactagcgcatttttcggctcagtcaagatccgtaccagatcatctgttgtcaatttctctaaagctgccataacaggtaatcgtccgataaactcagggatcaatccgaattttagtaaatcttcaggaatgatatgctgcatgacactttcgtcttcagaaagtttttggttttgtgtaccaaatccaatcgtcttttcgcccatacgattcttcacaatcgtttcgatgccatcaaatgcaccacctacgatgaacaatatgttcgtcgtatcaatctgaataaattcttgatgtggatgtttacgtccgccctgaggtggcacacttgcaacagttccttctagaattttcagcaaggcttgttggacaccttcgccggaaacgtcacgagtaatagatacattttcgcttttacgcgcaattttatcgatctcatcaatatagatgatccctttttctgcaagttccacattgtaatcagcagattgaagcaatttaagcaaaatgttttctacatcttcccccacataaccagcttctgtcaaacttgtcgcatctgcgattgcaaaaggtacattcaatgtttttgctaatgtttgtgctaaaaatgttttaccagaccctgtaggtccgatcaagcagatattgcttttttgcagttcaacatcatctgtgttttcttgtgcttgctgattgacacgtttatagtgattgtatacggcaacagctaacgagcgttttgcgcgatcttgtccaatcacgtagttattcaatacttcaagaatttctagtggtttagggacttcagtgaattcgcgtacagcttcttcataaaattcttcatcaatgatttctttacataggtcgatacattcattacagatgtagacccctggaccagctacgatctttttcacttcttcttgggttttcccgcaaaaagaacagcgtacggtctcattgctacttggattgtcatacatggtcttcaccccttaacttgcaaaaagtatgcaagaaactatcaaagactttacagtcttttactatcataacatagtttagtaaaaagaaaaagtgtttaacaaaggatcaactgacctatacctttgcattttttactcttaacaaaaaataaggaactgtgacaaaatcgtgtcacagtcccttatttcgaataaacaattttctagaagtagcttcttcagaaatgatttattacttgatttctattctttcgcttctgtcgctgtacctgtgatcaattcgattgcttttttcattgtcacatcatgttccagcatatcttctgtcaacacgcgtttgatttgttcgattggcatgttgtatgtttctgataattcttggatttctgcattgatttcttcttctgttgcttgaagattttcagcagctgcaattgcttcgatcacaagatttgttcttgtgcgcatttctgcttcaccttcgaattgtttatgcaagtcttcttctgtagaaccagttaattgatagtacatttcaggagagataccttgacgttgcatgttgttcaagaattcgtccattgaacgatgtacttcatcatgaaccatcacgtgtggcaattcaacgatttctgcgttttcaacagccatacggatcgctgcttcatcttttgcatcgtccgctgctttttcttttgtttctactaattctttgcgatatttttctttcaattcgtctaatgttgatacttcgtcatcaacatcttttgcgaattcgtcatctaattcaggcacttcttttgcttttacttcatggattgtcactttgaagactgcttcttttccagcaagatcttctgcttgataatcttctgggaaagttacatttacatctagactttcacctgatttatgaccaactaattgatcttcaaaacctggaatgaatgagcctgaacctaattcaagtgagtaattttcgccttttccgccatcaaacgcttcgccatctacaaagccttcgaagtcgattactactgtatcgccattttcagctgcagcatcttctttgataactaattcagcttgtgcttcttgttcacgtttgatacgtgcatccacgtcagcatctgttacttcacggtcttgtttttcaacaactagatctttatattgtcctaattttacttctggtttcactgttacttcagcagtgattacccagtcttgacctttttccatgctttcaacatcgatttttggttgagaaacaggatcgatgccagcttctttgacagcagcttcataagcttctggtaatacagcattcaatgcatcttcatataaagcttcttcaccgtacatacggttgaatacttgacgagaaactttccctttacggaatccaggtacgttcaagctttttttcactttattaaacgcagttgttaatcctttttggatttcgtcttgcgcaatcgtaaattttaaaacaccatcattcgtgccttttttttcaaatgttgcagtcatttaattccctccgagtttagaaattcattttatacatcaaaaacgtttcatgcatacctttaaatagtacactaaccctttcaaattgtaaacatattgaatggatagaatccttgtttttcataacatttttatctttttcactgataaaatctaatggaagaagatcatttgctgcaaaattttttctcttttttttaaaaaatcttgtttttcatcttctgtaccttcatacatcgtttttcctgtacacgcctctacagtcagttgaaaccagcgcttcgggtcttcgatgtatgtatcatagacaggataaacaattgcagattgcaacgtgaattcttcttttaacacggaactaagcagcgcatcttcattcccgtaacgatctgaaaatacacataattgctggtaacttgcctgctgctgcggctttggcagatcttttggtatgactttgactaacttttcttcaatcgtcaaatagaaaacaggatggcattcgttcaattgcctaagtgtctccagtaattttgcccttgctaaaatatggacctctggcgatacaataagtttactcgctgtttggataaactcatgataaggaagctgttcgatctcatcaatagacgcaagctgacgtgcaggttccaacgaaggaagttcctccgatttattgtggagtgccttgatcttctgcctctccatttgtccggataattcttctgcaaattggattttttcaatgacccgctgctcgaaagcttcataaaaatctgtacttgctatcaattttctagcatataaaaaatcttgtgtactgattaacaagtcaaaataaaattcagcaaactcctcattttgaagatactgtttttcatgcaagagtgcttgcttcaatgcttcttttttctcgtccaactcgtaaagacaaaaaacaagcaggctattagcctcaaagctttctttcaactcgtaagctcgttgaaataattcttttgcctgctgatattgctggtttgctagtgcttgttgtgccactcgcattaaattctcatatttttctggaaaatcaatcggcttcacgcagtgtcctcctcttgctcatattcagctcatgttcaatagtagcaaaacaaaaaaagcatgacaattaaaaataactgaagcaccctctaaaagctagattttagatctgacttttagaaggtgctttcaactgttactgctttttattgctcatcagctgttgacttcctggttgaacgctttgatcagattgatcgtaacaacacttgtattagtgaaaaaatcgcccagatgttgctttttctgattaaagactgctggaagataccctaacatcagcaaaggaaattttagaatgaaccggcaagcaccttctctaactaaaacggttgaccagctaagttcttcttcatcaaagctgatgactcgaataccaaagatcattttcccaatcgtttggccatgattgaatttcgtcaataaaataaaatacgctagataaataagtaaggctgtgaatccgtagagactcagataagaatctgaaaaattaagccaacctagatttttggcaataccaagtgttaaacgcgtaatagctccgatacacaaaagatcgaccaagaaggcaaacattcggataaaaaaacctgcatagaaatacttaggaaaatcatttgcttttggcggttcatttcttgtgtccgtatactttttccatttacgttgtttctttttgatttcttcgggcgtcaaaggctctctttcaaaagagctcagtaccttttgggaaaagttggagtcaggtcctacagcaggctgctgttgcttatctttttcttgttccttattttcatttgaaagctctgacatgcttactcacctccgtaataatacattgcttttggtgattccgctgtccctagattctcaagaacggataagatctgactagtctcagaaggcttcaatccctggaattctgctagtttacttcctaaccatgtactagcaaacccagatggcgtggaagaatattctactagttccgcatcttcaagctgttgttcctttcgtatagcttttaaagcatcttcaggaaatcccaattcatcgactaaacctacttcttttgcttggacaccatcataaatccttccatcagcaatttttttgacttcttcttcagatttattccgtccctcgctgacgattgctacaaaacgactatatgcgctgtcgatatatgcttgaagcaccgcttcttcttcttttgtctctggtcgcgttcctgaacccatatctttcaacgctccgcttttaactgttgtatcttccacacccagtttttctagaagtcctgaataattcaatcctgacatgatcacaccaattgagccggtcactgtttcttctgttgcaaagattttatctgcttgagcagaaatatagtagccaccgctagctgccatgtttttcatgctgacatacattgggatatcatgttctttacgaatcgtatccaatttcttagcgatttccgcactttcgtagacaccgccaccaggagaatttacttctaaaaagatacctttgactgttggatcttcttcaatcgccttcagttgttccataaaatttttatgattgtaaccttcagaagcaaataaacctgaagaccctcccgcagcaatcgttccatctactgataattttacgattttttgcgtactgtctccctcttccaacacatttggagctagttcttcatccccatataaccaactgttcaatccctcaatttgatcgttttcctgaggcttagtcaaactagctgaaactaacgaaaccacaaataatcctgcagcaatcagaactgctgcccaacgtcttttattcattctttctcctttctaatacaagttttttatgacgatcacagtttctgactgctcagaagtgtcgaaccgctctgctttttcttcccgcgcatacccggaaaacgactcttttgttaattcatcttctaccgtaaactcacgagcttgagcaacttccaaggcatcaggtgcgatttcttggatgctatcccagccagtatctaaaaatattttcgtatcatctgatacaccagctgatgcttcgaatttggacaattgtttttttaacattcccagtgtcatgatctcaatttttgaatccatttttactcctcctctatccgattactttctattgtaccgaactcctgaaaaagatgatagataaaaacccattattttttgacataaaaaggacatttgacaaagaatttgatatataccaatttattttttattctttttttgttgacaagaacattcgcaaaaggttatgattttaaatgtttccagataaaaaacaaaaaggaggatagttataccttttaggatagcgccaggtctgtgtaaacagatgacgaggagagggtttatcgaaagattcggcggatggccctagggactgcactctacagaaaatccacaaaaaatgtctgcaaagataaaacaaaaggattttcctgcagctggaagcattcatacgaattcattatagaaagtaggatgttttttatgtgcggaattgttggaatgattggattaaaaaatgtaacaccaggattgattgacggtctagaaaaattagaataccgtggttatgattcagctggtatctttgtctcagatggcacaactgattatctggtcaaagcacaaggcagaattcaaaatttgaaaaacaaaataaatattgatactacaggaaatataggtattggtcatacacgatgggcaactcacgggcaaccttctgaagaaaacgcccatccacatacttcccaaagtggacgcttcgtgctcgttcacaacggcgtaatcgaaaactttgaagaacttaaaattgcttatttagcaaatgaccactttattggtgagaccgatactgagattatcgctcatctaattgaaactttcgcgaaggatactacaacgcaagaggcgtttttaaaagctttgcgggtcatcaaaggttcttacgctttcgctttgattgatcggacagcacctgatgttatttacgtcgctaaaaataaaagtccactattaatcggactcggcgatggattcaatgtgattgccagcgatgcaatggctatgcttgctcatacgaaggaattcgttgagattgaagatgaagagatggttaccgtcacatcagaaaaagttattattcaaaattttgcaggtgacatcgtagaacgttcttcattcgaagcacaagtagatgcttcagatatcgagaaaggtacctatcctttttatatgctgaaagaaatcgacgaacagcctattatcatgcgtcgtatcgctcaaaaatacgtaacagaagacaatcgtgtctctcttgatcaaaagctggtcgatacattgtctgatagcgatcgaatctatatcgttgcttgcggaactagttaccatgcggggttagcaggtaaacagactttggaaaaattgacacagattcctgttgaggttcatttagccagtgaatttggctataacacacctcttctttcaaaaaaaccattctttattttcttgagtcaaagtggcgaaacagcagacagccgccaagtgctggtaaaaatcaaccgtctcggctacccttcacttacgattacaaatgttgctggttctactctttcgcgggaagcatcctttacactgctattgcatgctggacccgaaatcgcagtagcatcaacgaaagcttatactgcacaaatagctgtactaactttattagccaaagctatcggtgataaaaaagaatttgaaacttctcttgtattcgatatcactcatgaattgagtttagttgctaatgcgatggaatcggtcatcgcccaaaaagattatttagaagagttggcagaagtatatctcagcgatacaagaaatgccttttacattggacgtggtgctgactacaacgtttctcttgaagctgctttgaaattgaaagaaatcagttatatccaggcagaaggttttgccgctggcgaattgaaacatggaacgattgctttgatcgaagaaggaacaccagtgatcggaatcatcagtgaagaagtgactggtgcgcatactcgaggaaacctgaaagaagtcgaaagccgtggcgctaaaacactagttattgtctcagagggattagaaaaggaaagtgaccagctggtgctaccaactgtccacccttatctaactactctaaccacagtcgtaccgactcaattacttgcatattacgcaacgctattacggggattcgacgttgacaaaccacgtaatttagcgaaatcagtgacagtagaataataaaagaacaaggaccagtgtcagacatctgacactggtccttgttcttttattttttatgaaaatatctcttaatccagtccgatttcttctttgactactgccgcgattttatcgacatagtaattaactttctcatcagtaggcgcttctgccatcactcgaagtaatggttctgtaccggaaggacgaactaggattcttccttctgatcccatttcagcttctgcctcttcaatcacttttttgattgccggaacatccatcgcaccgtttttatcacttacgcggatattcactaatttttgcggatagattgttacctctgctgcaagctctgataatttcttacctgtctgtttcatgatattcagtaactgaattcctgaaagcatcccatctccagttgtgttaaaatctaagaaaatcatgtgcccagactgctcgccgccaaagttataatcgtttttgcgcatttcttctacaacgtaacgatcaccaacttgtgtaacgacatctttcaaaccgattccttccaccgctttgtggaatcctaagttactcatgacagtcgtaacgatcgtatcttttttcaatcgatttttttctgccaagtatttagcacagataaacatgattttatcaccgtcgacaatgtttccaagttcatccaccgcaataatacgatcgccatcgccatcgaaagctagtccagcatctgctcctttttcaacgaccatctcagctaaacgttctggatgggtagagcctacgccgtcattgatatttaacccgtctggatttgtgcccattgtataaaaatctgtttcaagatcggcaaacaaacgattaacacttgttgaagttgctccgtttgctgcatcgacacaaatggtcaaaccggaaaggtcaccgttgatcgtttgtacaaggaattgagaatatttcaataagccttctggaaattcttctacagttcccaatccttcagctgatggacgaggcaattcatccacttcagcatctaataatgcttcaatttctagctcttggtcatctactagtttaaaaccatctgcaccgaaaaatttgattccattatcttgtgctggattatgagaagcagaaatcatgacccctgcgcttgctttttgcaaacgtgtcagataagcaacacctggtgtagagatcacacctagctggaacacttcgatacccaccgataaaagtcctgaaatcagcgcttcttctaacatttgacctgagattcttgtatcccgccctactaacacgcgtgggcgttttccttcttcttcatgctggcttaggacataacctccgcaccgtcccagcttaaatgcaagttctggcgtaagttccttgttggcttcaccgcgtacgccgtctgttccaaaatatttacccatagttgtaaaattactcctttaacttaattttctgaggaatttgttctgctcatttgtgttgattcgcttgtttctgatgtttcttctgtacttgtggtcgagctgcttgtcccagattccgaactggaagaaatggttgttgtcgatggttccgttcctgaatcagcagatgaaatacttctactcgtacttgtattttcttgtgtccgactgctcgtcgaagcagagctactgcttgacgtttgcaacacgggtgtaatctccacactaactgattcgggcttgatacttaacccctcttctactggtatttcaattttacgagttgttcgatgattgatacctgagacattgatcggtacagcaatactgtcaccgatcgatgcaagcaaatcgctagagccgcttacttctgcttccagttttgaaaaactgaaatcatagctttctaccccggcagctggtgttccttgctgtatcccataaagtcgtaccgacttgcttggcttgatcgaatcagctctcactgttacttgcactggatcagagacgatacttaatacttcccctgctgcattcagcgcctgtattgggacctcactattaatcccatcatctgtgaccatcgaagcgtccacatcagctactactcgtttgatttctgccaatgttttgtcacctgtagtgatagagacttttttaggactaacggaagtatcatcaagttcatatccagatggtgtgaacgttgaaggaatcaacgtttccacatcgaaatcttttattacctttttctcaaccgttactgtaatagtcgatggttcgatctttgctgtgacagcactgctcaaattttgaatttttagcggaacttcatgtgttccttcgcccagcttagtgatatctgctgtgacgcggaacatccgtgtatcttcgtttgcctctgcattcaactgaactcggtttgcactggaaagtttgacagtcactgcattttcatatccatggatatagtagcgctttgaatcataagaaatcttgatcggcacccccgtaactgtttgattatacgcttcatttccagaaagcgtatttggaacggactggccatttgcattgaagtacagcgcaatactgaacagcaatgcaataaaactgtaaagaatgcttgtccgtttctcttttgagatcatttgcgatcccctcccttagtcataccgtctaggaaagattgaatcacgtttttcttgttttttgttttctcttcagcaattagttctctacgcaagattgccaaatattcttgctgggataagccagccatcagttcattatctaacgtgatgctgacgtccccggtttcttcagagacaacgatggtaatcgcgtcactgacttcgcttataccgacagctgcccggtgtcgagtcccgaattctttagggatcaacatactttctgatagaggaagataggcgcttgctactgcgatctttccttcttttacaataactgcaccgtcatgcagcggtgtattaggaataaagatattgatcagcagctccccagtgatatctgcatctaaagcaatccctgtctcaatatactcatctaatccagtatgacgttcgatagtgatcaacgcaccgatttttcgcttggacatatattggatggctttgtcaaaagacaagatcatcttctcatcttcctgctgttcgctttttgattgtttgaaaagcgaactgcgtccaagatgttccagtcctctccggatttccggctgaaaaatcacgatagcagctatcaccccgtacgtaatgacttggttcatcagccaagacaaggtgtgcagaccaatgatttccgctacgattcggataacaataaaaatagctacacctttcagaagctgaatcgcttttgtgcctcgcagcagttggatcagtttgtatacaagataccagacaaccagaatatcaagtatgttcaccaaaaaattcagagagaacaagtcaccggaaaacatttgctgccaatagtccaaattaaaaagttccccgatttgaaatgacataaaaagcctctcttctcttttgagatttcctctctagtatatcatatgttttaattttagaggctgatatgctcgtatttttcttgagaaaaacgcataattttcaagaaaattgcaagtatgcgttttatttttctctgcaataaatatttttaaacttcagagaattattcattatattttttctgttatttttcctttttttcttttgtagcttgttccatttttttacgtcgttctgctctggcagctcttctagcagctcttctttcttctgcttcaaggtccgtcgttttttcttttctagtcttaacgggtacatcgatagattcctctggttcaagtcgtttcttgattttttctaattctcccgtcagtgcagcatagttgtaaaaacgtgttttagcgtcgtggacagtcttttcaaataaagcttttgcaagatttggatttgcgttatctagcgaggaaaagcgaacttgtttcctcatgaaatcaggcatagcagagaaatcaggttttttgtagtccaaagtcattgggttcttgtttttttcgaccattgtagggttatatcgatataatgaccaataaccagaagaaacagcttcttttgcttctttaagcgattctttcattccgccaagcaagccatgtgtgatacaaggcgtataggcaataatcagagaaggaccaggatacttttctgcttcttcaaatgccttgatcgtttgcatttgattggcacctgaagcaatttgcgccacataaacatttccatatgtcatcgccatcattcctagatctttctttgaagcatactttccactagccgaaaatttagcgattgccgaagctggtgttgcttttgaggtttgaccgccagtattggaatagacttcgttatccaaaacaaggatattcacgtctgctccgctggcaagtacatgatcgatcccgccaaaaccaatgtcgtaagcccatccgtctccaccaatcatccattggctgttttttacgaatagatcctttctcttgtatatatcctccagttcagggaaaattgatcgttcgctttcgatcgcagcttgcagttttgctgctctttgctgcgttccttcactctcaaacatgtgtactaaccagtcttccatcaattctcgtagttcttctgatacttttggcaatacttctttgattgaacttgccaaagcctcgcgacgagtctgtgccgctagaagcataccataaccaaattcagcattatcttccaataaagaatttgaccatgcaggcccttgaccacattcattggtcgtataaggagaagcaggagaagcaccgccccaaatagaagaacagcctgtcgcattcgcgatcatcattcgatcaccgaacatttgtgtcaataattttacataaggtgtttcgccacagcctgagcaagcgcccgagaattcaagaagcggttgattgaattgtgtagacaagacagtattctttcctttgactggatttgctttttgtcttaatgtcattgcaaaagcccaattcacagcttgttctttctgttcttcataaggcttcatcactaaagctttttcttttgcgggacaagcctctacacacagaccacaacctgtacagtcttccactgaaacttggatacggtattttacgccgtctgcgcctcgcatttctctcacgataaatccttctggcgcttcttccatttcctcttcatctgctaaaaatggacggatggcagcatgaggacaaacaaaggcacattcattacacatcgtacagcgatcactaatccactcaggtacttctaaagcgacgccccgcttttccatagaagccgttcctaaaggcatttcgccagttgtcattccatttgctacaagtgtaccaacagagagttgatttccttcctgtgcattcactggttcaagtatttcttgtatataaccagtgttccttttattgattttttcaggcatctccaacgttctccaatggtctgggatcgcgacttgatgaagcagttcggtcgtccgatcgattgcttgtatgtttttttctacgatagccattgatttatgtccatagcttttcagggcttcttcttttagcagcggaagcacctcatcaaaaggaatgatgtcagctaatttaaaaaaagccgtttccattgccgtattgatccggcgtcccaaaccgacttcttgggccaatctcatggcattgatcgtatagaatctaatgttattttcagccaagtaacgttttaattttaagggcagatgcgtttctaattgttcgtcgctccaaagagtattcaataaaaaaatgccacctggcttcaatcctttgaccaagtcatagctatgcaggtaagctggtgtgtgacaggcaacaaggtccgcatgctcgacaagatacgctgaacgtatcggcgtatctccaaaacgaagatgagagacagtcagaccgccagattttttcgaatcataataaaaatagccttgcgcatatttatcggtgtgatctccaataatcttgatagctgatttatttgctccaactgttccgtcagatccaaatccccaaaacttggcctggaatgtttgcggttctgtcaaatccagactttcctttggttccaaagattgataagtcacatcatccacgatccctatggtaaaccgttttttgcgtatgcttgggtcttttttcaattcatcaaaaactgctgagatttggtcgggagtcacatctttagaccccaatccgtagcgaccaccaataacagccgggcgaagttcagaatcatataacgcactttgaacgtctaataagagaggttctccacctgcccctggttctttacttcgatcaagaacagcaattgtttttactgtatgaggcaacttttgcacgaatgtttccactggaaaaggacgataaagatggatattcaaaaaacctgttttccgtccgtttgcattcaagtaatcaatcgtttgttcaatcgtctgtgcaactgatcccatagaaacaatgacttcttccgcatcgtctgctccgtaataagtcaccaagtcataagaagttcctcgtaatcggttgatctctttcatatatttttgaacgatttcaggtaatttatcataataggggttgatcgtttcccgttgttgaaaatggatgtctggattctggttcgtaccactaacagtcggatgattgggattcatccctcgtttacgaaatgaagctaatttctcctgattgatcagaggagctaattcttcatattccaaaacttcgattttttgaatctcgtgactcgtacggaatccatcaaagaaattcaaaaaagggacttctccttcaatagaagcaagatgggcaacaggtgctaaatccatcacttcttgtacactgctttcagctaacatagcaaatcctgtttgtcttgcagccatcacgtctccgtgatctccgaaaatattcaacgcatttgtcgtcactgcccgactagcaacgtggaaaacacttggcagtagttccccagcaatcttgtacatattcggtatcatcaaaagcagcccttgtgaagcggtatatgtagttgtcagtgcaccagttttcaatgatccatggaccacaccagctgctcctgcttcggattgcatttctactacttttactggttgaccgaatacgttttcttttcctgctgctgaccattgatctactaattcagccatggtcgaactgggtgttattggatatattgcagcaatctcggtaaatgcataagaaatatatgcggctgccgtattgccatccattgttttcatttttcgcatgattcatcatccttgttcatattctctcttattatctgttccattataacgtaaaacatgccatttttttcttttatttataaaaatattttacatgtatctatttgaattggtcatctaatttttagacaaacagtctaaatcgttgcctttttttgtcagacatgtataaactataagcgaaagaggtgttttaacatggatatatcagtgattgatgcaacgaaaacaaatacacaaaaaggaatcctttatggttcatcgaatgctcctaaaaaaatggtcgaattcatcaacttagcttgtccgtattgccgacaatggtttgaagaatcttatgagctattagaagaagcagtccaaagcgggcaattgcagcgagtgatcaaattgttcgataaagaaaaagaaagcttacagcgagggaacgtgatgcaccggtatctcacaatcagcgatggccaaaaagcgatcaaagagatcaaacaaatattcgatactcaagacgagtggaaacatctttctctccaagaagtagcggattttgcagtagataaactaaagctgacagaacaaaaagacgaacagctgagccaagctgtcatcaacgaagctgagcaagcacatattcgatttgttccaactgtcatcttgggtaaagaaatctttgatgaatctatttcaatagaggaattaaaagaattgatccaaacaaaataaaaaaataaggagcgtgggacaaaagtaaagaacacttttgtctcacgctctaaacacgtataaacggcggaagcagaagcaactccttcttatttcttggagttaaacgcttctgtcccagcctccttattccgaataaatggtgtccaaaagcttgcatctgccagattatctcatttcttatgacaagctaagcaaattatctccaccaaataatttattcatatttttgacttgcgcatactaactaattcttaaattttcatacaaaatttctcaatttcccttaacgagtaatatttatgtacggtgattctcactagtatcccaatcactttttaagttatcccgatttcaattctacttcaaaaatagttgcttttatgtatgctgttagttgattagatggtcatttgttgagctaggtcgtttattttaaacaagttgtttctttagcttatacctatctcgtctaccaaacgcaagatggcaaacacaaatgcatacgcatctgtatttgccactttgattcgtataaagctaacaactattaactcctctcagctaatagttgctctcttttttattcagattcatttttgctgatcacagcctagtatttcaatggttttgaacactaaaccaaattgttccattacaacattcactggctgatgaaatggattagtagatttcgattattcaaagcgattttctattggtggatcgtgttcccaactaataagacggattccaaacctatcgtacagatcttctaaaccacttataaattttgcacctatttcaggtgttttattgcgtggatattctattgttacgccattaaatggataccaattaggattaggctctctttttttctgtacatctcccatagaatagttagcactttctgggacataatatattcttcgaccatcctctaattcatctaataagatatttcgtgatcgtctatcacttgctaaatgtagacgccacgtgcgataccatgccatgctacctgcatctgcagaaaatccatcaaataatgcaacaattgtatcttctatcacaatcctttccccatctacttcatattctaatctaaaatcaaactcccctcgggtaatttctggtcttggtggcttaggacccaatattattctacttaaaaccgcattcgttcccagatgaaacacagctataacaacaataatgattaatattttgtttctatttgataaatttctcattattcgcacatcacctctacattctcacatattagttcgtaatactcctttaatatcaaaatatctactggtcgtaataatattcgctatgaattcctactactcgtataagaaaggccaaatcatcagcttttacttgctgatgatttggcttgtttctatttatcgtaattgttttctaatcaccaaaattgttaacaatcggttcagatatttcccagttgattaaggtaattccgtattgtgtcaaaacttcttgcgcttctccgaaattaagtacagttcttatgtatccactttctcctaatataaagtctacctctcttttaaaaccttcctcgagatttctaagggctatatgtggttttaatgacattgattgtacattttcccccatataatattgcgcacttcctcgactaaaatagattcctagatcgtccccaaaaggtagatcttctctaccactagctaatctacttctccatcttcgttctcttttcatagaacctgcgctgaactcacacccgttaaactcagctatgacagtatcttcaattatgttaatctgtccatctagttcgtattcaatcctaaatggaaattctccataggtgatttccggttcgggtattttaggtgagattaatgcaaagaaaggaaatattaagcttggcaacatcaaaaaaactcctcctatgatcacaattcccgatgtaatccaaaatataatttgtacaattctcattgatccattgtattccattttattccccctattactattcatatccgcctatctatatcgatcttccaatgcagagataattgcttccataccttgattttttactgagttacctatgcgagatatcattctccactaaggtgcatcatattgtctatctaacatgattaattctccaataggtgtatactcctccaaaaacaacatttaatgcatctccctcgacaacataagctaccatgtttgctgtatatgtgtttgagtctaattcataagcagataaatttactgtcgctggattaaatataatcgcattcgtatttatagctactgaatttgctgcttcagcaccaccttttgaatgtccgatcattgtgatttcaatagtaggatttacgtggacagccctcaccgtttaccctgaccattatagaaatcgcttacttttttgaactacgcaacaaaggatacaatgctcctaacttcactgtctccatttttgtccactaaggaatataaaaaataggcattaattcatttaattcggtcacaacacgttaccttttaaatcattatactgtatctcatacattattatcaataaactattataaaaatgcaaaaaatgctttatcaatctattttgtaattggtcataatatcattgaaatcataccctgtatcgatttttcctatgaatctcgtctatttgtgattgacgaaaaagaggcaagacagacactggaatggtaattttacccactattttgctccaactatttgtaatcgtacccacttttgaaataccgagatgatcattttaattgatatgctgattcccaagcaaaaccccaagaaattaaatgctctatcgcatctagcttcttgggttttgcttatataaattccaacatttaaattttttatgctgttcggtctcagaaatgccgtttttgcttatatcacaatatcaagatgtcaaattattcgtgttgccgatgactttgattaatttttttcaaattgtttattaagactaatgctgtctttttgcagataccaatgttcgaactttttaacattatcatatgatcctgcaagttttaacttcttaccattagatgttatcaaagttataattaaccttgcctttttcccattaggatcttttattttatgaattttctgcaggtaatctctcctaatggcagctatttttacctcatcagtgctgataaaccattgatcatccacatacatactgcctgttatgttgtgtttttccatttcttccgagaacgaaaagtttaaggctcgttcttacttccaaagttgaatgagtccatggattggacttagtgtgagaattgagaacaacaataagaatccatatcctcccgcaaacatccctaaggctatactgtctctccatccataagtaggattagaagagaaaagagtcaccgtttgtaataatatgaaaaggaataatccagcacaaacaccaaagataacaactccaaacattgaatttttatacaatgaccatttatttataggcttttctttcattttacttccccctactgttctgttcacacggaatgaattcaaagttcataagccctcctctttgaacatatgaatacgacttgctaactatactttaaaaaagcttgttttaagcggttataggcgagttgtaatctctattcatctcattagcaaataacttgccgaaaagtctactgaaattaaagcagatagtggaagaattatttagccaggatagacactatttgtgaaacacatgtctttacttttgaaattctatgatgaaaagccttggaatacagtagctcttaattggtaatactttttccattataaataacctcttttcattttatatttatcccctctaaaaataatatctaatctaatattttaaacttatatttccctcgctgtgctaatagagcattactaaataaatagaaactagaaaaaagcattacgcctgccagaataaaccaattatttgtatccgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataataatctataaacatcaccccaaataaaacagaaaacagtataagcattataaaaattatcaacaaccttgatccttcttttatagattcaggaaacagtataattttagtactagataaattgtttacaccgattagtgttaaaatatctttattcttcttgctaacataaccctttatgcacaaaagaacagctatacttaaagtaacaaataaataacgtattccaatagaaaaatcactataaatactctctagcataggaccgacaattgaagaagtcactactgcaaatgctggacctatccaagcaacattagaatgttctttctctcttttcctttgtaaatctttgttgagtattaatctatttatttcttctgcaggcaagttaattttcataaccttatgggggattatccaattaaaaatcggaaaaaggtagcctccccaaaaagtatagtgatctgtgtcaatcagataataacctgattttgattccagaataacatatctcaaagccgaacgaaaatttttcatgaatatccataatctcactgtttccacacctaattcctccaattccaattaaatggatttatagcatcaccaattatgttaactgcctgaccaacctcattgataaaattggcaccactatcccatgcttcaacaatgctatatatctatcaaacaaaaaatggaaaactaaatactcgcgcacataaattttacattctgttttttataagactaataataatcattgaaaaaatttcttatcggtggcgcatattcccaattgattaatgtgatcccatattctgcaagtattttacgagcttcttctaagtcatagtgagaaaaatgcataaaacctgcaatacgatcacggactgtgagctgtggcttgcttccaccatcattcataaaatatccagcagagccactacttaaagtgattgttacatcttcactttctattattaagaattcataatgaaatgctttcaactctccactattatttaaaagttttatactccaacttcgtctaggttgagttgtcacattccctctaaaacttcctataaattctgcaatcaccgtatcttcaatcaaaattctttcctcatctatttcatattcaagactaaacggaaattctccatatgtaatctctggcaatggtggtgctgtagttctccaaataaatacaataactgtgaatagaaaaaatccaacgatcgatataaatgttatgagacctgctcgaagtaaaacccgatataataaaaatgctgtatttcgctttgctatatctagaaaaataaaaagtactgcaatcataatgatagtaaaagttgtaaaaaagcacattttttgccctccctttataaacatcgattctcaaattctaaaccaaatcttgatagttcaagttcaggtataacgtataccaaccatacatcccaattactatttatgaacttatgattatcactgaataaatcactccatccccttgttaaaacttctacattaattacacctggttgttttcgactagctaatccaatgaacttatcaaccatccttatccaccaaccacgagaatcttgaccagaagtaagaaaaacagttctcaaggttgatcgagcagttccttccagtttttaattaatctccagttatagataaatacttgatcctatctatatcaggacttctatattaagcaaaagtttatgtataaaactaaaatcttcattcagttgtctccccgctttttatacgattgtattaaaaaacaatagaagcctttcaacattatgttactccagtaaagttggaattatagtttgacggaagaaaagcaagtatagcttttaaaaaaaactgatacattcgcatctcctgcttcatgtatcagttttttctttggattaaactgcttcttcacgcagtttttccgcaaattcatttattttgcgaattcggtgattaattcccgattttgatattgcacctgagggaatcatttcccctaattctttcaagctgacctctggatgttgaagccgaagttctgcgatttcctgaagtttttcaggaagggcatgtagaccgacctttgcttcgatcaattcgatgttttcgatttgtttagaagccgcatcaatcgtcttgttcagatttgctgtctcacaattgactagacgattgaccgaatttctcatatcccgtacgattcgaacatcttcaaatcggagcattgagttggttgcaccaatcaatgttaagaaatcagcaattttttctgctccttttaaatacgaaatatagccattgcgccgttcaagcgttcgagcatgtagaccgtaataatttaacatatcgcaaatgtcttggttatgctgttcataaatagaaaatatttccaaatgataacgactcgtttccggattattgactgaacctgaggccataaaagcaccacgtaagtaagaacgcattttttgcgaatttcccataatctcgtccgaaacgtgtccattgaacatcataccatccatgatatcaagatccatcaacacatcttttgtgccttgcttcaaccggacgatatagacattgttcttttttaatttcatttttttacgaacgagtagctcacttcgtacctgataatgatctttcaaaagagaatagatacgtctggcaattgcagcattttctgtttggacgttcaaaataaactgctggttcacaatacctaaagagccgttcattcgcagcaaagcagctaattccgctttcgcatgttctcgatgaacttccaaaccagttagttctttcttcacatctgcagcaaatgacatcctattctcctcctttctccaacaataaattgcttaatattttgaaccgaaaactaaacggaacaattcttctactactttgtctccatcgtggaagacaccaccatctttcaattctaaaaagtcggtggaaatcactcgacatccttcatttctcaatccgttgaagtcgtgtgcgacttgtactagatactcatcatagatctctgggtccatataatcttcaggcactttttccgtattgaccaatactgtatcgataaaaggctgattcaaatgcttgtgtaaaacacgtatatgatcggcatctgtgaaatgttccgtttcccctttttgggtcatgatattacagatatagacggtttcagcagttgtcttgagcattgcttcgccgatttctggtatcactaaatttggaaggatactggtgaataaacttccgggtcccaaaacgaccatgtcggcgtccataattgctgaaacgacttttcgagccgctttggcttcacttttatcatttgtgttgcagacatacacacggtcaatggttttacggttgatcgcgattttagattctcctactgcagtcgttccgtctttaaaaacagcatgcaaggtcaaaggagtttctgaagaaggataaacatgtccatctacatgcatcatttttgctaataattgaatcgcctcataagtgcttccccgcatctcggaaactgcggcaatgatcagattaccgatcgtatgattggctaaaaactgatcttcctttttgaaacggtattggaaaatatcttcatagaattgtggcatatccgataacgccactaagacatttctcaagtcaccaggaggagccatagcgatcgattctctgattgcaccgctgcttccaccatcatctgcaacagtcactactgctgtgatatctgctccttgatttcgtaaacttttcaggataactggcagaccagtgccaccgccgaccactacgatctttggttttcttatccggtaggttttcattttcacgaccggttcaccgtctctttccttttatccttgtcccgatgtgtcacattgactttatagtttttccctaaagcatttgccaaacgttcagtcaatgccacagaacggtgttgaccgcctgtacagccgattgcaactgtcaagctgctttttccttctttaatgtatccaggcaatacagtttccagaagatccaaaaatttatggtagaatgattgcgtttcatcaaaggacatcacataatcatagactggctgatcttttccggtcaatggtcttagttccgggatataatgagggttgggcaaaaaacgcacatccatcacaatatccgaatcgatcggcaacccgtatttaaaaccaaatgatacaaattcgatccgaaatccttggtctccctttgatttgaatgactcattgattttttcacgtaattgtcgtggtgtcaatgttgtcgtatcaatgatcacggaagcttgggctttcaagtcgtctagtatcgcccgttctttacgtatcccttcagtgatcaaaccgtccatcgccattggatgtgctcgtcttgtttctttgtagcgagccactagttcttcgtctgaagcatctaaaaataagatagaagtgtcgatgaagttcgtattttcgatttcgatcagcatgttttggatttcttcaaagaaggaacgagaacgcaaatccactcctaaagccatttttgtgactttacctgattctttgatcaattcccagaattttggaatcaatcgaggcggcatattatcgatacaaaaatagcccatatcttcaaaactttggatagctactgttttccctgcaccactcatacctgttatgatgactaattgcaaattatctgtcatatttacgaacccctctcacattgtgcataataaaattatatcatcccgggcgtatcattaccagttttctttttcttttacaaaaagatttggaccaaatatcttttaggatatttgccccaaatccaatttttttacttttccgatgctgtatccaatgcctcgcttctttcagctaatgcacgttcgatcgttcgatccgctaaaatagattgagcatcgatcactgggtaatgattatcttcagcaaattcatgcatcaaagataattctgtgcaacctaggatgactttttcacagtttaggcgctctaccgcttcctctaagatttcgtaatagagctcttgattcaaataatccgattccttgatctcatgatagatcaggtaattgattttttcttgaagcgcagtatcaggaatcactgtttcgaaaccaagatttttgacttcgcgttcatagattccagctttcatacttccttctgttcctagaatcgctactctccctgtcgtatgctgacggacaagttcatttgctgcttctcttggcatatgcaagataggaatatccgttgccgcttgtaactcttcaaaaaagtagtgtgcggtgttacaagtcaacacaatgaagtttggtcgcaataaattttgtttctcaatatcatccagcagaaacggcattggattttcttctgatcgatctaaaatataagctgtacgatcaggaactgttgcatgattgaataagacataattcaaatattcttgatcttttgtagctttcgttcggtggttgatcaagcgaacaaaactttctgtcgccatcgtgcccattccgcctaaaatactgaaaaaattctccatgaactagccttctttcacatgaaaatactttttgaatcttggaatatagttatggaacatatatttcatcaacaaccagcgcttgattgatcggtctttttcataaaatacagtagtaccgtaacgattttctttgatcatttgctcagctagttttttgtcttcattttcccgagcatattctaaaaagatttttttgggcacacccatccataatcttgctttatctgattgattcgttccataggtcgtttcaacaaagggtttgttgaacactcgatcttctgtgacaaaacgagccagattcaagccgttcaatgtcacaaagaaactgctacgaccttgtctcaaattgatttcaaataatttatattctccatctctaggatcatacttcatatcgaaattggcaaagcctgtatattcgattttttccaaaaatgccttaatggtttgatagattttttcgttataatctggcatgatcacaacgtaattaccaatcgatgctggtgtaggatcttctaatagtggatgaccaaggcacatcatccgaacttgatgatcttcatctacatacgcatttagcacacgcatattactatcatcacccgggataaaatcttgtacaatcatttcacttttataaccggcttcgtatatccggcctaaaattaaatcgaactcttctctagtctctaaaataaaagctttttttcttccttcaaattggacagaaagatactccacactgtttgcaggtttcaaagcaactgggaattcaaaaggcaattcctgttccaaatgtccatttactaacatttcttctctgacgatcaatgttttaggatacggaagatcatattcttcacaaacttcataaaagcttactttattgatcagcctttcaaataaagaataatcaatatatggacagataaaatattctgacagctcttgtttatgttgggagatcaattctgcatatccatcaccacaagcaatcaaaagatattttttactcttatcagaatatctttcttttgccaaacgaagcatcgtctcgataaatacagggtctttatcaaatcctggaataacttctacattgacaattttactgtagcgggtaggggctaactgatccgaagcatatgcttggcagattttgccgtatgcttcattaaaagaacgtgccataccataaacgttcatgtcgcttcctaataatatagggataaattcttcattttcaatactgttcatcattatctctcacttactcataatctcttgtttttcttttccaactacacaaggaatatcataccataaagaaaaaagcaatcaaaggaaagtcctccgattgctcaattcttttttgaacggattgaacttataggaagtttttatctataccaatcagtgtagaaagaactaccatgtaatgattctagaacactgatattaataaaacaagcaaaaattcatttttttatgtttttttaactatctcagctatctatcctctttataccattatttttttcaaatagtgacctgtataactttcttttacgttaatgatttcttctggtgttccagtcgcaaggatcgttcctccaccttctccaccttctggtcctaaatcaatgatataatctgctgttttgattacatctagattgtgttcaatcactaaaactgtgttaccagcatctactaatctttgtaatacatgcaacaagcgggcgatgtcatcgctatgaagtcctgtcgttggttcatctagtatatagaaattctttccattagagattttgtgcaattcactggcaagtttcatccgttgtgcctcaccaccggacaatgtcgttgctggttgccccatcgtcacataacctaagccaacatcaacaatcgtttgcagtttgcgatgaatctttggaatgtgcttgaagaattctacagcatcctctactgtcatttccaaaatatcagcaatgctttttcctttgtaatgcacttctaatgtttcagaattatatcgtttaccatgacatacttcacaaggaacatagacatcaggcaaaaagtgcatttcgatcttaataattccatccccgcgacaagcttcacaacgaccgccttttacgttgaaactaaaacgccctttcttataaccccgcatttttgcctcgttcgtttgagcaaataacccacggatatcatcaaatacacttgtataagtcgctggattacttctcggcgtccggccgattgggctttgatcgatatcgatgatcttttcgatactttcgtagccggaaattgtcttgaatttacctggcttagcagaattcttatttaatttttgcgctaacgatttctttaagatactattgaccaatgtactctttccagaaccagacacacctgtgactgctacaaattctcctaatggaaattcaacactaatatttttcagattgttttctgaagcaccagtgatcttgattgctttcccattacctttacggcgttcttttggtacagggattgattttttccctgaaagatatttccctgtcaaagaattttcatcattagctacttcttcaggagtgcctgcagccacgatttgtccgccttgttctccggccccaggtccgacgtcaatcaaataatctgctgcccacatcgtatcttcatcatgttcgactacaacgagggtgttgccaagatcacgcattttctttaatgagccaatcagtcgatcgttgtcgcgttgatgcaatccgatcgatggttcatctaaaatatacaaaactccagaaagattcgatccaatttgtgtagccaatctgattcgctgcgcttctcccccagataatgttccggaagcgcgactcaaagttagatagtctagtcccacattttccaagaatgaaagtctgtcatttacttcttttaaaatcggtttggcaattactttctcttgttcagataacgttaagtttgagaagaaatctactgctttttgaatagacaactcatttgtttgcccgatattcgttccattgatttgaacagatagagcttggggattcaatcgataacctttacatgtctgacaagttaattctgtcatataaagacgcatttgctcacgcgtgaaatcactgttcgtatcatgataacgacgctcgatattcttcaataccccttcgaaagtcgtttctacatcgcgaacgccaccaaaatcattttcataatggaaatggaaaagatcatctgtcccattcaagatgatctcctgatgctcttccggtaattcttcgaatggtgtatctaaatcgataccgaaactttcacaagcctgcgctaacatttgaggataatactgagagctgattggattccatggaacgatagcaccttgactaagtgtcttcgttctatctggaatcactaaatcttgatcgacttctaatttgacacctaaaccatcacagtctggacaagctccaaaaggcgcattgaatgagaacagtcttggttctagttcgccaacagtaaatccgcaataaggacaggcatagtgttcgctaaacaacatttcttcttcaccgatcacgtcaaccagagcatagccgtctgctaatcgcagggccgcctctaaagaatcaaataggcgagaacgaatcccttctttcacaatgatccggtcgatgacgatcgcgatatcatgttttttgtttttctccagctcaggcacttcacttaaatcatagatctcaccatcgactcgaacgcggacgtatccctctttttggattcgttcgaatatttttttatgttgtccttttttctttaccacgatcggtgccaacacttggatctttgtgcgctcaggcaaagccattacttgatctgccatttgatctactgattgactggtaatctcgatatgatcgttgggacaaatcggatgtcctacacgtgcaaacaacaagcgtaaatagtcattgatttccgtcacagtacctactgtcgaccgaggatttttacttgttgttttctgatcaatagaaatcgccggactcaatccgtcgatgctatctacgtccggcttatccatttgtcctaaaaactgacgagcataagcagaaaggctctctacgtatctccgctgcccttcagcgtacagcgtatcaaatgctagggaactttttccagaaccggacaaacctgtaacgaccacgaatttatctcgtggaatcgttacatctatatttttcaagttatgggcacgtgcaccatgaatcgtaattttatcgttagccatgttgtcctcctactttgaagcttttaattctaaaatcatatctcgcacattcgcggctgtttcaaaatccaaagcttttgccgcatctttcatttctttttctaatttcatcaataacgtgtctttttcttccttcgtcatttcttcgtacgagacttgtaccgcttcttttgtatcatcttccgattctttcgtaatagaaatcaaatctcggatttctttaatgatcgtttttggaacgatcccatgttcttcattgtacttctgctgaatcgtacgacgtcttgacgtttcatccatcgctagacgcatagaatctgttactttgtctgcgtacatgattactttaccttcttcattccgagcagctcgtccaatcgtttggactaaggaacgttcactacgtaaaaagccttctttatccgcatccaagatagcaacaagggaaacttcaggtacgtctaatccttcacgaagcaaattgattccaactaacacatcaaattcacctaatcgaagatctcgaatgatttctgttcgttccagcgttttgatatcactatgcaaatatttgactttgatccctaattctttgaaataatctgtgaggtcttctgccatttttttcgtcaatgtcgttacaaacacccgctggtctttttcgactcgttcatttatttcgcctactagatcatcgatttgtcccatgattggacgaacttcgatcactgggtcaagcagccctgtcggacggatgatttgttggataacggtatctgtttgttcatgttcatatggtcctggcgtcgcagagacataaatgatctgattgacatgtttttcaaactcttctaaccgaagtggccgattgtctaaagcagatggcaaacggaaaccgtaatctactagcatctgttttctcgctcggtcaccattatacattcctctgatttgaggcatggttacgtgcgattcgtccgccacgatcaaaaaatcttcaggaaagaaatccaatagcgtataaggcggttcaccttctttacgtccgtccatatgccgagaataattttcaattcccgacgtgtagcccatttctaacatcatttcaatatcgtaattggttcgctgttctaaacgttgagcttccagaagtttgttttcatttcgcaagacagttaaacgctgttctaattccgctttgatattcgctacggcatgctccatatgttcatcattcgtcacaaagtgagtcgccgggaagattgctacgtgttccgtttctcctaaaacttcacctgtcagtgcattgacttctcggatacgttcgacctcatctccaaaaaactccacacgtaaggcacgttcatctcttgaagccggaaaaatctccacgacatcaccgcgcactcgaaaacgaccgcgctgaaaatctatatcatttctttcgaattggatactgactaagtcacgaatcaactgattgcgatctagttctgctccctgtcgaatcgaaactacttgtttttggtactcaaaaggcgagcctaatccaaaaatacatgaaacggatgcaatgacgatcacatcatttctttctaataatgaactagtagccgaatgtcgtaatttgtcgatctcatcatttacacttgaatctttttcgatatacgtatcgcttgaaggcacataagcttcaggctgataataatcataataagaaacaaaatattcaacagcattgttagggaaaaattccttgaattccccgtacagctgaccagccaatgttttgttatgggcaataatcagtgttggtttattcactttctcaataagattggaaatcgtatatgttttccctgttccagtcgcacctaataagatttgtgcttttttcccgccgactacgccatccactaattggttaatcgcttcaggctgatcaccagccggttggtatttcgagacaagctcaaagtgtcgggaggtatctctctcaatcattcttcgtcctccttttcattcattccttttcattttacgaccaataaaaagaaaaggaaagcaaaggcattccttactaaaaaattataccacaccgaacatactttcgccacttttttatcttattatacatgttatgttttataacataaaatgttagaaactcgcatttttttcattttttcgagcttacagtcttgtctgattcagcacttttcgcctataataataaaatattggaaatttaggaggttgattatgaaaagaaagcatttatttcactcatttgttttcttaatgacaggacttgtgacacttgcgtttggtcatgttgcacaagctgacaacactacaacggcagagtcaagcacaagcgagacaatgcaaaaaatagagcccaaaaaagacgtatacgtaattgccagtgactctgcttttgctccatttgaatttcaaaacgcaaagggcgagtacgaaggcatcgatgtaaaattgatggaaaacatcgccaaactgcaaggatttaacatccgaatggactaccgtggtttctctgctgctttgcaagctttggaatcaggacaagcagacggaatgattgccggaatgactgtaacagatgaacgaaagaaaagctatgatttttctgattcttactttgatagcgggatccaattagctgtcaaaaaaggagatacttcgatcaagtcttatgaagatttgaaaggaaaaacagtcggagcaaaagttggtaccgaaagtgctgaatttttaagcgaccatgaatctgaatatggctattctatcaaatattttgatgctgctgatcaattgtacgacgggttaaaagttggcgcaatcgatgcaatgatggatgattatccggtaatcggttatgcgatcaaacaaggacaagaattggaaacaccgatcaaaaaagaatctggcggaaaatatgcatttgccgttaaaaaaggacaaaatcctgagcttcttaatatgttcaatgaaggattgaaagaattaaaaagaacaggcgaatacgataagattattaaagaatatgtagcggatggttcagaaacttccagtgagtcttccactgctgatgaatcaacatttcttggacttatccaaaacaactatcaagcattgttgaaaggactttggagaacaattctcctaactttgatctcctttgctttggctatagtaatcggtgtgatttttggattattcagtgtagcaccaatacgcgctcttcgcacaattgctagtatttatgtcgatatcatccgaggaattccaatgatggttcttgcgttctttattttctttgggttgcctggtatcgttggatttacgattcctgacttccttgctggtgttatcaccttgactcttaacgcaagtgcttatatcgcagagattgttcgaggcgggatcaacgccgttcctgtcggacaaatggaagcttccagaagtttaggtctttcttataatcggacaatgcaaaaaatcattttgccgcaagcgatacgcatcatgatcccatcattcgtcaatcagttcgttatctcattaaaagacacaacgatcatttccgcaatcggtgtagtcgaattgctgcaaactggtaagatcattgttgcacgtacaacacaaagtacgtatgtttacttgatcattgcgatcatgtacttgattttgatcacagcattgacaaaattagcaaaagttttagaaaagaaggtgaagtaagatggcagaaaaaatcttagttgagcatttagtcaaaaaatacggcgataacacagtattaaacgacatcaatgtatccatcaacgaaggagatgtcgtctgtatcattggcccttcaggttcaggaaaaagtacattcttgcgttgcttgaatcgtttagaagaaccttctgacggtgaaattattattgacggcgcccacttgatggataaaagcacagatatcaacttggtgagacaacatatcggaatggtattccaacactttaacctattccctcatctttctattttggaaaacatcattttagcaccgatggacctgaagaaagaatctagagaagaagcagagaaaaaagcaatcaaattactgcagacagttggtctagaagataaaaaagatatgtatcctgaaatgctttctggtggacaaaaacagcgtgtggctattgctcgtgctctagcgatgaaccctgacatcatgctttttgatgagcctacttctgcactcgatcctgaaatggtcggtgatgtcttgaacgtcatgaaaaagttagcagaacaaggtatgacgatggttatcgttacgcacgaaatggggttcgctaaagaagtggccaatcgcgtcatgttcattgacgacggaaactttttagaagatggaacgcctcaacaaatctttgaaaatccgcaaaatgaacggacaaaagatttcttgaataaagtattaaatatttaataaaaaccaaaaatgcacggtcgccatgaagggaccgtgtatttttatcttcttattttctcacctaatcgtatcagccgcatcgcttgttttcctgcacaaacaagcaatcgctctacctgttccatcgcataagaaagtaccatcggttcattgatgatatcaagtacatagtcgataccaccctcacttaattgagcttgatttttcttctccatattatgtagttgtgggacaactttctgacaatcagcaattgtgtcaagaacggatcaatcctttattggagttgctcgaaagggtcttctcttattacggacaggctttgctcactgtacatagacaacaaatcattatcctagtcaatcggatttccagagcctcattgctatcattgcttgataaaatccagacaaagtttaataaaatgtatcagttacagctaaactttggaattgggtcgctttgttatacagagcaagagacaccgcaatctttccttcatgccaaacaagtttgcgaatggatagctttccatcaatctgtgaacgagatccgcttttttgaagatttagacctcgggatcgttttaccagcaatcccgtcagatcaacgaacattatatgtaaaacgtattttgaaaagcctgacagaagaagaagtacatttgttcaagaagactttggcatgcttcagtaaaaataacggaagcatcaaaaattgctcagaagaattatttattcataaaaacaccttgcaatatcgattgaacaagttccattctctcactggttatacccctagaaactatgacgattatcatattctaaagctggcttttttgttggtacaaacatgacaactacaaaaaaaccaggcgaacatatgattgttcgtctggtttttaattattaatgacttagcgtttttactagaaaaactacttccgctttttcccgccaaaagcatctttaaacttatcgaagaaaccgtcttcttgctgttcttcaactttgatgccgccagcttcagcgaatgcacgtaatgcttctctttgttgttcatttagatttttcggtgtgatcagttttactttgacatgttggtcgcctgttgcaccaccacgtaacttcggagcgccttttccacgtaaacggaagttcgtacctgtctgtgttccagcagggatcttcaatttcacatctccatggacagttggtacttggacttcatcccccaaagctgcttgtacaaaacttaaaggcaattcatagtaaatttcagaaccttcacgatcaaagatatcactttcttctacacggaagaccacatacaaatcaccaaatggtccgccgttttctccagcttctccttgaccagctaaacgcatttgttgtccttcttctacaccagctggtacattcactttaactgaatgtgctttcttctcatgtcctgagccatgacaggttggacaaggttctttgatttctttccctgtcccatgacaaacatcacaagtttgacggctcatcactcgtccaagtggtgtttggcgttctacattaatcgtacctgcaccatgacatttatgacaagtagttggttgtgtgcctggttttgcaccgttcccaccacaagtatgacagatttcttcccgattatacttgatttctttttctacaccaaaaatcgcttcttcaaaagacaagtcgaccgtatattgcaaatcagcaccttgacgaggcgcatttggatcgactgaccgaccgcctcctccaaagaaagagtcgaagatatcttcaaaaccaccgaagccgccaccagagaagccgccgaatccaccaaatccgccaccagctccaccagcaccgtaatttggatctgtgcctgcatgcccgtattggtcatatgcagcgcgtttttgcgggtcacttaaaatctcatatgcttctgatacttctttgaatttttcttccgcatcaggttctttattgatgtcaggatggtattttttcgaaagcttacgataagctttctttatttcatcttctgatgctccttttgagagccctaagacttcataataatcacgttttgttgccataggctttcctcctattggttctcatcattttcacgtcgcttgttatcatatcatattttgtttgaaacaaaaaccgatacttcaaactatttttcaaaagaaaaagccaaagtagcaactttggccttctctcgaaattcagtgaactgattatttatcgtcgccatcgacttcttcaaaatcagcatcaacgacatcatctgctccgccttgagctgcttctgggttttcttgagcttgttgttgtgccgcttgttcgtatagtttaacagtcaagttttgaacgatttcgttcaatgcatcgcgtttagttttcatttcttcgatgttgtttgcttcaacagcggctttcaattcatcgcgagctgtttctgcttttttcacttcttcttcgtccactttgccttctaattctttcaatgttttgtccacagagaatagcaatgcatctacatcattacgtaggtcaacttcctctttacgagctttatctgcttctgcatttgcttctgcatcttttaccatacgttcgatttcttcgtctgttagacctgaagaagatttgatcgtgattttttgttctttttgtgtacctagatctttcgcagatacatttacaatcccgtttttatcaatatcgaatgttacttcgatttgtggaataccacgaggagctgctggaatatctgtcaattggaatcttcctagagttttgttgtcagcagccattgggcgttcaccttgtaatacatggatgtctactgctggttgattatctgccgcagttgagaatacttgtgatttacttgttggaatcgttgtattgcggtcaatcaatttagtgaacactccacccattgtttcgatacctaatgacaatggtgtaacgtcaagtaaaacaacatctttcacatcaccagtgatcacgccaccttggatagcagcacccatagcaactacttcatcagggttaactgatttgtttggttcttttcctgtttctttacgtactgcttctacaactgcagggatacgagtagatccaccgactaaaataacttcgtcgatttctgattgtgataaacctgcatcttttagcgcttgacgtactggtacttttgtacgttctactaagtcagctgttaattcatcaaattttgcacgtgtcaatgtcatttccaaatgcaatggtccagattctcctgctgtgataaatggcaagctgatttgtgtgcttgatacgccagataaatcttttttcgctttttcagcagcgtctttcaagcgttgtaaagccattttgtcttgagacaagtcaatgctgttttcttttttgaattctgctaccatgtagtcgatgattttgttatcaaagtcgtccccacctagatggttgtcgccagctgttgacaatacatcaaagacaccgtctcctagttcaaggatagatacgtcaaaagtaccgccaccaaggtcgaatactaagattttttcgtcgcgatctgttttatctaaaccataggcaagagcagctgcagttggttcattgacgatacgttctacttctagaccagcgatcttaccagcatcttttgttgcttgacgttgtgcatcattaaagtaagctggcacagtgataactgctttttcgactttttcacctaaatagtcttctgcgaatcctttgatatattgaaggatcattgctgagatttcttgtggtgtatatgatttaccttctacatctactttgtaacctgcttcaccgatatggcgtttgattgatgaaatcgtatttgggtttgtcacagcttgacgttttgcaacttcccctacttggatttctccatttttgaatgatacaacagaaggtgttgtacggtttccttctgggttagcgatgatttttgcttcgtttccttccaatactgctactgcagagttagtcgtacctaagtcaataccgataattttactcataattaacgtctccttctttaattgaaagtgtaagttttatatccgcacaattattgtgcaacaatgaccatggttggtcttaacacgcgatcatgtaatttgtagccttcttgtagtacttctacaatcgtatcggctggtgtatcttcagtcgctggaacagtttgtactgcttgatgaagattaggatcaaaggcttctcctttaggcagggattttttcaattccttcttcttccagtgcgttacgcaaactttccaagaccatttccacgccttttttcaaacctgccccttgatcatctgacacttctgtggctaatgcacgttccaggttgtcaattgatggaagtaattttttggctaaatcttgtgaacggtatttttgtaattgctcacgctcattttttcctcgatttgccatatttgcgatttcagcacgagcccgcaagtatttatcttccatttcttctaactcagcttttaatttcgctgtttcgaattcttccgcttcagcttctgaaatacccgaatcttctgcagcttcgacatcgatttccggttctggctgagcatctgtcatttctttatctagttcttcttgattttctttcacgatacagtcttcctttcattattcagtcagctgtttgattgctcttactaagaaagagagaacgatcagctgcaaatagcttcgttattcacattacgagtttgacaagtcaagcgaacggtagtaatcagcaagtttagctgctagttctcttcgataaacatcgactagaccgaacatccgagaataaggcatactagtaggccctaacaaggctattgtacctcttccatgaccatctatctcgtaacttgcttgaatcatactcatattctgcaataaatcattgcctaattcagcaccaatcttgatatgaatattgctatccatcggagtgatcatttgtgtaagtccgtctgagtctttcataaaagaaaacatcgatttgaactgatcaagatcttgacggggctcataatccaagagattcatttgtccactgacataaaccttatcttcaaaaacatgaccaagaacggtgtcaaataactgagacatcccttctgtcgtttggaaatatttatgaagaatcatcggaatctccgtacgaagtttatggtacaccgtcatcagaggatctccgactagacggtcgtttacaatctgtaccattttttctagttcctgacttcccatatattcgggaagagtgaacacttggctttctacattccccatatctgttacgacgatagcaataatctgtcgattattcaagggtacgatacgaaagccagtcagtcggcggtcttttatttcaggtcccaatgaaaaagtcgtatagcttgtcagctcagataatatctcagcagattgcttaataatctcattgatttcatgaaattctctgcctagagactgacgaatcagcagcaaatcatcttctgctacgcgagcaggttttaacaaatgatccacgtaataacgatagcctaaagcagatggaatccgcccagaagaagagtgagtcttcaacagcaatccttcatcttctaatgctttcatatcattgcgaatcgttgctgagctggccttgactccctcagacatcaatgttttggaaccaacgggcacgccactactcgtatagtgttggatgatcagacgtaaaatgtcgttttgtcgctttgttaacatcttcctcacctctcattagcactcatatattctaagtgctaatccacttataaatatagcaagaagcccttctcctgtcaagagaaagactccattttttagcactctaaacacaagagtgctaattctaaataattgatgtaaatccagttatatcaacgtttcaatagtcctttattgtatttttgaactttttttatttaaattcagataaaaaacaaatattctttaaactatttttcaaacaaaaagcgctcaaacacattgttccccaaaaaggtccctcttggtgtcaaataaacacggtcttcttcattaacaagtaacccttcttgctctaattcccttagcacatcaccgtacaccgattcaattgttttttgatagcgatcatagaaatgttttttagtaatccctgttttttttcttagtcctaagaacatttcttcttctatttgattttttcgtgtcaatttttcttcttccaataccgggcgttcatttgctcgtaatgggcgtaaatagtgttggattggtcctttgttgcggtaacgaatatctccaagataaccgctagcaccagctccaaacccaaaatagtggtcattgttccagtacatgaggttatgttgagattcatgtccggagagcccaaagttacttatttcatattggtgacgtccatgcttttccattgcttcaatcgtctcttcaaacattctggtttccgtttcctgatcaggcagttcgagtcttccttgtcgtacccagttcatgaacattgttttgttttcgaggatcaatgagtacaaagaatagtgaggcagatccaaagccaaagctttttccaaagtatccagatatccttctagtgtttgtcccggtaatgcataaatcaaatcgatgcttacattggtaaaattttctgcttctaaaaattgcatagtttgatacacatcttctgcggtgtgtttacgtccaatttttttcaataagcgattatcaaatgtctgcactcccatggataaacgattgacgccatagtttttcattacttgaagtttttcacgggtcaaatcacctggattcgcttctacagtaaactcattaccattttgaaaaggcaggatctctctagcacctgataacagtcgatcaagttgtttagcagataaagaagttggtgtcccgccccctacgtaaagtgtttctaaattcgctgtcggatgactttctagcattattttcatttcattcagcagcatttccacatactcatctactggctgcccttctaaaaaaactttattaaaatcacagtaatagcagatatgctcgcaaaatgggatatgaatgtacgcagaaaccttgttttctgcgggatttattgtttctatcattgaaattctttctccttacgtcgaaaagtcgtgcctgttttcgaccttcttaaaatcgcgttcaagcaccaactcattgaaataagccgcatatttagaatcaaggaaacctagctctaaaaatgcttgcttattgtcatcggagctacacggtgcttttacagcctctcgataaacggtaatcgcaaagctgaccttcggcattaagtcaaaatctgcaaaaatatgaaaagctattttcacagattcctccttaagtgctcagaccacaacgctttgcttacaacctctcatatacgcatactaaacgtatttggcgaacaaatccactaaaaaatccaagaatcgacttcttggatgattttttctttcattaaactggttacctagttatatatctctagggttgttttcatgtctgagtgcccgatatgatttatttttcgtttctataattactttttgccttccagtttcttttaatattgtactcaagcaagtgggaattggttcttttgtcatccatgtatgcaaaatgttataatgctggtaaacaaaaatgattacctgtcatttttatttagttcgtatttaattaagttgactatctgtatactctgtctaaaacttaagaattgttgttttcgctgtcgctacccaattttaatgaatgtctgtaggttaaaactgttgtccttgttatagatagtaaaggagagcttgaaaatgaaaactgcgattacgtttctattagaggaatatgccgattgggaaggtgcttatattactagcacactaaaccaaaatgagaaatggcaaaacaaaactgcttctatccaatcagaggtcacttccattggaggattaaaaacaaaaatcgattacttaatcgaacaaatacctgaaaaagttgacctttttattatgatcggtggcaattcatgggacataaaaaatcatcatttatatcaaataatcgataaattgttaaaaacagacgtaccagtagctgctatttgtggggcagttgattatttagctcagagcggattattgcaaggttacaaacacaccggaaatgcgcaatttccttggttagaatcggaaaattatcagaataaagaagattttatagaacaacaagctgtgaaagatcgtaatttgattactgcgaatggaacagctcctatagaattcacagacttgattcttcaagcagtccattttgaaacagaagaaataagagaaaaaacgattcgtctatacaaacttggattctatgattactataaaaagtacggagatcctttctcctaatcattctcttcaattaaatactccttatcaatagtgtgacaagtaattttactgatgattatttgtcacactttttctgacatttatcaaagaagatacactctatttatattcatagacaaggttttacggattcaaaaattcaggattatgctatactggtattaaaaaaataatgaggtattttatatgaaaaagttaggttttattttattgttggtctctttattccttgtaggatgtacgtctcctagtaaagaaaatagtgatccatctgcgaccacagacaaaagttcaatcagacaaaccagttcagctgaaaaatcaagtactcagaaatcagcttctactgaaacgaatacatcttcaacaagcagtaaagtctcagagcccaatacttcttctacatctagtagtacagttgagacaaatatttcttcttcaacaatagacacaacctcctcacagtcttctcagtcaatagatccgttagcaggatattctgatctacaaattgagtacgcacgtgtttggctagctattagaggtaatacttttagagatacatcgggtgatttcgaattacatgttattcattatcctgcaggaacacctatcgccccttatgatgcagggagtgcagtctatccgaaagatgtggttatgctcactgggaaatacagttaccagggagttttagtgtattcaagtaaccatgacgggacaatcactagttatccagttccttcacattggcaaatgcctgcagatcaaacatcttatccagcgttcattagagaaacaactcaagaaatcattgataatgcatctgtagtagctattcctacaggaaatcccaatgacgtgaaacagttaatcgatgtgacagttatagataattagactttctaatatgttatacaaaaagaagctgacagcattttgtcagcttctttcactttcttttctatttagatttattggtctttgatagactccaaggcaggaaaaaattttttaaataaacgtttgcaaaacagtcgcttttctatcttctaccgctacttctgcataggcaccattaatcaatgtcagttgtggcggtacatgaccacaatcaatatcatacaagatcggtagttttaattcctttgacagatcttcgtatacatccttcattttataatctaacaaatcctctgccgcacttctaccgaacatgatccccgagctgccatcaaaccagcctgccagtttcatctgaacaagtgatcttcttaaatcaactgacgatagctcacagttttctagaaaccacaagatcggctttccatcattatactttcttttaaaagattggacatctccataaggagtaccgattaaatgcctgatcgtatcaatacaaccacctaataatcgtcccttcatccttactgcatctccgctgactgattgccaatttgttggttcagtgagatggaaaacagaagatgatgaatgctcatggggccacactttttgatacttttcagaagattgctgtagaatcgattctccttctcttgttttcagtacactttcccacattgctgtcgtttcatccaagtactctcctcttaaatcaataaggttagttccatgtgcagtggctatccctgtttttaatgtgacagcaagtagcaacgtactaatatctgaataacctactatccattttggttgtagagcatcaaaatcgacaaaatcgagaatctcaatcaataattctcctccccaagtcggaaagatcatttggatattttcatcttgcatcatttgattgaattcatctgctcgttttcttgctggacctgatttttccttatcttgcgtccaaagcgtctttccagtaactacttggaaagatttttcttccattctctttaaagctgattcgagtaacgaatggtgttcctctgatacgcctgaggatggtgcagtaaccccaatcgttgcatttctttctaataatggataacttatcatgttgcttcacctccaagtatgcactattttacttggttaattgtttttttcgtttgccggcatcaaaaatatcggcatctcaagtagctggatgattttgtttaagtcaaccgtttggatgaccatcgtttgatctggtctacctggtgcaaaaacaagtttttcatttgataagagctcttcatcaataataatcggaatctgtttttcataaccaaacggagaaacagcgccctgcttttgtcccgtttgttcttccatgcgttctgatgaaacaatagaaagccttttaccgacgatcttccctaatgctttgaaatccgtttgtttcgtagtaaaagtcagatatacgtagttattatcttttttatcttttaagaataagcttttggtctctgtacctgtaaatccttgttctttctttattaccaaagcatcttcatttgtataaatggctcgatgatgatacaactcaaaatatatattttcgtgtaagaatttctttgccaagtcaatcatttttatgtctcttttctattttattatttgagacatcttatcatataaatatagcggttacaacattacttgtgttttgttcgttttttatacataactattgtttttctggtaaaataaatcaaaccacttaatggaggcgttttagaatggaaaaatttcagccgatcatcaatcaaatcaaagaaaaagaacatcaacaaaagatcaaagacctttttgctaagataacagaaacgtatccccagctagacacaactgtaaaatggaaccaacctatgtttactgaccatggtacctttattattgcatttagttttgctaaaaatcatttttctatcgcaccggaaaaagcagcgattcgtgcccttgaaaaaaatatccaagaagcaggctacgtatatacggataacgtcatcaaagttccttggaaaagtgtaatcaactgggaattgattgaacaattgatttcatttaatattgaagataaaaaaggtcatgataaattttggcgataaagctttatacgaataaaccttttactggcgaggaaactattcatcaccttatacaggttttgttcaatcctatcctttttatcatccctggttaaacacttaattgacaaagtatctgctatttttataaggagtctttcttgtgctgaaaaaaatcactgattgaatggctttgaattttctacttagtaaaattattttttcagcaattttcctgcaaaacttttgaataaggaaaaaatacgagaaaatatcagtgatctttcataatactgcccattattttcaggtatatttaaatataatatcactttaggagagaacgaatttctttagagaaataaaagttagaattttctgacttgatttttacaatgaccttaattaaaatcgttctttctacatttcgtgattaagcaaatatcaactaagtcagtagaaccattcacataggagggtgaacattgaaagatttttactcagtaaatgaattagccgaacaattaggtgttactacacgttctatcagaaattatcttcatgaaggaaaactaaaaggaacaaaggttggcgggcaatggaaattttctgaacgtaatctttttgagttcctatacggagatcaagcagaggaagcagcaaaagaaatgcagcgattcatgctaaatgcaccaatcacgatgcgtttcaaccttcaatatcgtgattttacagcaatcaatcaattccgagaacaattagtccagtaccataacgatgtttacgcaaataaaaaagaccgtcttttacaatacgatctttataaagacaatcatgcggagatactaatcggtggtaacttcaattatgtcgtaaactttagtcaatggatcaatgaaaaattattgatccagacagatatttcccttgtatcttaaacaattaaaaagcgctagaaattccagagatgttggaaattctagcgctatttttttataagtacttactgtttggttcaaacaaatatttttttaataaatgaaattttaccatctttatcctcaaataaagaccgtgaccatgcttcctactacgatcagcaataatccgataatcgttaattttttttcttttggtgtcttattttcatgcaggatgtacataccgcctaatgtagagataactacgtttagctgtgtaatgatatatgcagtagcaaccccattttcatttgctgaaaaaatataagccaatgctgacacactaaagatggctccaacgatcgttgctttccaactcttgtcttcagaaaatgcggttggtttacggaaaatcacataaatcactgcccctaaaaagacaccgatcatttgcggaaagaaaatggaaagtccgcttgcatcaactagtttaggcaatgcactgtatacccaataaccaatacttgttgatgctaatagactaattccttttgtgataccgcctttttttccaggatcatcactgattgccgttaaagcagaaccaaatacaagaagaatgattgctgctgctccaatgattttccccatacttccagaccattctccaaaagcgaagacaccaatcaacgaggttccgactaactgtaatgcagtcgaaattggcatcgttttagaaacaccaatcaagttgaaagatgtatactgtcctgtttgtccaataacccaaaatgcaccagaaagtaaactaatcaaaaatgtagtcactgaaataccagctggagaagcgaataattgaacgagtaagccgacaagcaccgctccaataccagttcctaatatctcatttgttggtctgccaccaatctttttcaaaatcagtggctggatcccccagccaactgccgggatcaatgcaatcaataaacccatttttattcacccttatccttttccaccttggaaagaaggatataaagtcatcccaccatctgcaaatagtgtaatacctgtaacataactggattcgtctgaagccaaccatgcagctgtcgccgctatttcttttggttcacctacgcgtcctagtgggatcatactttccaagagttctttttgttcaggatcatcaaattttgccgcattaataggtgtacggatagcaccagggcctatactattgattctgattcccttcggtgcatactccattgctaccgtttcggtaaataattttaccccgccttttgaagcagcgtaatgagcaaacgttggccatgggatctgttcatgaacagaagacatattgatgatatttccttttttattattctctgtaaagtaatttaaagccgctttcgttccgataaaaacgccagtcaaattgacttttaacactctttcccaatcttcaaggctaagttcatgggttggatgctgattttccatcccagcattattaacccaaacgtccagtgtcccaaaattttctaaagccgtatcaagtaaacgctgtattccttcttcagaactgacatctgcttgtacagagactgcttttccgcctgcctcttcgattgctttgactgctttttctgctccttctttatccgagttatagttgacaactacattcattttttctttcccgaatcgttgagcaatcgctgttccaatcccctttgagccaccagttactactgcgactttgttttctaattccttgtacatagtacccactcctttttcatacctaaacctgttattacggataacttttatttccgccttaaagtgagtgtacaccaagatatatagtctaaagcaaatgatacgctctagcaatcgttttcatgaattgctagtgtccttttatttctataaagaaagaggttgtgacagaagtggtcagcttcaagaaatttcggcttatttccgaagaagctacttctgaaaaaccatttatttggaaaaaaaggctgtgacaagacttttgtcacagcccctttcctgggcttatttatcacccattttattgtaattgctagttatacataaacaagagattttatgcataatgttttattgctgagaaaaatattcagctgttgcttgttcatcctccttgagttgttcaatcaattcctctacactagaaaatttcacttgatctcttaaaaattgattccagcgtaccgcgacatgttcaccatagatatcttgattaaagtccaaaatatacaactctacagtcagctcccgtccttcaccgaatgtatcattatgtccaattgaacccatggctggataccatgtttccccaatttttatttccgacacataaacaccttctttaggcaaatgaaccgtgctctttactttgacatttgctgtagggaatcctagtagtctgcctcgtgcatcgccatggacaactaccccttctacctcatatgtgcaacctaatagttttgctgcttcttttacttgtccgctgtctagtaatccacgaatacgggtagagctgattttttcaccttgttcttcttctttagaaactgtgacgattttgaatcttcctttggcatattcaggaaaatgagcgacatctgcaatgtcttttggtccatacgtataatcaaaaccggaaacagcatattttgcatgtaaccctacgatgtattgatcaacaaattcctgcggtgctaaatgagcaaaagaagaagtaaaatcaacttcatataaataatctatacccaaagcggccattttttcttctttttgcttaaggctagtcaaatatttcacgctgctaggatcgatctttttaaagacaatagatggatgctgattgaaagtcatcaatgctaatttcaatccttctttttgtgcaatttccatacctgtctttatgactttctggtgtccgatatgcacgccgtcgaaaaatcccagcactaaaacgacatcgtcttctggaatttgttctgattggtaaggatgtctgatcttgatgatattcattcgttattcctcatttctcaatactttactaggttttaatttgtttttttctttcgggtttggctgataaatactgacaacttttcctttataaaacaaagcaatttcttctgacggcatttctgggagcgcaaatacagtataatcaagtctcataccgttttttactttctgccatacttcatcagtaatatctactcgtttgaaccgttccactcctttttctattggcagcaaacaatcatcgattgtcccatttttcacagcttgagctacttcttctaatgtcagagcatccttctgggacataccggcacttgctgttcgggtcagatcagacatgtgcgcagggtaaccaagtttcttgcctgtatctacagctaatgtgcggacataggttcctttcccgcattctacttcgaagcgccaagaaatggttcctgtcacttcgtctcttgtcaattcacttgtccggataaaacggtaaatctgagcctttctaacaggacgctccactgtttcattattgcgggcatattcatataaccgcttaccgttgacttttaccgctgagtacattggtggtatctgggtgatctcaccaataaatgaagccatcacttcatctatttttttttcagataaagacatatctactggttttgtttctacccgttctccggatcgatcttccgtcgttgtactgaaacctagagttatctcgcctacatagattttcccagaatctgtcaaatattcgataacttttgtggcttttccaatacaaatgggcaacacaccgtctacgtctgggtcaagcgtacccccatgtccgatttttttcgtatgtaagatttttcttaatttgaatacgcaatcatgacttgtcattccgcgttctttccataaaggtaataacccgtccatgtcttttctccatttcatttttgatttaactgaattattataacacattgcatcaattactgacgaatttgacatcataatgaacggtttttatttttcggcaataaaaacgtaacaaaattcatgctcacgtaaatagaaatcatgttatgcttttttaaaggagggaatagaatggaagattttttctttgcaccatttgattggatttatgggtggcttacaggtaaatagtttggttttcacttcccaaaaacgaaaaaaaagactggccattcttccagtcttttttccgttttttttatttattttttcagtttcttaatcaatgtaaaaaattctattttgcgggatcgattttatcattttattggtcaagatttttccatttccaatccaatacttctggcagatcaataccattttcacgaatatagttttgatgttcttgtaatttctgatccatttttttcgcaaaatcttctgcttgacttcctttgatttttaaagctgcgtcttttgccaaatgataacgatcaagttcatttactacacgcatgtcaaatggtgtcgtgatatctccattttctttgtagccatgaatcattaaatgatggttatgacgatcaaagaaaatcgtgcggaccaatgtttcataaccgtggaaagcaaataagatcggtttgtcttttgtaaaatattgatcaaattcttcatcgctcaacccacgcggatcttgacttggatgacgtaatttcaataaatctacgacattgatgaaccgaatttttagttttgggaattcttccagcagcaaagttacagctgctaatgcttctaagttagattccgttcctgcagcagcaatgaccaattcaggttcctcctcttttgctgtcgaagcccaatcaatgattttcaagccttcattcactaagacggctgcttcttctgctgagtaaaattgagcacgcggatgtttggaagagatgatcaaattgattttttctgacgagcggaatgctttatccatgactgcgagcaatgtatttgcatccgcaggcagatattcacggatgaactccgccttcttttctgccaaatgtgtcaatattcctggatcttggtggctatatccattgtgatcttgctggaagactgttgagcttgcaatgagatttagcgaaggataatcatttcgccaagaaaggtcatgtgatttccgcatccatttgaagtgctgagtcaacatagagtcaaccactcgcaagaatgattcgtaacttgcaaaaaaccatgccgtccagtcagaacgtacccttctaagaacccttcatcttggtgttccgataattgactgtcgatgacgcgaccagatggcgaaagccattcatcattttctggttcgattttttccatccattggcgatttgtcgttttgaaaacttgattcaatcggtttgattttgtttcatctggtccaaatatacggaaattttctggatttttctcaatgatctcgcgaacgaatttaccaagttcggtcatatcttctgctttaacggagcctggtttttcaaattgcaaagtatattttttccaatctggcataataagcggtcttggatcgattccaccattggtgataggattttttgccattctttggtcaccagtaggcgcgatttctctgatttcttctaaaatacgtccttgtgcatcaaataatttttctggttcataggatttcagccaacggagtaaagcatctgcatgatccatatgttcttgatctacaggaatcggtacttggtgtgctcggaaggttccttcaattggttccccgtcccattcttttggaccggtccatccttttggtgtgcgtacgatcaatactggccattttggcatcacgacatctgttgctgtcttcaggcgagcttctttttggatggatttaattttctcgattgcttgatccattttttcagccataacaggatttaatttttctgaatcatttccttcaataaagaaaggttcccagccaagtccgttaaagtaatttgctaattctccatctgatttacgtgccaagatcgttgggttggctatttttgcaccatttaaatgaaggatcggtaaaacagctccatctatcactggattgataaagacatttgagaaccagcttccagctaaaggaccggtttctgcttcaccatcaccaatcacgacagcagagattacttcaggattgtctaatacagctccgactgcatgtgaaagagagtatccaagctctccgccttcatggatagaacctggtgtttctggtgctgcatgagaagcaatgcctccaggaaatgaaaatcgtttgaataatttttgcattcctgtctcatcttccgttacttctggatagatctctgtgtaacttccatctaaataagcattcgataccatgacttgtccgccgtgtcctggcccttcaatataaaacatgttcaaatcatatttattgatgactcggttcaaatggacataaataaaattttggccaggaatcgttccccaatgaccgattggatgttttttgacatcttcgggtttcagtgtacgtctcagtaaggggttatctttaagataaagttgcccaacagaaagataattagcagcacgccaccaagccgtcattttatcaaagtattctttactagaataatccatacataacactccttttcattattactcttattctagcgcagatactcccaattgaaacctaataagcacttctgttcatttgtttggattttatatctagccaaatgaacaggtataaaaaaccacgaaatttttcctttcgctgacgttttttacattgatccaaaaaacttgtcgttatcacaatggctgttccgcagttcatttcgctcctcatcatgcataatttgctgaatgacgctgggccagttaacacattgctggaaaactggggctggatcgagcaattcctttcctgattgatccgttttatgtaaaagtctctgttatctttgtcaatatgtgaattggtatcccagctactatgctaatttctacagggattatccaaaatttggatcgtgaccaaatcgaagcggcgtaatcggaaatatcaataacttcaacgtgatttttcttttaactgtcaacggaccgacaaactcaaacttttatggtgcaggttccactgatcttctagttacttggctatacctgactgtcactaaaatagattacaatctagcttccgttatcggtatcttgatctttatctatatgcaaaaatttatatactactagaaaaaagaaagtcgaattttttacttttctttttctcttttttggttagctgacacgccgcaagactaaagtcatggaactcttaggtaatacgtcttaatgaaaacaaaaaaatcccgcaacccctgatttcacaggatttgcgggagtttttgattagtctttgttcaagtcgcgaagcaattcatcgatatggttgccatagacaactgattcatcaagttcaaagaacaattcaggtgtcttataaatacttagattgtgccctaactctcgacgaatcaatcctgatgctttattcaatccatcttgtgctgttttcttatctgatgctaagtcagataaaatgctgtaatagatcgttgcttgctgtaagtcccccgtaactttcacatctgtgatcgttacgttctccacacgagggtcacggacctttttgcgcaaaatatcattgacttcttttaagatttcttgaccgactcggcggtcacggtagttagccataatgattggcctccttttatcagtttttagtcatttttgacttcttccatgataaatccttcaattacgtcatctactttgatgtcattgaatttttcaatcattgcaccacattcataacccattttgacttctttcacgtcatctttgaatcgtttcagacttgcaagttggccttcatagattacgattccgtcacggattacacggacaccgctatctctacgaatatatccttctgttacataggcacctgcaatcgtaccaactttagaaactttgaaggtttcacgaacgatcatttgaccggtgattttttcttcaaattcagggtctagcatccctttcatcgcagtttcgatttcttcgatggctttatagatgatacggtgaagacgaatatcgacttcttcagtatcagcttgcacttttgcctgcggtgtaggacgaacgttgaaaccgatgataatagcgttgctggctgctgctaaggttacatcactttcattgattgctccgacagctgaatggacgatttttacacggacaccttccacatcaatcttcttcaatgatgcagccagtgcttctgctgaaccttgtacatctgctttgatgattacgttaacttctttcaattcgccttctttcaggctttcaaataagttatccaaagtcacacggcttgtggcagcacggttttctaataatgcacgtttcgcgcgttcttcacccgctgcacgtgctgtcttttcgtcttcgaagactacgaaacggtcacctgcttgaggtacatcattcaagccagtgatttctactggcgttgcaggtcctgcttctttatcgcgacggccaagatcgtttgtcattacacggacacgtccgtaagtattaccgacaacgattgggtcaccaacatgaagtgttccttcttggacaagtaaggttgacacaggacctttacctttatcaagacgtgcttcgatcactgttccgattgcgcgttgtgttggatctgcttttaaatcttctacttctgcgactaacaggatcatttccagcaattcttcgatgttttggccgaatttcgctgagatctcaacaaagatcgtttctccaccccatgcttcaggaattaactcatactcacttaattcttgcataacatgttgagggtttgcacctggtttatcaattttatttacagcgacgatgattggaacgcctgcagctttggcatggttgattgcttcaactgtttgtggcatgacgccatcatctgcagcaacaactaagatcgtgatatctgtgatacttgctccacgtgcacgcatacttgtaaaggccgcatgtcctggtgtatccaagaaagtgattggtttaccatcaatatcgatctggtaggcaccgatatgctgtgtgattccgccggcttcgccgcttgttacacgtgaatggcgtaatgtatccaataaagttgttttcccatggtctacgtgtcccataatcgttacgactggcggacgtgagactaatttatctggatcgacttcttctgcctcgaagaatttatcgatatcagcaatgtcaacttggactttttcttgtggttccatgccatagtccgtcgctaacagttcaatcgtatctttatccagtgcttggttttgattgaccatgacaccaagcataaataattttttaatgatttctgctggctcacgatgaatttttttcgcaatatctgctacgttcataccttcagtatactctaatacatctggcaattcacggaatttgcgtggtggtacagctggtttagttgattgttgctgtttgccttttttaccttttttattataacgattacggttattattattaaatttgccgcgattgttattgtttggtttgttgttattgttagtacggttttgattgccgccttggctcgttccttgacgattttggctgctggtatttcccgtattattttggtttgttgttggtttttttccttgattcacttgaccgctcccttgaccgcgatcttgataactgcggttatttttatttttttgttgattgttcgttgtttcttttttacgttgatcgttcggctgttgattggctggttttctgcttgcttgttgtgcagcttgttgtttcgtgcttgggtttttgaacgcttgttgcaatttcttctcatcattgctagtaatcgcacccatatggtttttcacatcgatgccaagttgttgtgctttttccacgacgtctttactagattttttgagttcttttgctaattcatagattcttttgttgcccatgcaatcaccttcctaaccttcaattagctccttggtcttcttcgcaaatccggcatccattattccgaataccttgcgaggttttccgatcatctgcgtgatttctgcttcagaaaatagctcaaagcaaggaacttcataatatgaactcttatcttttatcttttttcttgtattctcgcttgcatcggttgccacaaacaccaattttgctttttgtttgcggatttcagcaatggtcagttcttcacccgtgattagttttcccgcgcgcatcgctagaccgatgagattcatggctttttgccgattaactgtattcattttccaaataactctttacgtgctttttggtgagtgacatagtcaagaagttcttgataaaactcatctgttaatgttgtttcgagtactcgatcgagaatttttttatcccaagcttgttgtacttcttccggctcaagtgagacatacgctcctcgtccaggcatttttccagttggatcgatcgatacttccccttcttttgaacgggtgattcggaccatctcttttttaggtttcatttcacctgaaaccacggatttgcgtaaaggaattttcctttgtttcatctctttgcctccttactaaagttaagcttctggtttttcttcgaccgtttcattgttgaatgcaattgtttcatattcatcgtctgttaaatctgactgaacgattgcttcatcatgcagttcttctgtttctttttgttgttcttgattttcataaaattccgtcatgtcagattctgatttgatatcgattttatggttagtcaatttagcagctaaacgtgcgttttgtccgcgtttaccgattgctagcgataattggtagtctggaacgacaactgtgcaggcctttggatttgtctcatcgaagatcacatccatgacttgtgcaggattcaatgcatttgcaatgaatacagctggatcttcattccattcgacgatatccatgttttcgccttttaattcattgacgattgcttgaactcgttgtccctttggcccgacacatgtaccgactgcatcgatatttggatcatttgagcgaactgccacttttgaacgatcgccagcttcacgggcgatgctgacaatttcaacgattccatcatagacttctggtacttcttgctcaaataagcggcgcaataggtctggatggctgcggctaacaaatacttgcggacctttagacgtattttctactcgggaaacataaactttgattcgatcatgtggttgataaaattcatttggcatttgatcttgtttagaaagaactgcctcaattttaccaagattgacataaatataacgtttatcctggcgttcgacgattccttgcatgatgtctttttcataagcactgaattcgttataaataatcgttctttctgcttcacgtacacgctgtaaaataacttgtttagccgtttgcgcagcgatccgcccaaaatcttttggtgttacttcaaaacggatcgtatcaccgatctcatatgctggattgattaaaagtgcatctttcaatgagacttccaactgtgaatccatcacttcttccgttacttcttttaccgcatagacatggatctttccttttttctgatcaaattccacttcgacgttttgtgcttggccatagtgacgtttgtatgcagaaaccaatgctgcttctaaagcatcgatcacgatttcttttgagatccctttttcagcttctaaagcgtctaacgcatttaacatttctttactcattttttctgattcctctccgtgattaaaattggatagctaagcgagcttttgcaatattttttcggtcaaaagtcaattctttttctcgtgtttttatgcgtattttcaatgtaagctgttcagcatcaaatgattgaagaaatccttcatattgtttttcgccatctactggttggtataaggagacatggacataatcaccaagtgccttttcatagtcgctttcttttttcaatggccgctctgctcccggggaggatacctccaggaaataagcttgaggaatcggatctggatctgctgcatcaagtttttcactcagtttctcactgacaaaggcgcattcttcgatatcgataccgccttctttgtcaataaatactcgtaagaaccagctttttccttcttttacaaattcgacttcgacaagttcaaaattttgttcatctaaaatcggtgtcaccatttctgtgactgtttcaacgacgctactcaaaagtttcgcctccttaaaaaattaagtgcgtaattccattaaaaagagtgagcgaaaaatccgctcactcacagttagtatcattacctataagaactataccatactctgcttaaaattacaagcagacaggaaaacagatgcttatagcatatcgaataacgataattgattttcatctggtagatctttcaatacgccattgtcgttcatatattcgatcaatgtttttgaaactttaccgcgggtggcaagatcttctttggataaaaatggaccgtcttttcttgcttcaacgatttgttttgccacgttggttcccaaacttgggacagctctaaatggtgcgatcaacgtatcaccttcaataacaaagttaacggcatccgatttatacaaatcaatcattccaaatttgaatcctcgttccagcatttcattggctaactccagcactgtcagttgattcttttcttttacggaagcatctaatcctttgtccgtgatttctttcattgcttgtttcacagcatcttttcctttgcacatggagactagatcaaagtcgtctgcacgtacagaaaagtatgcacagtaatacaaaatagggaaataaaccttgaaataagcgacacgaagagccatcaatacgtaagctgcagcatgggctttcggaaacatatatttgatttttgaacaagaatcgatataccagtcgggcacattattttctttcatcgccgatagataggtttctcgcaattcatcagggatcttgttccattgtcctttacgaacagtttccatgattttaaatgccatcccgctatctaatccagcatggatcaaataaaccataatatcatcacgacagccgattacttccgccagtgtcgcatctcctcgtcgaatcaattcttccgcatttcctaaccatacgtctgtaccatgagatagtccggaaatttgcagtagttctgcaaaagttgtaggatgcgtttcttctagcatccctcgaacaaaacgagtgccgaattctggaatacctaatgtccctgttttggaataaatttgttcctgacttactccaagtacttcaggaccggcaaatatccgcatcacttccgggtcatccgtagggatcgtttgtggatcgatccctgataaatcttgaagcatccgaataacagttgggtcatcatgccctagaatatctaatttcaatacattatcgtgaatcgagtgaaaatcaaaatgagtcgttttccattccgaattttgatcgtctgctggatattggatcggcgtaaaatcatagacatccatataatcgggaataacgatgatcccccctggatgctggccggttgtccgtttgactccagtagcgccttttgctaatctgtcgacttctgcacttcgaaactgcagattattgtccctttcgtatccttttacatagccatatgctgttttgtcggcgactgtaccaatcgttccggcacggtaaacatagtcttcgccaaacaatactttcgtatagttatgggcttctgcttgataatcacctgagaagttcaaatcaatatcgggcactttgtctccatggaatcctaaaaatgtctcaaatggaatatcatgaccgtctttgtttaagcgtgcaccacattttggacattgtttttctggcatgtcaaatccagaaccatacgtaccatcttcaaaaaactcggaatattggcactctggacaataataatgaggggctaacggattaacttcagtgattcctgtcatcgtcgcaacaaagctagagccaacagagccacgtgaacctactagatagccatcttcattacttttatgcactagtttttgggcgatcagataaataaccgagaagccattaccattaatagaattcaactctttttttaatcgtttttgaatgatctcaggtaacggatctccgtacatttgttttgcttttgtgtaactcaattctgatatttcatcttctgaacctggaatcttcggtgtataaagttcatctttgactggaatcacttcttcgcagatatctgcgattttattcgtattttctactacgatctctttcgctgtttcttcccctaaaaagtgaaatgcagttagcatctcatcggttgttcggaaatggacatccggcaaactatgacgattcaacggattcgctccgcccatagaattgatcaaaatttttcggtaaatggcatcttcttcgttcagataatgtacattacctgttgcaacaacgattttatccaaactttttccgatttctaccaaattttggataatttcttccaaatcatgttcattttttaccaattcttgctcgatcaaaggcgcatagaccgcttttggcataacttcaatataatcgtagaattttgctcggtttcttgcctcttctacccctttttgcatcatggcttcgaatatttctcccttatcacaagctgagccgatcaatagattttcacgcatctttttcaattgggagcgtggtattcgtgggacgcgttcgaagtattcgacattcgacattgaaatcagtttgaacaaatctttcagtcctgcctgattttttgctaaaatcgttacatggaaaggtcgagcccttttgtaagaatctccttctccgatatgctcatttagctgatcatgataaagcatgttatgattgtccattgcctctttcacaaagatccatgctaagtgaccagttgcttcagcatcatagattgctcggtgatgctgttccaagctgacaccaaattttttagataacacacctaatccgaaacgtttgaattgaggatacagatatctagctaattccaacgtatcaatgactggattggccgcttcaggaataccataccttgcgtagctagtattcaagaaccccatatcaaaagccgcgttgtgggctaccaaaattgtatcttttgaaaattcaaggaacatccgcaatacttcttcttccgactttgatcctcgaaccattccatccgtgataccagtcagatctaccgttgttcgtgacaaaggatgtcctggatcgataaattcatcaaagctttcgatcacatttcctttatacattttgactgcggctagctcgatgatcgtgtcatatactgcagacaatcctgtcgtttccacgtcaaatacgacatatgtggcttcactcaatgcttcatgtgcatcattataagcaattgggacaccatcatctacgacattcgcttccacgccgtataagattttcacacctgctttttttccagcactatgtgcttccggaaaggcttgcgcaccaccgtggtctgtaatggcgatagctcggtgtccccatttccctgcttgtgccacaagatcagagatgctgtttgttgcatccatcgtactcatattgctatgaacatgaagctctactcgtttttccccttcaggagcataatctttgcgaggtgtatgtttgacttctatgatatcttgcgcattcatgaccaaatcacggacaaacgtatcttcttgaatacttcctcgtacctttaaccagctaccgacactgatcgcatcaaatacttgttcatctttttcgccgttcgagaattttttgacgataaatgatgaagtataatctgtgattttcaaagtcaagatcttgcgttttgaacgtagttctctgacttctttgtcgaatacgtacccctcaagtgtgactcttcgttcttcttcaacgatactgatcattggtgtcgttggttcatcggctggaatatttcgtcctagctggatgtggatgggtccttcaagagctggcgattgctcttttctttcctttttcttttgttcgtggacaactagactttcagctgcttgcttcataaaggcttctgcctgttcttgtttgcgttcttcaaaaagtttcaatactcgttccgcttgctgctcatccacttctggttcgatacgaaattttgggaatccgtaactgacgaacaactcttctactaatggcaagtattgttgcttcaaataagaaatagctcctgtactgtcgattggcaagatgactttacgatcttttatcacaggtacctgcgttttcaatacttgctgtgctagtggtgtatcgcattgctgattttccaaagcttgggcccagtaatcttgcaagagctgttcatcgaatgtctggtcatctgctaagatattcagtttgacttgtgcaatatctttaaaagcgatagtcagatgctgagtcaatgaccgatatagcataataggcaaaattttggaaaaatgcagcgtaaattcccataaacgcgatttacgatggaccactacactatccatttcaccagcagtaagcagtggatgatttttttctgcttcctctagttggatttgttccaacagtttttcaaataaatctcgtttttctgacaaagatatacgccctttctgatgagaaacaatgcaattgatcgcatcttatcctcttctttttcagtaccttttagtatactcgttttttctgagttttacattaaaaaattggaactgcgattcaaatcgcagttccaattttaaaagcgaatcatcagattgtcaaaaacagctgattcagctatttttattttctgtgttttaacgcttattattcgccttggttcaagaggattggtaaagtattcaccaattcttctttacgtacttcaaccatttcgccagttttcttgattttcacttctacgattccatccactgcttttttaccgacagtgattctgattggacagccaatcaaatcagaatccgcgaatttcactcctgcgcgttcatttctgtcatcaaccagtacttcatagccagcttttgtcatcgcttcttctagttcattcgtcaggtttgtttggtattcgtcttttagattcatttggacgatatgcaaatcaaatggcgcaattccttttggccagttgattccttgttcatctgaatgttgttctacgattgctgataataaacgacttacaccgataccataacagcccataatcacaaatttttctcgtccattttcgtctagtacagttgctcccatagattcactgtaacgagtgccgattttgaagatatgtccgatttcgattcctcgagtaaaggcaagaacaccattgttgtctggtgaaggatctccttcttgtacaaaacgaagatcttcataagaaagtacagtgaaatcgcgttctggattcacatttttatagtggaatcctgtttcgttcgctccagtaatggcattcgctaaatcttggacataacggtctgcatatacttttacgtcatctgaaacaccgactggtccgacagaaccaaactcagcacctagatatttttgtgcttcttcttctgttgcttcttctaaaaagtcagcagataaaaagtttttcagttttacgtcattgacttcatggtctccgcgtaccaaaacaaggacaggttgttcatccgcaatgaacaatacagacttgatgattttttgaggttcaacagaaaagaaatctgctacttcgtcaattgattttacgttaggtgtagctactttctccaattcaagctgtgtttcatgcgatttttttgatacatagtagcttgtagccatctccaagtttgcagcataatcactttcagtcgaataacagatcgtatcctccccgatttctgagatcgccatgaattcttttgagtctttcccgcccattgcgccaccgtctccgataatcgagcgaaattctaagccacaacgcttgaatacttcggtgtaggctttttcgtaatctttatatgtctcgtccaaactttcttccgttgcatggaaagaatacgcatctttcatgataaactctcttccgcgaagcaaaccgaagcgaggtcgtttttcgtcacgatatttaggttggatttgataaagatttaaaggtaatttcttatatgaattgatttcattacgcatcaaatcagtaaaagtttcttcgtgagttggtccaaggatcatttttcgatcattgcggtctttgaaacgatacaagtttggtccatatgtttcgtaacgcccggattcttcccaaagttctgctggcaagatggcaggcatcagcatttctaccgctccgattttttcaaattcttcccgcataatgcgtttcagtttttccaatacacgatttgctaatggcagatatgaataaatacccgctgatacttggcggatatatccagctcttagcaagatttgatggcttaatacttctgcatcatttggaacttcgcgtaatgttggaatcaacatttttgattgtctcattctatatactcctttatttcctcaaaatagttatcgtttgttattataccctatttgtcaactttttctagaaaaagaatcgttgaatatcgttccatgtaactagcaccatcaacaacattaaaaatccaaagccagctaatgtcaatattccttctttttcttgacttaatggtttcccgcgaatcccttcaaaaatattcaagactaatttcccgccatctaaggcaggaatcggaagcagattgacgattccgagattcattgaaagaagcgccatcaaactaataacagttgttacaccttgatttgctgcttctgaagacaattggtacatcatgacaggtccgcctaatttatctaaactgaaacctgtaaatagtgatcctaaggctttgaaaatttccaatgaaccgctgaaagcttgacgcgtccctccaatgatcttatccataaaacctgtattcattggggcttttataccaagttggccaactttttcgccatttgactctacagatttcggtgtcacgtcgacagattgcacctgaccttctcgttcgatcttaaagtctaatgttttatccggatttttcgtaatgactgttgtcagatcattccatgaatggatttcttttccgtccacactgactacctcatcattttcttttaagcctgcttctgccgcagctccattaggcatgatctctcctacgcgattagtgttcgtcacttgaacaccaccttgcataaatgccagaatgatgaataacaggattgccaaaataaagttattcatgggtccagcaaagttggtcagcatacgctgccacaatttagccgattggaactgtacgtcttttggcgcaattctgatttctgttccgtcgttttcaataatcgtcgcatcgtgatcaacagggtaggttactacttctgtttcgtctccattcacataaccagtgatagtcagctcatcttctaaatcataacggctcaattccatcgggatagcatttgtcaattggattttcttacttaaatttatcttctctacgatgccgtcagaatttagtaaaagagaaagaggcattcctggtgccatttctgtttcatcatccccattgcctgccattcgaacataaccgccaataggtaataggcgaagcgtatatgttgtcccgtcttttgcttgatgcccataaattttcggacccataccgatagcaaattcgcgaacgaggattcctgatcgtttcgcaaagaagaaatgaccaaactcatgaacaatcactaatataccaaaaacgatgataaatgtcagaatcgttttcatagcttttttctcctttacttgttttttgtgttttttataaaacaacgataaaacactataattttaccatagtataccaaagacaccaatagtatcaatataatgaaaaataaaaacctgcgtcttttatgaaattcacaaagaaacgcaggtatacttactaaataatgccaaataaatgcatgataggaaatacaaacagcaaactgtcgaaacggtctaagattccaccatggcctggtaagatatttcccgagtctttcacatcataatgacgtttgattgcagattcgaccaaatcaccaaattgtccgactgctgaaaaaataatcgtcatcagaagcatgacaaacataccatgattaaatagttcttttgctgggtatagcaataaataaagaaatgcgactacaacagcactaccaataccaccgagcgcaccttcaatcgttttgttgggcgaaatatcaggacttaacttatgctgaccataacgtcgaccaaccatatatgctccgatatcagttgcccaaacaataaatagaccaaatatcaaaacagccaagctttctgttcgtgcattgacaaaattctggaaacctattcccacatacaagctgacaagcacaggaaaacctgcttcatcaatcgtatacgtatttttagaaataactgatgttcctaaaagaatcataactataagataaaataacataaatgtacttacattctctggaagaaagaaaaaccatctttcttttggcaaaacaagtaacactgcaccaacggcggataaaactccttcaaaacttaagagtgtcaatcctttcatccgaaacagctcgtaaactcctattactgctaagattgctgctgtaagctcaaccgctatgcctccgatccatataatcggaataaacaagactagcgccacggctgctgtgaccacacgttgtttcatgactgatcccctttctcatcttctgttttttttacaccgccgaatcgacggtctcgattttgataagaggcgattgcttcttcaagatgcgcaccatcaaaatcaggccaaagcgcttttgtaaaatacagctcactatatgcgatctgccataacagaaaattactaattcgctcttctccacttgtacggatcatcagctcaggatcttgtaactctttaggcaagaaacctgtcattaaatgcttagcaatcaattcatcatcgatttcttctgcgtgtatttctccttttgctacttcttcggcaatttcttggacagcagtcacgatctctgctctgcttccataattcaaagcaaaattcaataccattccagtattgttttttgtttgctcaattgcacgtcttacagcatcttgcgtatgttctggcaatacgttttcataacccatgacatgaactttgacattttctttaatcaattctggtacgaacgtatcaaagaagtcgacaggtagttgcatgagaaaacttacttcatcttttggtcgcttccagttttcagtcgaaaaggcataaagcgtcaacactttcactccaagccttgatgctttttttgtgactttctttactgtttccatgccttctttatggccagcaactcgtggcaaacgacggttttgcgcccaacgaccattgccgtccatgatgatggcaatgtgctgaggaattggtccatcggtattaaattgaaattcgcttttttcttgaatatatttgtttttttgcggaaaaaaacgtaacattctttttcctcctatacttaaaagattcccactatcttaagtattatagcaatatctaactgtttttcctatgaaatcattgtttttttatttaaaaactgaataattttttcttttttaatttttaaataaaagaaatataaataaaaacagaggaagcggaatgatccgcccctctgtttttatgattttattaaacttccaataattctttttctttatcagcagcgatcttatctacttctttgatgctgttatctgtcaatgtttgtacgtctttttctaatccgcgcaaatcatcttcggtaatatcaccatttttttgttgttttttatattcatcgatcgcatcacgacggatgttacgaatcgcgatttttgcattttctgcttcttttttaacatctttagctaattcttttctgcgttcttctgtcagttgcgggataactaagcgaatgacatttccatcattggttggactgattccgatatcacttgccataatagctttttcaacatcttgaagaatgctcttgtcaaaaggtgtgatcattaaaacacgtgcttctggaatttggattgatgccatttggttcaatggtgttggcgcaccgtagtagttcacagtaatacggtccaaaaggctagcgttcgcacggcctgcgcggatttgcccaagttcacgttgaagattttgtgctgcttttttcattttttcttttgcttctgtcataattgcatctgccatttttatttcccccttacagttgttccgatattttcgcctaagattgcacggcgaatatttccgtgttcatttaaattgaagacaagcagtggaatatcattatccatgcttagtgaacttgcagttgaatccatgacttgtaatcctttggcaataacttccagatgagtcagttcttcaaattttactgcatttgcatctactttcggatcagcagaataaacaccgtctacattgtttttagccatcaggataacatctgcgccgatttctgccgcgcgtaatgctgctgttgtgtctgtcgagaagtacgggttgccggtaccgcctgcaaagataacgatccgtcctttttctaaatgacgttctgctttacggcgaatatatggctctgcgatttgacgcatttcaatcgaagtttgcacgcgtgtcggtacacccacgttttccaacgtatcctgtaaagctaaggcattcataactgtagctaacatacccatgtaatcagcttgagcacgttccatgcccatttgtgctccgatttgtccgcgccagatatttccgccgcccacaacgattgccatttcaacgcccagctcgtgaacttctttgatttcttggatgatttctttgattactggtggtttgattccaaatcctgcgtccccagctaaagcttctccactcaattttaagactacacgctgatatttcggtgtgaccatgttcattcctccaatattttctattgccattttaccatacttagatgatttcgacactctaagactggtttttcttgttttgcttaaaaaaagggagcgcacaaaccgtgcgttcccgtctgttattcaacagaattattttttcacttggctcataacttcttctacaaagttatcttcgcgtttttcgataccttcgccaacttcgaaacgtacgaatgttttaacagttgcgccttttgatgcaacgtatttttcaacagtcatatcaggatctttaacgaatggttggtccaccaaagcgatttctgctttgaatttcttcaagcgtccttctaccattttttcaacgatattcgctggtttgccttcgttcaatgcttgttctgtaagaacagttttttcatgttctaattcagcttctggaatttgtgattcgtttacataacgaggattgatagctgctacgtgcatagctacgtctcttgcaactgtttcgtcagttgttccatctagaacagtcaatacggcaatacgtccgcccatatgcaagtatccaccaaatgcagcattgtcgtctttttctacaacttcaaagcgacggaagctgattttttctccgataacttgagttgcttcgatcaagtcagattcaattgtacctttatctgttttgattttcattgcagcttccatgtctgctggtttgttttcagcaacaagttctgcaatttcttttactaaatcttggaacatttcgtttttagaaacaaagtctgtttctgagtttacttcaacgattgctgcagtgttacctttcacagcaactgaagccaatccttcagctgcaatgcggtcatttttcttcgcagcctttgccattcctttttcacgtaaaagatcaactgctttttccatgtcgccttctacttcaactaatgcttttttcgcatccatcattcctacgccagtcatttcgcgtagttcttttaccattttagctgtaacgtctgccatgtttaactcctcctgtgtgtttttctttttaaaaaaagctgcttcaaaggagagtgaggcttgtcgcccagcctttgaaacagctccatcattcaaaattattctgctgaagaattgtcgccttcaacaacatctacgatttcttcgattgatgttgctgtgttttcttctgtgaaatcttcttcaactacttgatcttcaccttggtttccttcgatgaaagcatcagccatttttgaagtaatcaatttaacggcacgaattgcatcgtcgtttgaagggattactacgtcgatttcatctggatcgcagtttgtatcaaccatagctacgattgggatatttaatttgtgtgcttcttgaacagcaatacgttctttacgtgggtcaacgatgtacattacatctgggattcttggcatatcagcgataccgcctaagaatttttcaagacgttcacgttctttgttcaaaccagcaacttcttttttaggtagaacttcaaaagttccatcttcttccattgcattgatttgtttcaaacggctgatacgtttttggatagtatcccagtttgtcaatgttccgcctaaccaacgatggttaacgaagtattgtcctgcacgagttgcttcttctttgattgcttcttgtgcttgtttttttgtacctacgaataatgctacgccgccttcttcagcaacgctcttcatgtaatcataagctgcatctactaatttaactgttttttgcaagtcaatgatgtagattccgtttctttctgtgaagatatatttcttcatttttggattccagcgacgagtttggtgaccaaagtgtacgccggcttctagtaattgtttcatagaaattactgccatgtttgtttcctccgatttggttttatttttcctcttcttatcttctaccttgccggcaaactttttcaagcacctaccgacaatccaataagaatgtggatttgctgatgcataaagcaccctcagctattatacagacaaaagatccgtatcgcaagagcaaatatacttttctgctcaacattcaatagtttacctgaaagataaaaagaattcaagaaaaacagtagatttctctttgtttctttattatcctttttccataaaataattttaggtataaaagacgaatattattgggcaatccttcttttttttgttatgatacatgtgaaatctttcgtaaaggagaaagaaaatgcgcaaagctcaaagacatttgctgattaaacaagtcattgaagaattcccgatccgtacgcaagaagaactattaaacaaacttgggcattatggcgttaccgccacgcaggcaacgatttctcgagatatccgtgatctaaaaatcgtgaaggcacctgatgaaaatggcgtttcccgcttcgtattgtttcgcgaaaaaggaactcctgagactaggactgaggaagaggatcggctggttcaaatgattgaagacattgtattgaaagtcgaacgagtccactttttgacgatcgtcaataccttgccagacaatgctcatttatttgcatctgttttagatgagatcaaacctccctctattgtcagtacaattgctggattcgatacgatcatggtcatctcggaaaatgaggaggacgcaaaacgagtagaagaatttcttcaccatccaactgaagtatcacttttttaatcagagcacgtattcctaatatggaatgcgtgtttttttattttcaatattttccttattgaataaacctttacactctttacaaaaatacatcattttttattcaaatttttcaacaccttgattgaatcacaataatcatcatttatattggatgttaacaagagcagcttcttgctctttgtgtatttcaaaaaagaaatgaaaggaaatcatatgtataaattattaacttctggaccattgacgacttctgaaacagtgaaaaatgctatgctgatcgatcattgtacttgggatcaagaatacaaagaaattacacaatggataagaaaaaaattattggatcttgctcaagtatcggaaggaatatacacaacggtcttaatgcaaggtagcagctccttcggggtagaatcggtattaagttctgtgatcaggccagaagatactgtactgatttgttcaaacggcgcatatagacaacgaatgatcaacatgtgcgaatgtctgaaactgaactataccgtttatgaggtatcggaacatcaaatcctccaagctcatgtgattacacagctgattgaagagaatccgtctatctccgcactagcaatggtccatagcgagactacttccggtattttgaataatttggaagagattgctgctgtcacacaagaaagagatcttttgtttatagtggacgcgatgtcaagctttggtgggataccgatttgtgtagccgaactagggattgattttttgatttccagctcaaacaaatgtattcaaggtgttccaggcttttcttttgtacttgctaataaagcggaactggaaaaacgaaaaaatgttagccgaagtttgtcacttgatctatatgaccagtaccgcgtgatggaaaacgagaatggcaaatggcgtttcacttcccctacccatacggttttggcttttcaacaagcgctgaaggaactagaggcagaaggaggaatcgaaactcgatattcacgttatctcgccaataatcatgtgctacgacaaaaaatgacagagatggggttccagcctttcattcaagaatatcaggggccattcatcacctcttttctttaccctaaggactggcgatttgattttaatcatttttatcagtatttaaagcaaaatggatttgtgatctatcccgggaaaatcagcgatcatgaatgttttcgtatcggaaatattggcgagatctatccggaagatattttggaactgacagcaattatcaaagactataaggagaacgttaatgtttaaaactgtaatttttgattgggcaggaacaactgtggactttggctgtatggctcctgtccacgcttttagaaatgcttttctagaaaaaggaatccaactgactgacaaagaaatccgctaaccgatgggaaaattaaaatgggatcatatccaacagcttctttccctcccttctgtcaaaaaacaatggatagctatttatggacaactacctcaggaaaaagaggtggaggaattgtatcaacaatttgaacattatctgtttaaagatttggtcaagcattctaccttgaaacccgacacattggaaacgatcgaacggttgagaaacgctgggatcaatattggttccacgaatggatttaatgctcctatgatgacaatcgtagcagaaaccgcaaaaaaagaaaggtattcaccagacttcatggcaacttttgaagacgtcgaagggtatggtcgaccgtttccttatatgatccataaaaacatgcagtacttcaaaaacaagtcggttgatgaagtaatcaaagtcggagatacggtctcagatatccaggaagggaaaaatgccggagtgttgacagtaggtgtaattgaaggtagttcgctaatggggatttcttatgatgagtaccaaaaattagagatggggaaaaagatcgtttaaaacagtctgttgctcttagattccaacaagccggcgctgatatttgtgtaaacaatttaaaagagttaacagaatacattttgtacgctgacatgaatccagaatgacttttatacaaaataagaggttgtgaaaaagctgtcctgtatcaagtaataaaaacagccaagcaaaaatagctcctcatatttttcgtttggttaggcttattaccgcagatgcaagcttttgaacaccgtttattcgaaaaaaaaagggaagctgtgacacgacttttgtcacagtccccttatttgcaaacaaacagtgtttaagagacaacctctccactaaacggtgttcattcagctgactctcggtatttgctcaaaaaacgataaaatttgaaaagctattttctcttttgtttctctaatactcggatcagaacgctgatttcacattctctttttcttacatcttatctggtgcatgaagtcctagcaaacgaaggtcttctttcaataatacagtcactgcataaactagagctaagcgtgcttctttttgttcatcatcagctaaaatcttcgtatgagcatagtatttgttgaatgcttgtgctaatttgattgcatgtttcgcaatcactgacggttcgtatttttccccagcagacaagaccgtttcagggtatttttgaactaatttaaccacttcccagctggtatcgtcattcaatgcatagtctgctgtttctgaagggacaaatcctgctttttccaacaggctgactgcacgagcatgtgtatattgcacataaggtccagtttctccttcaaatcgaacaacttcttccaggttaaagtcaaatgtattcagtcgatcgtttttcaaatcgtggaaaatgactgccccaaccccaacttgtttagctacagcatctttgttttccaaatcagggtttttctcgctgatttgttctttagcagattggattgcttcatttaatacttcttctaataagacgatctttcctttacgagttgataattttttaccaccttgcgtgatcaaaccaaatggaatatggtgcatgtcgtcagaccagtcaaagcccatttccttcaagacagctttcaactgtttaaaatgatagctttgttcattccctactacatatagagattgtttgaagtcgtaagtacgtttacggtacaatgcagcagctaagtcacgtgtaatgtatagtgtcgcaccgtctgacttcttaatcaacgctggattcaggtcataagcagataggtcaacgatctctgcacctttatcctcgttcagcaaatgtttttcttctaaaagtttgacgatttcatccatcttgtcattgtagaaagcttcaccgttcaacgaatcgaaacgtacttccagcagatcatagattttattgaattctttcatcgattcatcacggaaccattgccataattgaatagcctctttatcgccttcttccagacgtttgaaccaagcacgagcttcttcatttaattctggttctgtttcagctacttcatggaattggacgtataaacgaagcaattcattgattggttctgctttaacagcttcttctgtaccccattttttgtaagcgacgatcagttttccaaactgtgttccccagtcacctaaatggttgatgcggattggctgataaccgattttttccataatgaaaccgatcgaattaccgataactgtcgaacgcaaatgtcccattgagattggtttggcaatattaggagaagacatgtcgattggtactgttccttgattcccgatgttgctatccccataatgttctttttctttcactactgtttgcaaaacttttttgctgataagttctttattcatgaaaaagttcaagtaaggtccgacaacttcgattttttcaaagttggcagaatcgattttttctgctaaatctgcagcgatttgctgtggcgcttttcggtaaacttttgctaatgaaaaggctggaaatgcaacatctccgtgttcagctgattttggattttctagtaattgctcgacttgttccagtgttaaatcatctttgacagcgtcatagacagcttttgcgacaagatctttattattcatctttattcctcctaaagtgttcccttgattgttaaacaaaaaaaatctctagcgacggcatacttagtatgccatcactagagacgagatttcccgcggtaccactccaattgtcctaaaaaaggaccagctccatctgatatcggtagacgaccgtctgtttaaaacagaattctccaagtgcgcttcgttgtatcttcttcattcggcttccaccacttccgaattcgctagccaagaatgatacaagtactctcttgttcaacaaatcttagtcttattaaactttcttgaattatatcagaaaaaaaaacgaaaggctagtcgtttcataaaaaaacaatccagatggcctaaaggagaagaaataccacctggatagctataaatcatttcgtaaatacgaaagacttaacaaattaatcagctacgataatcgttccttcttcagaagctaaaagattctcgatattttctaaagaagtgatgattgccttagcgtttggttttgcttcaacaaatgcaatagctgcttctactttcggaagcatgcttcctggagcgaattgcttttcatcaatgtattgtttcatttctgaaacagtaacagtttctaatttcttttgatctggtttttggtaattgacatacacattgtctactcctgtcaatacgatcagcaaatccgcatcgatgatttcggctaatttttctgaagcaaaatctttatcgattacggcttctcgtccttctaatccagtagctgtttctacaacaggaatcccaccgccaccaacagagactgtgataactccttgatcgaccagcgtttcgatgacacgtgcttctttaatcgagatgggtttaggggaagcgactacttttctccatccacgtccagcatcttctttgaatgtcacagtggagtcagcattcatttgttctttggcttcttcttccgtgtagaatggaccgactggtttacttggatttttgaatgaaggatcattttcatccacaataacttgagtgactaaagaaaccacatctttatcgatccctttttccttcagtacttcgcccatggcgttttgtaaccagtaaccgatagatccttctgtcattgcaacacatgtatctaaaggcattgccggtgttttctcagaatcagcagcttgctgctgaatcaataggttaccgacttgcggaccatttccgtgggagatgatcaattcatctccttgttcgataaatttcactaaatactttgctgtttccattaacgcttcttgttgggcttttgcacttgcatccgtagacaagatggcattgccccctaaagcgacaactacttttcgtttggccatttcattcgtcctttcttcagttctaccgaattttctagataacaaaacgagccagcgttttgtgattttccctcaatgctgactcgttttttcgtgagatgaatgtggttatgcttaaacgcgagggataaacaagttacctaatgttgctgccatgatcgctttgattgagtgcatacgattttctgcttggtcaaattgacgagcatatttgctgcggaagacttcatctgttacttccatttcagtgatgccaaagcgttctttcatttgttcaccgtaaacagtgtttgtatcatggaaagctggcaagcagtgcaagaagatcaaacgatctgtgttgtgtgttttttctaccatttccatattgatttggtaaggtttcaacaatttgatacgttcttcgaatttatcttcttcacccattgatacccatacatcagaataaaggacgtctgctccgtctacacctttatcaacatcgtcggtaatcatcaattgtgcaccggatttttcagcaaagccttctgccattttgacgatttcttcttcaggttgtaattcttttggtgcaacgatacgcatattcgctcctaaaattgcacctgtgactaataaagagttagccatattgtttcgaccatctccgcagtaagcaacagtgataccttctactgttccaaagttttcttggatagttaaaaagtcagcgatcatttgtgttggatgccattcatcagtcaagccattccaaactggaacaccagagaattctgctagttcctctaccattttttgactgaatccacggaattcgattccgtcaaacatacgtcctagtactttagctgtatcttctgtggattcttttttacctaattggatatcatttgcacctagatattcaggatgtgcacctagatcgatcgctgcagtagtaaatgcagaacgagtacgtgtagatgttttttcaaataaaagcgcaatattttttccttctagatagtgatgtgggataccacgttttttcaagtctttcaagtgttctgaaaaatcgatcaaatattgtaattcttcttttgtaaagtctttttctgctaataagcttcttccttggaatactgattctttcatattaaacattctcctttagattgtttttatttaagattaaagaggaaatcccgacggcagctgacagtaagactgccgtcaggaaacaaattacttcaagtcttcacggacaagtggttggctcatgcagcgtggaccaccacgacctcgtgacaattcacttgaattgatttctaacactttgatgccatagctacgaagcaattcgttcgatacataatttcggttataagtgactacaacacctggagcgattgccaatgtgtttgatccatcattccattgttctcgaggtgcaacgatctcatctccattaccagttgggatcagtacaagatcatctaatccaagagcagctttcatcgtttcgtgtaagttatctgaatgagtaatcttgatatcatcaccatctggttcgattgtaaagacatccatcttaccgtctttactttgaattgctggatggatagtgaatttatcgtgatctaccattgtaaatacggtatccaaatgcatcattgcacggttgttcggaattttgattgccaacactttttcaaatcctgaattttttgcgaataggtggcgtgctaatttttctaaagctttcgcattagttcgttgagaaatcccaacagctactactttatcgcttaagatcaattcgtctccgccttcgatatgatctggattttcacgatccaaccatacttcgattcctttatttgcaaatcttggatgatgtttcaaaatatattctgtaaacatcgattcacgacgacgtgcttcaaaagtcatcttattgactgtcatcccatttcccattgatgcggaagggtcgcgtgtaaagtacaagtttggcattgggtccatgtaaaatggatagtcatcgtctgctgacagatcatatagactgctagaacgtacttcgatatcttttgtacgaaccccagccatgattttatctaccatttcttgcgtttccattgatagaaggaactcatgaagaccctctcttacagcattcgatgcaatatgagattcatccaacattttattcaagaattgttctttgacattgcctgcgtcaatcgcttctgccgctaatttttccaagtaaagagtctcgacgccttcattttgcaatgtcttcgcaaagttgtcatgttcttcttgagcaatcggaagatatggaatatcatcgaacaacagacgatccataatatctggtgtcaaattttccacttcttgtccaggccgtttcagtaaaactgtctttaatttccctatttcagagaaaacgtgaataggtttatccatgttgtgttgcctccttctttttgattacatgtataggatatcctccttttgtaatcactttcataattttgtctcattcaaaatgagacattcctcacattaatattcgataattaaataattaaacgtttttctatttttaagcgtaatttattcattttttattctgtatacactttcaaaaaaatatttattcattgaaaaaatttttttgaataaattaaaaaaataaattatattatcgttgttagcgtttactatatgtattattgttgttttttatacacaaatcattcgcttcaaaacaaattattcaataccattgtatattttttacataataacaaattatatttgtaaagtattaaaacttgtttctaatgttggtatgttaaaactttacaaattctttaaaaaaagtgacaataaatatagtgaacaataaggagaggactttttaatgcgtgttaataaaatcgattttcacttttcaaaactcagatatcaacctgattttgaacatttctcggatgaagagttccaacagatcaaggaacatactgttcttcgttcttataaaaaaggacagatccttttcgacgatggtgatcccagacaacggttgtatatcttgaccaaaggactcgttcgtttagaacgttatgatgaaagtgcaacttattactactatgactatgtgaatacaaataacctttttcctatgtcaggaatgtttggagaagagacctacacttatacagctcaagcgatgactgatattgaaacattctaccttcctgtttcctactatgaaaaattagcacgaaaaaatcccgaacagttgatctatatgatacaaaaaatttctaaagtagttgaaatacatgaattgcgtatccaaatcggattgacctctagcgcctttgaccgggtaaaacaaaatttattcattttgaaagaagaattgggcgtaccaacaaaagatggtcatatcaccattccttatccgatcaccttaaaagaattagcagtgaatagcggcacgacacgtgaaactgctggacaagtaatcaaacaactacgtgattccgggctgttagattatgacaaaaagcgttttactttctgtaagacagctactactccagctatgagagaataacgcgaacaaaaataagcagtgaccctgataaatatcagggtcactgcttattttcctccctaaaacttctgaaagatccggcagttttagatcactggacaagactcaaagattttctatgtgtgtttcagttatgtaatattcactgtttgcaaaaaatactgttagattaactagatgaagcgtcttgtcctcatccgatctagattattcgatattcctcgacaataaacgattactcagtgagggcaatcagaggaacggataatgataaataagctgtaaaaaatagcaaaataacaataatgattaaaagtatgtaaaaaatagggctttgacaaaaacgtgtcacagccctatttcgattaaacggtgtgtacctgtcaactcttcggtcacaagtcataatgttcataaacatgaggagctgttttttgaaattgttccttgtgaatcagagttaaacgacaggcttacgaactcttgattaaacggcgttcaaaagcttgcatacgcggtaataagaacagccaggtcaaaaacatgagaagccgtttttcctgggctgttcttattacttgatgcagggcagctttttcacaacctctttattcagataaaaccaagcttggatcagcattcaactgatagctagcaaaatttcttttttgcatttccacatgtgctgctgctccaatcattgcagcattatctccacaaagtcgaagagggggaatcactagttctacctcagggagtttagctgccaaagcatcctgcaatccttcacgcaacccttgattggccgctacacctccagctataatcagttgcttgactggataattttgacaagctcgaagtgttttagtaatcaatacatcgatcacacttgcttgaaagctagctgctaaatcatttttgtctagatcttctccacgctgttgtgcattatgcaccaaattgataaatgcactttttaatccgctaaaactgaaatcataattatcttcatggatcatcgctcgcggaaaatggtaattatcttttccctgatgagctagctgatcgatttcttttccgcttgggtaagaaagacctaatactcttccaactttgtcataagcttctcctgctgcgtcatctcttgtctccccaatgatttcatatgatccatcttcttgcatatagactaattctgtatgtcctccgctaacaagaagtgccatcaatggaaactggaatggtttaaccagacgggctgcatagatatgccctgccatatggtttacaggaataagcggcaattggtgtgcccaagcaaaagccttagctgcagaaataccaatcagcaacgagccgacaagtcctggtccataagtgacagcgactgccgataaatcttctgccgacacaccagcttctaccagtgcatcttccaagcataaggtgatttgttctacgtgatggcggctagctacttcaggtactacgccaccaaaacgtttatgactgtttatttgagaagcaacgatgttagataagatctctgttccatttctaacgaccgctacactcgtttcatcacaacttgattcaatcgccagaatcaattcttcattcatttcatcgtctccgtttttaactttctgctcataatgatcgcatcttccgtcggattgcgataatatgatttccgtttacctaatatacgaaacttttctgattcataaagttttcttgctgcttcattagatagacgtacttctaaaaaaacatgcagcgaatcttttatttgttccgtaatcagtaattgtaacaaatgccgtgcatgcccttttccttgttctgaaactgcaacagcaatatttgtgatctcgacttcatctattactttcgagtatccaataaagccacagatctggttatcttcagctaaaagcagataatcagagtgaggctgttggatgtctgccaaaaactgcattttcgtccaaggtgaaccatgtggataagcattttcgctaatcatccatacgcattctgccaagtacgcttcatcaaaatctttttttctgcaaatcaactaatctcactcattttctaaaagttttatcatatccaacgcatcttcttttgtttcagtgtaatatctttttttgatcgttgttgcttgaaaccccaatttccgataaagtctttgtgcatcttgattactcatacgcacttctaatgacatcgtctcacagcgattcattatagcaaagttctcgatttcgtcaataagcagcgaaccgattcgtttacgctgatatgccggtcgaacggcaatattcgtgatatggcaatctaaaccgaacgctcttgaaccgataaaaccaatcattcttccattatcaaagatacctagatatagatgaggaagcggtgacttcaattctgatataaaggcactttttgtccatggcaattcgccattatagacttctcgttcgacatccagcagctctttgatatcttctgtagtcaattctcttagtacgtaacgacgatcgatttgttcgactgttttttctgtataaatcattttatcttgaaaaaagcttctggcatacgctctaaattttttcaacataactttcgtctccaggtgtgtgcgtctccaaccatttttcttctgcttctactcgttttaaatagcgaggaagaaaagcttgtttctctgcaactggttcaactaaagcacctaattgagccacagttacaccacttggaatatcccatgctggaactgtattaatcatcgcactaggcaatatttcctttatttcagagaagaatttgtgacaatcactcccgacgaaataaatagcttcattcagcttttgtagttgtgtgaacaaatcagaagcagaaatatgtacatcttcaagtacagtttctaatctattttctttccagcggtatgccccagcgtatacattttttcttcgagcatcaaacatgggcacaataatattatccacaccgatgcaattagccgcgatggttttcagactagatactcctactagctctttatctaatgtataagcaatcgtttttgctgtcgttacacctatacgaagccctgtataagaaccgggaccatcagaaaccgcgattcggtcaatgtcttttggacttatttgaagatctgcaaacaattggtcgattgcaggcatcagtgttacactgtggttgcgtttgatatttgtttgtatttgtccaagaatttgttcgtcttctaccacaccgatcgccaaagtttggtttgcagtatctattcctaatgtaatcatatatttgatcctttctgctatgacattctcgccttccattgtagcatacttttttattctgaggatgaaaataccaaaggcaaaactagtacaataatacatgattatctgctggcgggcaaattttgccccttcctgaaacacaaaaaagctgcggtatcactccattttcccacagcttttccatcttttatttcgttgattctcgaataatcaactctgtttccacaataatctttcttgaaaccggtgctttggaattacttaattgaagaatcgtctccactgctagctctcccatccattcggtataaacttttacagtagaaagcgagggcgttacatatttcgctacactgacatcattgaagcccatcacagaaatatcttctggtaccactaaacctttttcttgaatcgctttcagtgcgccaatcgctaatgcatcattagctgcaaaaagcgcatcaggaacatgcggattcgtttttaaatattgcttcactgcttgatatcctgactcgacagaaaaatctgcttcgataattggaccttcgtcgtagcctttttctgccaaaacttgttgaaatgccataattctgggatcttttagccgctgatggtttttcttcgtatattctgttccagcaagcatagcgatatgttgcgctttatgggagacaaagtgttcaatgactttttgaacacttgacttaaagtcgacaactagagagtcgattccttgagaagtgccgtcagaatctaccaaaagcaaggcattttgggatcctttcatttctaataactgagcttcgtcgaattttcctagtgcgatcgttccatctgccggaagatcactaatggaatcccacgtttctttcaataaagtaacgtttgcttcttctgcctttttttcgattcctaggcgaatagataaataataaagatcttcaagctcttccgtatcgtcgtaccactggatcaggcgaagcgtttgcttagtatttgctgcatttttacgatgtttcgtataatttaagcgttctgctgcttcaaaaattttttgctttgtggctaagccaacggaaagatcaggatcatagttgagaactcttgaaacagtagcaggagaaactcctgccaactgcgcaatgtctttaattgttgccatttgtctctcctccttttttacgtttataaaatcgcagtaaatcgttcaaacgctgcctgtcctttttcatctcgcttgaatactccagcgtcttccagtacacgtgcaaaaacctgacctacagatttttgtacgacatcggtgaccgtatctttcgtcaaatcaggatgttctttttttaattgttctgcccacggacgatgatattcagccatctggttttcttctcctaataagaaatgctctacttctactagttctggtttcaaacgaggtggtaaaacagcaagccccattacttcgatcaacccaatgttctcctttttgatatgttggacatctttatgtggatgaaaaatcccatcaggatgttcttctgaaacattgttgtctcgaaggacaaggtccaactcaaagtaattgtcccttcttcgtgcaattggcgtaatcgtatggtgtggtgtaccatctgctgaaaaagctctgatagatactgtttcatccgaatatgctttccatttttccaatactgagttagctgcttcaataagcaagtttttctctgttgattgcaaacggatcacagacatcggccatttcacgactcctgcgatgacttgcggataatcttctagtttgataagtttttctatcggtgcttttgccataggaaattcatgacgtcctgcctgataatgatcatgagaaagaatcgatcctccaacaattggtaagtcagcattcgaaccaacaaagtaatgaggcaagacttcagtaatccgaagcagtctagcaaatgtttcctttgtgattttcatcgggcggtgttgttctgataaaatgatcgaatgttcattgtaataagcataaggggaatattggaatccccagctttcaccgtctagattcattcgaataatccggtgattggtgcgggctggatagttcaagcgacctctatatccttcgttttccatgcaaagcatgcaggtaggatagtctacttttaccgcctcgcgttctgctgcgatttgttttggatctttttctggcttagataaattgattgtgatttccagttcaccatactccgactctgccggaaatttgatgttttttgcgatggctcttgttttgatgtagtcatttttcttacttaaattaaagaaatactcagttgcttcctctgggcttttcgaatagtgctgtgcaaagaatgcattgacgactgaaggtggcggtgtgagaaaatccattaattgcgcttcaaaaatctcttgttctgctggcaattctgaaagaacaccattttctcttgccttagcgacaagctgatccaataagtctacagattcttccttaactggtcttacttcaatgctttctagagcatcttctcctaccatccctaaaagacgattctgtaaatataagcggtccatttccatccatccgccagcttcgatcgcaagtgtggcaaaatcacaaatcgtttgactgattgacatatctcattcccctattcttcataaccatttggatggctgacatgccaatcccatgctgttttgataatcgctttgatatctgtgtattcaggtttccagcccagaatctctctcgctttttcacttgaagcgactaatcggctaggatctccagctcttcttggtgctatttctgctggaatttcttttcctgtcacttctctagctgcttctagcatttccttgactgagtatcctttgctgctgcctaaattgaagaagttgctttcatttccttctttcaagtattccaaagctaaaatatgtgcagcaatcaaatcttctacttgaacataatctctgatacatgttccatctggtgtatcataatcgtctccataaacagccaaggcttttctttgaccaagagctacttgtaaaatgattgggacaagatgcgtttctggtgtatgatcttctccgatagatgcatctgcttttgctccggctacattgaagtagcgcaaagcgacatagcgcatgccatatgcttggtcacaccacttcatcattttttccatcatcaatttactttcaccatacggatttttaggattagctggtgtatcttctgtgattggagactctttcggctctccataagttgctgcagtagaagagaatacgattttattcacgttgaactcgtgcatgacttcaagtaagatttgcataccgtatacgttgttgttgaaatacatcaatggtttttcgacagattctcctactaaagagcttgcagcaaaatggattactccttcaatcggttccttttcaaatacggaacgtagaaattctttatcccggatgtctccttcataaaaatgagcatctggatgtactgcttgtttgtgacctgtgagcaaattatctaccacagctacttgataccccttttgaactagctggtctacagcgtgcgaaccgatataaccggctccgcctagtactaaaattgtcataaaaaacactcctttgattagtaaaattgtgtttgttgattctatataatttaaaaaacgaagtttacttttatggtgaaaacaaacaaagtaaaatttcgtaaattcatatggtaaatttataataaaacatttagtaaacattttcaagggttttttgcaaaggtttacaaacaaacgtaaaactagcctttttttctcttttgttccataatagatataacaaataataaatgaggtggattcaatgaaaaaatttgtatctggaatattagtaggaagtctggcaacagccgctgccgttgctggtttggttgcttctgtgaaaaaaacagtgatcgatccaattgacgaaaaagaagcaatgatcgaagaaaaccgtaaaaaagcaatgcgtaaacgcgtttctcgttaataattatttaaaaatacgcatgaagactttctaaaaaacagataagtcatcatgcgtatttttatttgtcagtcaatataagttgtgctattttatctgcctgtctcagattccatggatctgtataaggtctagctactgctgcagttagccaatccacaccttcaacaggtattccatagcaataaaagtcagactggatttcccctgaagcatcaatcacgcgattcgtacctcgctcaacatctatagcttctgaatgataacttcctgtattatctgaaaatgaaaaagggcgaacaagtttgttttccttcaaattttttatgacaggattacttgaacgagaaaagcttgtttgtggcaatcgagcttcaatcaaatagcgactgctgatttctttatcttgtagagaaataacatagcggttgtgcttttgctgaatatcaaatggcggttcgatcaaatgaaaaatacccgcatctatcagtgctgctaattctttcgtccgaatgattggcggaccgatcgttaaaaagctatttagatgagtaaaccatccccatagtatttctttgtattccttagcagaaaaaacgtgccattcaatagcctgccggattggatcacgccagtcttttaatgcatcaaatgttgaagcaaatgctcctgtgcaattgcctttttccgcttcttttatctgcccttcaataaatattcggctagcttctgaaaagggctcattctgataggcaagaggagtttctaaatacgaccaatcccatctataagggattagtgctggatgctttccgagacactcctctgaagagagggagagaaaatcatgctcaaaatttttctttggaatcggcaagtgatattcttcgatgattttcttgtaataaaacaactcaacgtcttttttcagatagtcaaaaaatgtttcgccagtcaaaaatcccgactgatgccattgctccaggttttcttttgttagtaaccgtggccatgccattgctccgccttgcttttgatttcttcctcgagggtaataagggagcccccttcttgatccactgtatacaatcggttccttgcctgatggatgatagaccagttttcccttttcgttctcgaagcgccctcctcttgatactgtaaacaatccgacataatcaaaaaaacttaagcctagacctcttaaaaagacattttctttaggcggtatcttcgaaagatctacatctgcaggattagaaggaagctgatacagtaaaacatttttctttgcgtagtctacccacactctttcttcttctgtctcatcattttcccagtgaccgcttgctaaaacaagctgatcgatagaatagctttgctgatctgtctgtaaaagataaccatcttttcttttgcttactttttttactaaagaataaacaaactgaatagaagctggaaattcttcttgcaactttgagaaaaaccagcgttgatagagtccgtataaacatcgagtagattgctgatctttttccagacgattgatttcttctataattagttgcttatttttggttaccgtctgttcgatataatctgtagcaggtcctttactccattgaaacaagttgggtccctgtgttaccaatcctccactggacaatgtttcatctgtaaaaagcgtcacttgttgagaaacagaattcattaataactccggtggctgattcaaccgccaaactcgacctccaggaccattgggatcgaaaagaaaaagttcaagagaatgtctgtcctgattattatggagaatcctttctgctacacttaatcctctaggtccggcaccaatgatccctattttcatttgcatgcctccatttcgataaattttttcaataaaacagcatggttctgatgttcattttttgcaccataaacaaaagtaatgactggatgttctttcataagttgactgagtttaaaaatagcttgcttcttttcttcttcgaaaatcaattcttgctggtatttctttgcaaatgaagcaaatcgttctggtacatggtcaaaagttttgcgtgcttcattactaggtgcaatttctttcaaccacagatctaactgcgctttttcttttgaaattcctcgtggccagaatctatccacgagtattctatagccatcctctttttcagcatcaaggtaaacacgttttaatttgatcatagttgtttccttctttctaccttttcgcttagcttatatatgtagataatagcacaaaataaaaaaaatgaacggcacaactatccattgcgccgttcatgtgatcttggtcaaaatctaatgattgattcggtttttaaagctgtcatacaatcatctgttttatacttttttacttttgatttttccagaccatccgtcatatccacccttaagtaaataaatctcttgataacctgctttacgtaatttatttgctgtacggatgctcaaacttttcttttgatcgtaaatatagacaggctggtcttttcgaatagatcctaatgaatctttcaaaacagtgtaagggatgtttcttgcacctaaaatatgcccagcatcaaacacatctttttcgcgaacatcgattacttgtgcttttctcattccttctcgaaattcttcttctgtcaaagtcgttgctgaacgtttggccattactcgtagatagacttcccaaaggatgattgcaagcacaatcaatagcaaaatgatattaattacccataaaaccatgtaatgcctccgtttttttaagcaaatttcaaggctaatgaggcagcaccaatgacaccagcttcattaccaagctctgctaatttgatttttgttgattctcttacttgcgggaaagtaaattctttaaaatatttctctacacggctacgtaaaaattctcctgctgccgatactcctccacctaacacgatacttgacggatttaatgtattccccaagtttccgcaagctaaacctaagtagaagcatacgcgatcaacaaccatcaatgcaaacggatcgtcttcttgagccatttcaaagatatctttacttgttacttcttctccgttgtctagcattgctttcagttttgaatcccctgcgtattcttctgccaagaaacgacctaggcgtaccacacctgtagcgctagatacagtttctaaacatccgcgtttaccgcaagtacattcgaacccttcaggatccacagtgatatgtccgatttctcctccagctccgctcacgccgtgaatcaaatttccgccagcaacgatacctccgccaacacctgttcctagagtaacgaatacaacgtctggatcgttttctccagcacctttccatcgttcacctaaagcagcaacattcgcgtcattatcgatagcgaatttgattcctgttcctgcctcgatcagttttttcacaaattgaacttctgtccagtttaagttatacgcaccaataaccgttccagcttcgctgtccacgcttcctggggtacccatgccgattccgataaagtcttcggctttcatattatataaattcaaacgatgattgattgattcaatgatttcaggaacgatatgcttaccatcatccaaaatattggtatcgatgctccatttttgctgaatctctccttctggtgttaaaattgcaaattttgctgttgttccacctaaatcaatcccaataatcttcttgtccattacaaatttcctttctttcggctttcttcaattcggtgctctctttttaatatgcgccacgctgtcatgtatgtatcatgatcaatcaaacggctatcatacagattacgcaattcgatagtcattaattcaatgtcatagatgcgtgcacccacatagataaagatgccaaattttttgaacagctgctgtacatcatataagctctccatctttaagcacttccttcatattatacaagtaaaccatatttttttaaacccagtaaaatacatattacaaaaagaaatacaaaaactagtgtagaaagaatcctttggtgtatcgaatagcttgtctgttgtttcggtagacccaaaacattccctaacactaatccgccaattagcccaccgacatgtccccaaacatctacagaggtatccagaagaccaaaaacaaatgtcaacacaataaataaaagaaaatgtctgactagctgctggatcgctgggttatgtttaaaatgaaaccctaagataaacaacgcaccgaacaaaccgaatatcgaagtacttgcaccaccagacagaacattcgcttcgttaaaagcaaagcttgctgtatttcccattatcccgctgaacatataaatcaagaaaaaacgccaatggccatagattgcctcgatttgctgccccataaaatacagtatcagtgagttcattacgaaatgcatcagtccaaaatggatgaagattggtgtcactaaacgccaccattcattgaagtgaacaagataaggaccatacattccggcataataagggatctcaagtcgcggaaataattccatcatgaggaagaccgctgtctgtatccctaaaaaagcataggtccataacggtcgtcttaaccatgcacgcaattttatttgctgttgataattcatgaaaacctcccatttcattttagtcaataaacaattgttggatcttctgatcaaagctctccggttgccattgttcattcaattgttcacgaaaaacaaggctacatgtttttttatgaaaattatttaaataccggtcgtaataaccaccgccaaaaccgattcgataaccggctctattgtagataatacctggtacaatgaggagatcgatcatctccggcaaatagagcttctctgattgtggctcaagaacaccaaaactcgaacgtacaagaacggactgttcatccatttcataaaacgccatctgacgtttcggcaaagttttaggtacaactattttcttttgttctttttctgctcgttggataaccggctgtgtatccagttcaaattcattcgataaagtcgtccctatcacttttgctgacttccagtactcgctggcgaatagctgtttatagattcgctgttctttttcctttttcttgccacttttggccagatttttcagcttttcgattcctttccggcgtaatcttactttcaattggtccaaaaactcacccttccttctctcataaaatggtataggaaaaaaagaaaaatagcaatcgaactttcaaataaatgcataaatagaataaaaagaagacctagaaatgattggccttccttttttaatgaatttcaactgttcagcgcgtgtttttgtctgataaaaagtgcatacagaaaatatggcgcaccaaaaagggcaatcaaaattcctgtaggtacttccccacttggtagaatcactctagcaaccatatctgcactaagcagaaaaatggaaccgaacaaaccgctcagaacaaaggtccagttattttctttacgtacgactagcttcgcagcatgaggagctagtagtcctacaaaagataaactacctgtcaccgctacactaccgcttgccaaagcaacagctaacaacaaaaggattttttgacttttagccacgttaaggcctaatccttgcgcgcgttcttgaccaaatgatagcaatacaatcctctgtgcataaagtcctcctagcggaattaagataaccgcccatggaagcaatgcccaaacataaggccagctcgcaccccagattgatcccgctaaccatgcattcacaaatccataattttccttagataattggatcgtgcatagcaatgttaatgcagaaaggccggcattaacggcaataccggacaataagattcgattcatacccaaaaagccatttcgatcataggccgcaagatagacacagcaagcagctaaaacaccacctagaaaggctacaactagcaatagaaacggcagcgaatagtgcgaaaagaaacctaaataaagcatcactaaaaatcctgctccggcattaatgcccaatatactagaatctgccaattcatttcttgttactccttgcaagatataaccagaaacgccaagacaagctcctgctaataaactgatcagtaatcgaggaactcgaaattctctaacaatcagcgccaaagaagatgattctttccctatgaacgtggcaaaaagctgatccaggtaaataaaaggcgtaccaatcattaaactacctatagacaggatgacaagtacaaaaagcaagaaatagaacgtccaatatatttttttcaccgttgttccctccttacttgtatcagtaaaaacggaacgccaatcaatgcaatgactaatccaaaaggtgtttcaaaagggggattgatcatcctcgctgtaaaatccgccaacataaccaatccaccgccaactaaaaaagagacaggtagaacataacgatagtccgttccaaccattccgcgaacaactggcggaaccaacagcccaataaatgaaacaggtccgactaacgaaacggcaatggctgctaacactgcaactagacagaaaacaatcaaccgcgttcgtttaggatgacttccaagagctaatgcatgtgtttcactcaaatgaatcaaagatattgcttttcctaatgaaaaagaaaccaaaacagcaagtatatataaaggaaacaatactgctaattgtttccatgtgatattggcagctccgcctacaaaccaaaaagcaagatcctgctgcagattaaagaattgggtaagtgcttggctgatagcagtaaaaaaagaactaatagctacgccagctaaaatcagctgtaaaggattcatgcccattttcgaaaactgcaaaaaaccaaatacgagcaaagttacagcaaaagaacctgccaatgacattagaaacacagaaaaatcagaagctttaggccaaaaagcaaaactaagggccattgccaacgaagcacccgcgttgattcctagtaagcctgaatctgctaaaggatttcttgtcactccttgcatcaatgcaccgctcaatgcaaaacaactccctacaagaaatgctcccgccacacgaggcaaacgaatatttcgtatgatttggtgactttgttttgatctatcaaaatcaaacaacgcctgccaaaaatctgctttttccacagtcgctgcgccatttgaaagagcaacaaaaaaataatcaaaagaacaaaacagaccaaaagcaggagtctatttttcttcatagtcctcataattgatcctcctgctcttttggcaacaaatcataggttagaaaaactggtttatttgttcttggaagcgtgacaatcgttgcatcaatctcaaatatttttttcatacactcttttgtgatcacttcttcaggtgtaccttctgtgatcaacttaccgtttttcattgctaataaataatctgaaaaacgtgaagcatgattaatgtcatgaatcgacatcaagatcgttgtttgtttcatttgattgatttcagtcaataactgtaggatctctaattggtgtgccggatctaaaaatgttgtcggttcatccaagatcaagatatctgtttcctgagcaagcgccatagcgatccagacacgctgggtttgtccaccagacagcgttgcgatatcccgcatacgaaatccagctagacctgtagcatccaacgcccactcaattgcttcatgatcttgcgtgtccatgccactgaacagtttttgataagggtatcgtccgtaagatactacttcttctactgtcatacctgtagggtgttcactagtttgtgctaataatgcaattttttttgcaagttcttttgaactgtatgtagagatatcagagttattgacaatgatctttcctgatttcacaggtagtatacgggtaaaacttttcaataaagtagattttccacttccatttggcccaatcaaactagtgattttcccttcaggaatcgtaacagacatgttttcaatgatttttttgttttcgtagccggctgcaatgtcagctgctcttaatctcgtcatttcacccatcctttcgctgaaaatcattctcaattatgacgctgtttcaacatttcgtcaagcgctactttcatatctatagccaaatgaagcggttgacagcgttcgaaatatcaggaataataaccaatgagaaagattctcaattatgttaggaggaaagaaatgaaattaaaaacaaaagtattcacattatctagcatattgctgctggctggagtactgagcgcttgctccccctcttcagataaagaaacagctacaactgccaattcgacgacttcatccaatagtactcatacagtcacagatacacttggacataaagtagagattccaaacgcgcccaaacggatcatcggcagttacttagaagactatctgattgcactaggggaaaaacctatcgcccagtggactgttggcagtggttccattcaagattatctgcaagatgatttaaaggatgtcccaacgatttcttatgaccttccttatgagaaagtgttaagctttgagcctgatttgctgttgatttcttcttccgctactgtcgaaggcgggaaatacgaacaatatagcaaaatcgcgccaacttatgttgtaaaaaacggaacagatgtcacatgggaagaacaactaaaagatgtcggcaaagctttggcaaaagaaaaagaggcagaaaaaatcatttccgattatcaaaaatccatcaagaaaactcgagaagaactagcagataaaatcgagaacaagacagctgcagtgttgtgggtgaccaacaactcagcctttatggtcagcaaaaatcggtcaagtggaagaatcgtatacgacgatctggaatttggtgttcctgatctagtggaagaggtctccaaaaaagccacttctgactggtctgctgtttcctctgaaaagctagctgaattagatgctgactacatcatccttgtgaacagtgacaaagatgctgccatgttcaatgaaccaagctggaagaatctaaaagcagtgacagacaatcatgtactgcaattcggacctgaatctagttggctatataacggacctattgccagtcaggaaatggtcaatgatatcaaagaaaaactaaattgattttaactaaaaaagcatcttcacgattagtcgtgagatgctttttttcttattaacaaactagacgcatagattttattcttcttttgaagcaaccctattttttactctttcccatttttgaaaacgatgggcatatagattttcttgatccgttatcccctcatactcctctataagggcgaagtctgaaaaatcaatattcccaatatacgtatcgccttcaaacgtgctatcgatcaatgttcgccagatccgaccagtgtaaggaagaagttcttgaaaaatccgactaccacccgaaacatagatatcttctgagatcgtttgactatacgacaaaagttcatcgatcgaatgcattacttccgcattttctttcgtgcgaaaatttggttgcgttgtcaacacgatgatatggcgataaggaagtgaaagatcccccattccttcataggtctttcttcccatcactaaaattcgatccattgtatgttcgcgaaagaaacgcatatcatttggcaatcgccatggtaacaaaccatttttgccgatcagaccatttttatcttgtgcccacatggaaataaacatattatccgctccttatgattttagatgttttgagataaaaaaagtctcaattctttgaccagcaaggaattgagaactttaaaaacattattttgtttcacggtgcaaagtaactttgcgttcgcgtgggcaatatttttgtttttccaaacgatcaggattgttacgtttgtttttgcttgttagatagttacgttctttacaagaagtacactctaaagtgatgtttacgcgcatgtttttccctcccatttttacaagaatcctctaagatgactctcagacttgattatcttaccatgattttttctagattgctagtgtttttcacgattttgttaagtaaaactacttgacgataaatacaacggttttacttctcaaacaaaatctttttctttttgtataaatacccttacacttgtttatatagattatgttttttaataaagggggatactaatatgccatggaacatgaaggactttcctgcatcaatgaaaaacttagataaattgacaagaaaaaaagcaatcgacatcgcaaatgcattattagatgaagggtaccctgataaccgtgcgatcccaattgccattgatcaagcaaaaaaatggtatgaagatgctagtgaatcagaaaaacgaactttcgaaaaagaaaaaaatccaagcaagacggatgaacacgatacgaatcctcgtgctggaaaactgcttgattcagatgtgatcgtagaatatgaggaagaacaatggatcgtgaaatctaaaggggcaaaaaaggcaagcaaccattttgatacaaaaaaagaagcaatcgaaaaaggaaagcaagtagcacaaaacaaagaatcaactttgttcatttataaaaaagatgggacaaaagaaaaagaaatcgattattgaacatatgtaaaggggttgtgacgaaaatcgtgtcacaacccccttatgttcgaaacaatggtgttcctctgccaactccgaaccataagtcataatatctataaaacgggaagagctgttttttgaaattgtttcttatcactcagtgttaaacggtaggagaaaacctcttttttattgatatttgattttcatcaaacagtcacatagtcgattgcttctgcttgcggaatcgtttcatctacaaagtagactttataccatgtcaagaaactgaagattgtccagatttttctttgctcttctttacgtccttcgtgatggtcatctagcaacttcatgattttttcttgatcaaaaaattcttttgcaaaatctgcttcgaataatgctttgacttgttcgtagccgtgttcttctttcaaccaagctttgattggcacagggaatcctaatttcacacgattcgaccattcttccggaagatgtttgttcgcagcttgtctgaaaatatcttttgtgttgttttgattcaataaaaacttacttggtatttgttgagccaatttcatgacttcgatatccaataaaggtactcggacttccaaagaacttgccatagaaagtttatctgcctttaacaagatatcttttggcatccattgatgaagatcgacatattgcatcttattgacttcatctttgattccttctgttttctcgtaatgaacagtcatgatttcatccacagatggtgctgtttgatattttggtgttaacacttctgatgcttctgattcttcgaacactcgagcatgaccgataaaatattcttttgcaggagcaagtgattcatataaatggatccgtccatggaagtttttcatttttccgattttacgtcctaaattatagcgtgttccttttggtaattttttcaatccttgagcaatcacacggatgaattttgaattcgtatggaatccatacgtttggtatcccgcaaacagttcatccgccccttctccagattggactacccgcacactttgtgaagcaagatttgctaaaaagtacaaaggtacgcaagaaggatttgaatcaggttcatctaagtgatactggatcaaagggaatgctttgaacgacatgtctccgtcgatcactgctgctgtattatctaagtccaatagttcggttagttttctggcttcaatcgcttcattataggttttatcatcaaacccgattgagaaagaatgatctggtttcaatacagaggttacataactggaatcaaccccgctggataagaaagaaccaacttctacatcactgaccgtatgtgcttcaatagaagcttgaacggtttcgtcgattttttcgatccattcttgtcgggaatgcgtttcttttgtttcaaaatctgcatcccaatattgctgaatgtctatttttccatctttatacgtataataatggccttcaggcaaacgatagacatctttgaagaatgtttcgccgtttaatggagaatattggaaagtcatataaggtttcaacgcttctttgttcaattctttgttaaaatcaggatgaggcagaaaacttttgatttctgaaccaaacataaatgttccgttcatttctgcataataatatggtttgatcccaaagtggtctcttgcaccgaataactcattcttttcattatcccaaatagcaaaagcaaacattccgcggatcttttgcaataattctgttccccattcttcgtaaccatgcaaaaggacttctgtatctgcatgtgtttgaaaaacgtggccagctgcaatcaattcttctctcaaaggctggtaattatagatttcgccattaaaaataatgatctttgtccgatcttcattgtaaataggctgagtaccgccctctaagtcaataatacttaatcttctgaatcctaaagcaacatgtttatcgatatattctcctgaactattaggtccacggtgaacgattcgatccatcattgtattaataattgtttttttgttgtccttgtcgttaacaaaacctacaataccgcacatttaactttcacatcctaatataaaattactgtttatttcattcatatgcatcttatcatagaataaatagcggacgaatattttctctcttacaatttcgtcacgtgaaaacaaaagatgaaagtttctgtttttacagaaaataaagtcccaatatctaatttaccatgttttcttttttgaggctaccttattctcttcgtgttaaaaaaatattagtggatgctatttccaaaaaaaccagcaaaaaaagacacgacctaaagatcgtgtctcagactgtagacaaaagctgttccaaactcgtaactcgagcttggaacagctttttatctacttcgtttcgaatttttgaacaaaaaaataaaggctccttgcctttccatagccaggtggctaatttctttaaattcattgcagcaaacactagcatcgtatgcgtcgcgactttttccaagcctcgatacttggtccaacgcatcccatgcttttcttttgcatccgcaaatattcgttcaatcgtttgtttccgttttttgtaaattgatttattcagatctgttaggcgaagatgttccacttcatccatcagatctccccaaacatgtctcgtgatgactcgttgatgatttttacttatggtacattggtttagcagaggacagttcacacattcttttggattggatttgtattctcggtacccttctcgagtaaccgttgaaaaagcgagcatttgatcttgcggacaaatataacaatcaaaatactcgtcatagagaaactcattttttgataatagcccctttttccctttgggccttgaataaggcaaacaaggtcgaaggttcaaatgagtcaaaaagtgaacaaacttaggtgtcttatacccagcatcagcgacaacacaattgatttcaggaaaaagtctcttcgattgtttgacgagctgaaaggcgacttgactgtcataaatatttccaggagtgatgattgtgctaagaataaatccattgtcgtcgcatgaagtatgggcagaataagcaaattgtttttctcgttcgcctttgacgtagtagccgctttccggatcagctttacttatttttctttctttcagcttcacttccttttctaagtccaaagtaaaagggcgttttccagcctctattcgttgacgattgatctcatcttctaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaaatatcctcaaacaccgtcgtttctctaaatcggcgaacataattctttccaaaagttgagaaatgggggattttctcctcgaaggagtagcctaagaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagatatcatccataaaatggactttgtctacagtctgagacacgacctaaagatcgtgtctaattatgactgtatcagaaaatatgataccaaacggatctattcattaattaattgacatagtttatctgttgctcttttatgactggataactgaccaattcatgacgatccaagtcttctttattcatatttacagcagtaatttgactgtcttcatacgtacgataataataaatccctttatcaacgttacagcaagaagaataaatcgtatattcgtattttccttctccagtatcgcatactcctttttgttgctcgactgagcctagtatatgaaaaaattgactgatactttcagattctgaatcacctgatgcagcattcattttagtaaatgtggcttttacaaatcgagaaacagaagagagatctccaggtaagcccaatcctcccatcccacgactataaacattcaagctgatctggtttgaaaaatgattttctggtgttccattgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatgttacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacggtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaatcattcatagggaagtcctcttttctgtgaattggttgtcgttaactttattctacagaagggacttccttttttgtatggattttttcatttacacaaaatattttatactctcgttccatttgatagcgagcgataattgttcagattaaataattgataatcaaatggcggattatttgtcaacacaccgacaggattatcatataaatgaagtccatctttcatactttcaattactatcgatttttctttatcagctaataaccagtgtaaaggtgacaagggtagtttttcactaaaatcgatattgactagattgatagtagccaataattctttagcttcgtctatggttgagcattgccctagtatccatggaataaactcaaatggtgcaacgttatcttttccttcttgtaattctttataatcagcattgccaggaaaattcagtcctgccatactcaaccctttttcatttgtagcctcataatagagtggatagttggataccccagctgctattcctatcattgcataatgtttatctaaattttttacctttctaaaatcgaaacgataatttcttggagtaatagtgaccacttcattataagacatctcataatcaaaattccttccaaaataatggtctttcgttgcataagtgattgcggtacacatcgtttcccctcctaaaacaaatcgtttttacacttttatcttacatctagtattttttttatcaaaaaaaggccaaagaagattgatttactagcatttataaaaaatagtactcagggggaatcaaaaaatattgtaggttaaaagtacaacaataaggggctgtgacaaaagtcttgtcacagccccttattccgaacaaacggtgttcaaaagcttgcatctgcggtaataagcccaatcaaacgaaaaaataggaaaagctatttttgtttggccgttcttattacttgatgcaggacagcttcttcacaacctctaatcgttgatataaggaaggtacaggatttgaacctgcgcgccggtattagccggttcgccggatttcgagtccggtgcattaccactctgccaaccttccgtaagtactatttttaaacttttttcacgaaatgtcaagcctatttctaatagataaataacagaaatcgctttttttagcaaaaaagtccattgacagtttgcagccaacggacttaccgatcaaattcatactgatagaacactatctgattatttcaggattatctaatgctaaaatcgagtcaattgtccgtttgatcagtgcaatgatttgttcttctgttggatgcatgatgtttgatgacatcaatgacgctaagccagtcactgctacccatgtaccagtatgcagagcatcgacatattcatccgataattgattgtatctttcatcttctttaactatttcacggaaataattgtatgaaaaatcatgcattttctttccgtccccatgttcatcaatgtacaatgccatgtaaagactatgatgcttttttgcaaagtagatatagttcaaaccgagatcaatgattttatcaccagtacgttcaatagggaaaacatcttcttttagttgttcaaagatagaatccagcaacgtattttttaaatcttccatgtttttgaattccagataaatcggctgtgtcgaaatccccatctttttagcaatatttctcgcagtaaatcctttaaacccttcctttgcaacaacatcataagcagcttttagaatttgatccttggtatagacttttcttctcattaaaactcccccacttctttactgcagtatatgttgttttattgtaccctatttttagcattttttgcaaacattttactcaaaacgttatattttaaattttttttcagtcttctttaacttttttttgcaaaattaaaaaaatttggttaaattcaatgggttcccttacatttttagttttgacctaaatgatagttgtccaaatctttcatttcaagttatagttaaagaaaatgaaaaagaaggtgtgtaatggaaaacgaaactgacgttatttatattcatcctcaaaaacgaatcgtttcacagaaaagaaagtatttttatcttggttttacaggtgttttttttctttttattggcttgctttctaatactcctactgataattggagtggattgctaactattcttacctcgccaagcaatcttttgacagattattttgctttaggcggtttcggaagcgcattcataaatgtagggattttgaccttactttctgtgcttttagcttatcggcacaaggtgattttaaacggtcccttatttgcttcgattctaacagttaccggtttctctttttttggcaaaaacctttataattctatctcaatcattttaggtgtgtatctatacgctgtatttgtcaataaacctttttctcagtacatcatgatcggactgtttggtagcgcattatcaccggtcgttagttatatcacttttggtatgcgttttcctttactgataggtattttattggggaatttagctggcatagcaattggtctacttcttccgcccttagctgctcaaactttagttttccatcgtggattcacactttataatattggattcacctctgggttgattgcgatgacttttactgctgttttgaggttattcagctattcaatcgtcgaaaatacattggttttcaatgaatatcactttcctctcatttggattatttttggctttttttcgctgacagtcggaattggtttctattataattcctttcggcttttggggattcgagaaattttcgattcatctggaaaattgacaactgatttcattgctaattctggtattggtgctactttgatcaacataggcttagttggtctgatgctgtcttcttatgttttgctggttggcggtcagttaaatggacctgtcatcggtgctattttatctgcggtgggtttcagtgcttttggttgtcatttaaaaaacagttttccgatactagtcggaatatttattgcttctttgtttggaacttttcatgagatcaccagtactggcatgcttgttgcagctgtgtttgggacaggtctcgcgcccataagcggtttttacggcagtttttacggtgtaatagctggtgtactacatattgctcttgtccataacgtcagcactttgcacggaggactaaatctatataacagtggtttttcaactggtttcgttgcaggtatccttgtaccgatactagataactttaccgctgtcagaaaggaaaaaaagacacttggaaaaagaattatcaaaaagaatcatcgatgagcttcttacttatttatattcccatgaaataactgaaatacgtattggagtagaatttgctgaggaagggcttttcatagagatacagggtacggcagaaactcagccagaagatttagatgtacttgctgatttgctgaacaatcctcgggaccctagtatggaaatctactatcaagaactattaggtaatccccgacatgatcgggaagattatcatctgttaggtagtttgattgatgacgtggaaatcatgtatgcccagccgattatcaatattaagatctttcgacgtgcttctcattcctattattaaccctattttctatttataaaagactgaatcaaaaaagcagctcctgaaagttcgattaaaatctactttcaggagctgttcaagcttgacattattgattttccaatccttcatacacttcatctgttacaggttctaaaaactctgaattaccagcagtgatcgccaaatgttcaaaccaactgtcttttgtcgcaccatgccaatgtttaatccctttgtgcgttacgacgacatctccagccattaatcgtcttgctggctttccttcttcctgataccagccttctcctccggtcacaagtaagatttgatagccgtctttatggacatgccagtgattgcgacaacctggttcaaaaattacattacctacaccaacagaaacttcgggatcattcactaacatattcagatagctttgcccggtaaatacttgagcgtaagcttcgtttttttcacctgctggaaaaatcacgccattgtgtatttcttcgtgttttgtcgtcatttacgcctctttcttatcttcgctattttcttctaaatagatttcttttgctaaactaaaagctgaccaagcttttggccatcctacataaaaagctaaatgggtaatgatttctgctatttcttcactagtaatgccattttgcttgccaatcttcagatgagctggcaattgttcaaaatttcctcctgaaattaatgcagatatggtgatgatactacgctgatgagcagataattcttctctggaccatacttgtccaaataaaacatcatcattcaattctgcaaattttggtgcaaaatctcctaattgatctcgtcctgcggtttgtttttctgccatttctcttattctcccttcacgactgttaggtgattcaactatggttctaaggcaactttattttctattgtttcttcgcatttcattttaaatgtagtctttcagcctgtccaatgcttagtttattcagtcgatatgctttttaagcatagttgctaacgctttttttattttacgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatattaaaaaaaacaagttattaaataagtctttagttggatgtttttttgagatcaatcttttatacttatgatgaacttacaaaattgtttgttttctgtcatatcaaaaaatggcgcagttagttgcttttctagtaaagtatagttaacaaagaacctctaaggagttgatgaataatgaatattgctgcctctcgaaaactgataaatttcatatccattatcggattaggcctatcaatcgcgctgacgatttattttattaatttaggtgttttcaaagatttgaatgcgttaagaggattagtaggtgattccatcattttaggaccgattatttttgtcttcatccaaatcctgcaagtagttattccaatcattcctggagggatcagtactgcagctggtgtcctgatatttggcccttatgctggatttatctataactatattggaatctgcattggttcgattatcatttttctgctagggcgtcgttatggaaagccattcatactttccatgattagcgataagacatataacaaatatattggctggctggataatcaaaaccgttttgagaagctgtttgctctagctatttttcttccagttgctcctgacgatgcgttatgtttgatggctggattgacaaacatgtcagtgaaacgatatacactaatcattttgattgctaaaccactgtcgattttcttatatagtatggccttgatttatggaggtcaatatctaagtggtcttcttggataatatttattttgtaaaattagtcattgattgacaatgttaaatctgggaaagggtctgcaaaacacactgcaccctttcctttttcattagatttgcgctacaatgtgaagagcaggtgataggatgaattatttgaaacgtagcttaggtaatgcttgggactttttaaaaggaacacaagcttatttccgtgatgtcttgctgatgcatggctttattttatttatttgtttacccttattgagcagtacgacccgttttattttacaccgaggggcaattgactatttgtcttatgacaatattccttcaattttttctcaacatcctggggttctactctcgttaatcgtagttttgatgacgattttactgttagtttatttcgaatttacttttcttttgatgagtgttttttttattaaaaagaaagaaccaatctctttgaagcaactcttacacttgacgatacttcagctgaagaaagtgagacccattacttttttgtttttccttgcttattttttattgattctaccgatcagcggattaagttttaattctgatctactgtcaaaaataaaaatccccgctttcattatggattttatttttgctaatcgttggatcatcgtcagttcctttttactcgtttatattttccttggctatattgggattcgactgatttttgctttaccggaaatgattctacgagatcgtccttttcgagcagccattcgggaaagctggtcattgaccaaatcgcgtcttttggccatcacgggccaatttattgtgattggcggtacgattttactcctttcttctttaggatatatcgttgttattttggcacaaagtatggttgaacaatttttcccagactatgcattgatcagcgctgtgtttgctatgacgcttttacaagggattttattattcaatatcgtgatgtctaccgtagggattttttatatcattgttgatttcatggatgacgaaggcttcttgcctgagatccctaagtggtttatcccacaagcccccaacttgcgtttctctgcgctgaaaaacactggtttgactctttttgcagtttttttcggtattggcgtctgtctttacaatatggattatctgacttcagctgttcagacaaaaccagtgactgtctctcacagaggtgtgagtacccaaaatggggcgcaaaatactttagaagcacttgaaaaaacaagcagagactatcatcctgattatgtagagatggatgttcaggaaacaaaagatggtcatttcgtagtgatgcatgatgcaaatcttcgtcacttaacaggggtaaatggaacaccacaggatcttacattgaaagaattgacaaatcttacagttactgaaaacggagtgcaagcccctgtttgttcttttgattcttatttggaaaaagcacataagctaaaccaaaaattacttattgagatcaagacctctaaaaaagattcggatgaccttgtcgaacgatttgtccataaataccgcaaagttatcttagagaaccatcatattttgcaaagtttgacgtaccaaaccgtttcagatttaaaagaagcagaaccaaacttttatgtgggctacatcttacctttcaatattgttgggccccctgtgacgcctgctgattttctgacaatggaatatagtacgatcaaccgtaacttcattaattctgcccaccaagacggaaaagaagtatatgtatggacaatcaacgattcagatgctatgagtcgcatgatgttttatggtgtggatggtatcataaccgatgagatgggactactaaatgaaagtgtgaaacaaacagatgaagaaatcacttattcagataaactgctaaattttgttttgggagtcggctaatcaaaaatcgttaatgaaaaaagtctttatacaacaaaaaacgcataacctgccaccgcaggtatatgcgttttttgtttgacgctcataatgtgtgcttaactttctcttgattccttcatcgcacgaacaatagctaaaatagcaggaattgcagagatcactgcaagaataattcccattttccctgaactttttctttttggcatatcttctcgctcccttctgtctttatttatattataagggagttcttgcgaattctcaaaaatactgtttaagaaaccaattcagcaggtgcgctaatatcacagaattttacgagcatgcgatacttgctttcattgataagttgatagtctcgttggtcataactttcaacatacacgacagccgtgttgatatatgtacgttcaatacagccgattagttcatgagatactccgatcggtttgcatatataagatcttcctacttctgcttttaccatttcattccctcttttctttatttttattttgttttttctttattttataataacaaattaccttgtatttgaaaacgtttttatccatttttttattttttattttgagtatctttctgctttttagataactattttttaacacgatcttagacgttgtgacaaaaacgtttgtttatattcctatgttgttcgtgcgtttttttctttatattgctaagttatttataaagaggtgagcatatgatttatattcaagcaatagtatttgtaaccttgatgattgggctacttatcggattaaaagaaaatagctaaaccatttaagaaaaaataaataaggaaaatgataaatgctttttaattgcatcaaaaaacgtacgatgctaaacttggtataagttcgaaagtttaaaggaaactttcaagaactaaattacattacaaaggagatgaattttatgacgtttacaaaaacaaatatgcaataccgcgtagcttttgatacaacttctaaccgttttatggcgattgatgcacaaaacgaaaataacgttgcgtttggtattacaatcgaacaagcagtccgagcattaaacgaatctagataaggagtgaaccattccaaatggcgactgatgagatctcggaaaatcaataaaagacgtttgtaacggtaatccgcgacaaacgtctttttgtattcattacatatatttggaaattgtctctctttatctctagacctaaacaaaaacacaagttctaatatcaaccatctcgttttttatgacaattttgttagctgtttcgatgataatattccgttattatctgtataatatttaatataatcttaattgtcaaattaagttagacagatcatcaatacttacgtaactcaaaaatacttccaaaggtgttcgataatccagtgattttctaggaatattatttcgtttagatgcggcagattgaataaaaaattcatctactgaattgaaatccatagatttcaataaaccatctctacgtaacaatccgttagaattctcgtttaggcctctttgagacggcgttcctggatcagcgaaataaatggcaatatcattgacattactgatctgtttccaatttgaaaattcctttccacaatcaaaagtgatggatttgaataggtttttcggtacagattcaaaccattgatttaattttttttcaatatcaatcgcttgtctaccacacggtttcaatgtgatgataacttttgataatcgttcaactaaggtaattacagcacttttatgtttcagacctacgatagtgtcaccttcaaggtgaccaaactcatttgagaattggctataatccttttcacgttcatgaatagagcggcggaaagtttgttttccacgtctttcttgatgtccattcggtttacgcttgcctttcatcggtaagtcagaagaatcaaatagcccctttttgaacatacgataaatggtacgagcagaacaactaataggaaacgctgcacgaccaacaatcacatcgggtgtccatccttgaacaacctttctttgaatatattctgattgttcctcgggtaaaacaagcggacgtctaccacagtttgatttgtttttcttatactgttgataatattctaaggctgattttccttgcttgaagaacagatatactttatggatcgtttgtcttgaacgattcaagcaatgggcagttttagcaacagattgattcattttgaaataagactctattattacaagttcatccgttgtaagatgggtataggtcatttgtactcactccttataattctttggtcggaactattttgagtgtagcacaaatgacttttttagttgtctagcttaattttacaatcggcgtaataaaaacccgtggtgctagttaattttttcctagaggaaaatgtctaaacatgttggtaaatcaacaaaaaaacgcatatagtagtctcaaaactcccaagaaatgaggactacatatgcgttcatcaaaatatactgaacattatacagatacttttataacattcaaggaaattatgagaactgtttctaacatataccacaattgtgtaccagataagattaaaaaccgaagaaatactgataaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtataataaaaataaaaaaggagatctttcatgaaaaaaattttagggttgatcgttatcatattgattgcttttataggatggaaaggttgggactactatcagtctacttatgtaggtaaagattattatgcggtagtcaaagctccaatgcctgcagaaactgatatcaaagcagataatggggaagtaattggaagaggttttaaatacaacgtagatgcttatgctgaaaacggtgaaaaaagacagttagatttcgatgtcattacttctggtgactctgccaatggttctgcttaccccgaaggaacgatcttgcagttgaaagcaagcgaaaagcggatcatagagaaaaaagtaattaccagcgataaggtaccctcatctgtaaaagaaaaattaggcctatcttaagctaagaatatatcgcaaaaaagcactcgaagtgagtgcttttttgcttactgattctagaaaacaaaaaaacagaattaaccttcgaagtcagcctcactgttcttaaagtcctaaaacaaactaaagagcaaggcaatcaatcgatttctatacaaacaagggactgtgacaaacgtcttgtcacagccccttattctgaataaacgatgcagtatgtttgagtacctaaatgggtaccagttttcattttaaagcgaacatgtttctatcactgattatttaaatctagcgaaaaacccttatcttacaggcgttcgttcaattctttagcaagatcttcaaagcctggtttgcctagaagtgcgaacatgtttttcttgtaagcttctacacctggttggtcgaatgggttgattccattcaagtaacctgaaatacctacagcaatttcaaagaagtacattgtataacccaatgtataagcatccatttctggaattttgactagcaagttaggcacgtcaccgtctgtatgagcaagcaatgttccttcaaatgcttttgtatttacgaagtccacttcttttccttgcaagtagcctagaccgtctaaatcttctgcttgttcaggaattgtgattgatttacgaggtttttcaaccttcacaactgtttcaaaaatattgcgacgtccttcttggatgaattgtcctaaagagtgcaaatcagttgagaagtttgcgcttgaaggatagatgcctttttggtcttttccttcagattcaccatacaattgtttccaccattctgagaagtattgcattcctggttcatagttgatcaacaactcagttactttgcctttacggtaaagaatgttgcgcattgctgcgtattggtaagcttcgttttcttctagtttgtcgcttgagtatgctttgcttgcatcagcggcaccttgcatcaatgcatcgatatctgcaccactaacagcgattggtaacaaaccaacagcagttaatacagagaaacgtccgccgatgtcatcaggaatcacgaaagtttcccaaccttctgcatctgcttctactttaactgcaccttttgctttatctgttgtagcgtagatacgtttgtttgcttcttcttgtccatatttcttaacaagaagctctttgaatacacggaacgcaatcgctggttcagtagttgttccagattttgaaataacgtttactgaaaagtcgcgatcaccgattacttcgatcaagtcagcaatatatgttgagctgattgaatttccggcaaagaagatttgtggtgcttttcttgtgttgctatctaataaattgaagaatgtgtgattcaagaagtcgatcgctgcacgagcgcctaaataagaaccaccgataccgataacaactaatacttcagaatcagattggatttttttagctgcttctttgatacgtgcaaattcttctttgtcatagttcgttggtaaatcgatccagccgcggaagtcgcttcctgcgccagtaccttcccgtaattcgttgtgggctgctgttacttggctttgcatgtaccctaactcttgttcgttgacaaacggtgctacttttgaatagtcaaaatgaatgtgtgccatttgttatcctccttataggtttactctacaggtaatactttacgtttttttttattatttttcaagcaaataaacaaaatgctgacaatatttccaagaaagtttcatttttcaaactaaaccttctgctgccattgctttggcaactttttcaaatccagcaacatttgctccaagaagcagatttttttcgtcgccgtactcggctgctgtttggcgacacgtatggtaaatcgtttccatgatttgatccagctgctcatccacttgctctctttcccaagtcaatcgctggacgttctgactcatttctaaagcagatactgctactcctccagcattagcagcttttcctggacaataccacacgcctgcttcatgaagaacagaaacagcttttactgtacatggcatattagcgccttctgctacgattttgatcccattttctactaagatttcggccaagctttcgtctatttcattttgagtagcacatggcaaagcgatatccgctttttctttcaatgtccaaacagattctccagcatgataaatagcagaaggacgttggtttgcgtattccgtcaaacgttgtctattgatttctttgacttctttcaatagtttcacatctattccttctggatcatagatgtacccgctagaatctgaacatgtaacaactttcccgcctagctcttgcactttttcgattgcataaatggctacattcccgcttccggaaacaaaaactgttttttgattaaatgaatctttttcttcgttcaatagatgtttgacataatacactaatccataaccagtagcttccgtacgtatcttacttccccaaaaatccaaaggtttacctgtcaacacaccagtatcatattttttcaatcgtttatattcgccgaacaaatagccgatttctctagctcctacaccgatatctcccgcaggaacatcaatcgatgggccgatatgttttgacaattccagcatgaaactttgacaaaaacgcatgatctcattatcagattttcctttaggatcgaagtcacttccgccttttcctccaccgattggcagaccggttaaactattcttgaaaatctgttcaaaagccaaaaatttcaagatacttagattgacactaggatggaagcgcaatccacctttataagggccgatagctgagttgtattggatacggtaccctctatttactcgccagtttccttcatcatcttgccaaggcactcgaaattgaataactctttctggttccgttaaaagttctaagatattcttttcgatatattcgggatgagtgtccaaaaaagacataaccgtgggcatgaattcatcgattgcttgtaaaaattcttcttgcccttgatccttttgatgtagcttttcttgaattgcttgaacatattctgttgcgtttgtcatcgttccacgctcctttgcttatcttccctcattttagctcattttctcttttggctcaaaacatttttttctgttttctttcttcagatatgctacactttccttgaggtgagggaatggaaaaactgtatgatgtgatcgtagtcggcgctggaacaagcgggatgatggcagcgatcagtgcagctgaacaaggcgcacgcgtactcttgatcgaaaaaaacaaaaaagcaggaaaaaaactactgatgacaggtggtggtcggtgcaatgttacgaacaatcgtcctgttgatgatttgattgcacatattcctggaaatggaaagtttttatatagtacgtttgcgcaatggaataatttcgatatcatgaacttctttgaatcacaaggcgtacatttaaaagaagaggatcatggacggatgtttcctgtaacaaataaatcaaaaacgattatcgaagcattgctcaatcgtctgaaagaactagatgtgacgcttctattctctactcgagtagagaaattgatccacaaagaacataaaatttacggtatacgcacggaattcgaagagttccatgctcctgccattatcttaacaactggtggacggacttatccatctactggttctactggagatgggtacaagatcgtgaagcgagtgggtcacacggtgacgcctctttatgcgacagagtcccccttgatatcggatgaaccgtatattcaggagaaaacacttcaagggctttctttacaagacatcactttacgcgttttaaataaaaaaggtcgtgtattgactgaacatacgatggatttacttttcacccatttcggtatttctggtccggctgcactgcgttgttcaagttttgtcaataaagaattagagaaaacgggagaaccagtgacactttctctggattgtttccctacacaaaccaaacaagagcttattcatatattgacagaaaaaagtaaagcaaccaaaaagaacttggtcaatgcttggcatggtatattgcctgagcgattgttagttttctttcttgagcggcttgaaatggatcatctgacaggacaacaagcctctcaaaaacaaattcaagattttgttcaactatgcaaagagtttaagctatcaatcaacaaaacttttcctattgagaaatcatttgtaactggcggaggggtttctctaaaggaaatttatcctaaaacattggagagtaaaatcattgatggtctgtattttgcgggagaattactggatgtcaatggttatactggcggctttaatatcacagcggctttcgctacagggcatgtagcaggaatgaatgccgggcaaagagcataatgtataaaaaagaaagaaggagactggacaaacaacatcccggcctccttctttcttttatacgtatgatttattgttttatatctgcaaattgtccgctcgttaatgcacagatatcttgaggtgctaactccatctgtagccctcttctgccagccgagacaatgatttgttcatagctttctgcaatttgatctaaataagtaggaaatagttttttcatacctataggcgagcagccaccacgtatgtatccggtcgttgcttccaaatcttttaaatggagcatttctacttttttattccctgaaacttttgctaatttttttagattcaattcggcttctcccggtatcacagcaacaagaggccccgtcacattgcccacagcaaccagtgttttaaatatacgagattggctttctggaagctgttcagcgaccgatgacgcacttaggtggctttcgtcccactcatattcgtgctctgtatagggaatctttttttgttcgaccatacggattgcattcgtttttactatttttttctttgccaaaaaatatcacctcaaacttgttctacaacggttcatttaataattgaataatttgcttcaatgctttgaccggtaattgtcctggagcagaagtagaatcgctgcttaaggaaccaaatgtcataacggaacccgtcgttccgccaaccagacgagaaattttaccaagatttcccatggacatcgtaataataggcatggagacaaaagcatttgcccgtctagtcaactccatcaaccgcaaaacatctcgttcattattgggagttactgccagttttccgatatcggctccaaaatgttccataacattcaatcggtaaagcaagacagggtctgctggtgtttctttaaaatcatgactactgataattaaaggaatgtttaaagacttgatttcctctatcagtctttttcctagactttctactttgaacaactcgatatcgaccatatctactaatcctgtgtgtatcacatgttcataaaggtcgcgatactgacggatcgatatgtcttgttctccgccttcagctaaggtacgaaacgtaaataataacggcagtccatcaagcatctcatggataagaaccaatgtttctgctacttcatcaaaagaaaaaacttcacgataatgatcgactcgccattcgactaaatcggcccctgcttcacgtgcaagaactgcttcacgtaatacttcctctcggacggccccgataagaggcgcacaaatctttggtctaccgcttcctatattcaatccctttacccgaaccattctgcatcgctccttctaatggttatttttaatttgataaacaaacactttcagataattgccttctaaaaaggtatccgtcgtctggaaatcttttggcagacgatataaagcaagttgttcaaaagaaacatttttggcatggaattcctcttcaatcattgtttggaattgttctatcgagacattcgcagcatttgtagacgcaataagtatcccgtcttctgctaaaatatccagactatccttgaccagttccccataatcttttgctacgcgaaagacttttttcttatttctggcaaaacttggtggatccaatacaatcatgtcatataaaaattgttttcttttggcgtatttgaaatactcgaatacgtccataacaatgattttttgctgatcgacatccaaaccattcacttcaaactgttcctgtgttttttttaaactgcgttttgctagatcgacacttgttgtttcgattgcccctcccattgcggcagcaacagaaaaggcgccggtataactaaacatgttcaaaactgttttcccagaagcgaaaccttctgctaatgatccccgtacttctttttggtctaaaaagatcccagtcattaatccttcatttaaataaacggcaaattttactccgttttcttttacgatcaagggttccggtgcctcttttccgtaaatgaactggctctcaggcagatttactgattcaaatcgaattttctcatagcctcctatgatttccgggtagatttcacgaaaagcttgaatcaataattcacgatgtgcatataacgtttcgttataccaagaaaaaacagcataacctgcataataatcaacaatcagaccgccgatcccgtctccttctccattgaatatacgaaaagcggtagtagaatcatctgaaaaaaagaaagttcttttttcttttgacttcacaaaaaattcttcaaaaaaagattgatcaaatgggatgttctgctggctcaatacccaaccgattcccttattctgctttcctagatatccttttgcgataaattggttttgcgaatcaactaattccacccattgcgtggtttctttttggggatgagcaaggtcttctttttggatcagtggatatccttttttcaatcgattgcttgctcttttttttacttttactttcattccttcacctgctttagctttctcttcccaagtataacaaaaaacataggacttgtcttactgctcattttttcatgaagcttaaagaaaaccttaatgaaacagcataaacttctggtttcaattgacactatattgtcatactagtaaaataaatgagaataagtgagctgtgtaacatggtttcaggacacttctgtgattaagaagtgcagaaaggaagattatcttgaaatgtataaaaacacctgcctttttgaataagaggctcggatttttttctttactagtcgttttactttggttgaaaacgatttttgcctatttagttgatttccatctcggaatcgaaagtggcattcaatactttatcttgtttatcaaccctattgcaactacattgttattacttggaattgctctttatatcagacgccctagagttgcttatatcacgatgatggtcatttattttcttttgacattgcttgttttttcgaatgtcacttattatcgagaattcacggacttcattacgatcaacacgattttaggtgctgggaaagtagcgagtggtctgggagaaagtgccattcgactgtttcgcccatatgatgtgatctattggatcgattttattatcttgactgttctgctgattgcaaaaaaaatcaagttggaccctcgcccgatccgagcaagaatggcttttgcgatctctacattagcagttatgattttctcaggaaatctttttatggcggaagctgatcgtccagaattgctgactcgaacattctctcgtgattatttggtcaaatatcttggcttgaatgctttcatggtttatgacggtgttcaaacttaccagacaaaccaagtgcgggcagaagcaagtcccaatgatatgaaagaagtagaaaattatgtaaaagaacattatgcagcaccaaatgacgatttgttcgggctcgctagaggaaaaaatgtgatttatatccatttagaaagcttccagcaattcctgatcgattataaattgacagatgagaatggtctccagcatgaagttacacctttcatcaatagtctttaccacagcaacagcacgttcagttttgacaactttttccatcaagtaaaagcaggaaaaacaagcgatgcggaaacgctgatggaaaattcattgtttggcttgaatcaaggctccttgttcacacaattaggcggaaaaaatactttccaagctgcacctgatattttaagtcaaacacaaggttacactagtgcggtattccatgggaacgctggtacattctggaatcgaaacgagacatacaagaatttaggatatgattatttctttgattcttcttattatgatgttaatgatgacaattcgttccaatacgggttgcatgataaaccatttttccaacaatccgtacaatacttggaacgtctgcaacaaccattttattcaaaattcattgctgtatctaaccattatccttattcaaaattcaccaatgacgaagcaggattcccgttagccaatacaaatgatgaaacgatcaacggttactttgcgacagccaattatttagataccgccgtacaagaattcttcaattatttgaaagaaagcggcttgtatgataattcagtcatcgtcctttacggtgaccattacggtgtctcgaattcaagaaataaaaatctagctgaattagttggaaaaacaagttctacttggacaaactacgacaatgcacaaatgcagcgtgtcccttatatgatccatatccctggacaaacacagggcggaatcaatcacacttacggcggacaagttgatgccttgcctacattacttcacttactaggtgtagatacaaaaaattatattcagttaggacaagatctattctcgaaagatcatgaacagcttgtttctttccgtgatggtgattttgttacaccaaaatatacttactacggtggtacgatctatagtaacgaaactggtgaagctattactgaacctactgaggaagtacagaatgaaattgattcactgaaagaaaaagttgataaacagttagctgtttctgaccaaatcaataatggtgatcttcttcggttctatacgaatagtggattagacccaattgataccagtgattatgactacaagaatggcttagagaaattaaaagaagctgaaaaatctcttggtgacaagtcaactagtgtctttagtgaacacaacggacaatcaactgttgatctttataaaacgcaaacgtaccaagaacttcacggaacgaccacaagttcttccgaatgataaaataaatttaaaaggagcagcgacaaaattattgtcgctgctcctcttttcgaataaacagtgttcaaaagcttgcatctacggtaatagaatagggcagcttcttcacaacctcttgctttttacaaaatattttctggttttaattcgtgatttcactaaaggaatttcatactttattcatattcattttctatactttttatagaggtgaaaagtatgaaaataatccgctatgctactgctcgattaatttattacaaaaagcagacaatactctattgtttattttcaagcttttctgcttttttattgatagcatgcctgactctttaccatttgcaatcggctttagccaatcaagtccaagatcggctttcatttattggcgcttctgcatctacagagcttcttccggctttagaattagctagccgattttatataaaaggcatattcagtttattttttctatttgccttcctttttatctttttcttttactattcagtcaggcaaaacaagcaggaattgatcaattggcacctgactggtctttctaaaaccaaattattcctttttattttctggcagctgttctttcctctctttctttgttgtatcttggttttattgtggatcgtaagcttccagtcagtttatgaagcgcttcttcaaaggatcaattttcttgtcttaaagactactgaactgccagatatccgtgatatcttgacttcggtaagcggacttacaattccgatggatcaacagactttttttaccatcgatttccaaaatgatctttttttcacagatatacttaagggatttgcccaaactcttattgggctcagtggatgctgtctcattcttagtctattccctttcactttttttatccatcatttgcaaagtaggaggcctggacgtaatgaaacctgaatatttgattcatgctgaacacttgaccgttattttgtgtcctctcgaaaaacagcataaaatattggagcacttgaaaaaagaggttcttgttgcaaaactggataattttgcgatcatccaaaaaaattggccgatgtttccttatctgaatcttaaagaccatgtcctgttggatgtaccggaaaaagaaatcaaacaagatcgtttggcctatcaagaaaaacttgatatctctccttccttgcttaattgtgcggcagctgagttgacgtcttttgaaaaagtaaagctgcaattacttcatgccttgctttccaagcgaaacaatattgttattgaagatacatttgatgaacttagtgtattggagatccaagagctactccacttgctttcttatttagctcatgaagaaaatcaaggtatcttactctttactcatgatgctactattgctcaaagtccttatattgatcgtttagagcccgcgggctaaatcaatcattttatagtaaaaaacaagcggtatagaagatcgattcatgatcttttataccgcttgttttttactcttttttgatttctacgtcaggcaaacgaacagcgaattttgttccttttcctagttcgctttctacttctaattttcctttatgcaagcgtacaagttgctgcacgattggtaaacctaatcctgattcaccatattttgtattttttcttgaaggatctactttataataacgatcccagatacttttcatttgttgttcagacattccaattcccgtatcttcaatcgtgatgatcgtttcaagatagcctttttctaaagtaatcgtgatttggccgttttcagtaaactgtatcgcgttttgaataatattgaccatgatttggacaaatcggtcataatcagcgtaaacatcaatatcatcaacggctttcaatgtcaatgtatctcctgctgcttctgctttagcttctaactgtgcaacaatatttttcaatgtttctgttccattgaattttttaatgaccatactgatttgattcgtacggattttttcataatccaagttttcattcaccaaacggatcagacgctctgtttcatttttcatcaatttaatcgcgttttctcgctgattttcagggattgcattgtattctaacccttccagaagtccgttgattgtcgtaagaggtgttctcatctcgtgagaagcatctgccataaattgtcttcgacgattttcttgttcttcaatttctgcttgagattctttcaatgaattcgtcattttattgaaatcatctgctaactcatcaaattcatctttgtcatgtacggggagctgtacatcaaaattaccattcgtcacttctttcgtcgcattccttaaccgattgatacgcttaacttggaatgctgcaaaagcatagctggcaataactgcaacgatactggaaaaaataaatcctttgaacaggttcagtgtaattggacgaacgctgttatcgatatttcgcgcaggttgactaactacaagtgctccatagaattcatgattcaaattaaatggcacaagtgcgtaagaggtcgcctgtgcttgtcctaaaatatttttattcgatgtgaatttttcttgacgtccattcctcagatttttccattgatcagctgttaaggtaaaattcagtaaagctgtattagtcggataaatgacacgttcgtttttatcgataaatataaagttcacattttgttctgtcagtacttgctctgtcagcagcaatgcattttgaaacgcctgatcttgactaaactgcgggagcgtatcggcataggtttgcgttgtcttttcaactgattcagcatatccaaacagttgctggtaattgttttcttcaatcgtttgttttgtcagttgtgtaaaagaaactccaacgatcaataagatcaacgcgaccattccgcagaaagctaagagttgctgatacaaataacgcattaggcaacaccagaatcatcgaatttgtagccgactccccaaacagtttggatgacttgtggtccgaccttttcgattttttgtcgtaatttcttgatatgggcgtccactgtccgttcatcaccaaagtactgataatcccagactaattcaagcaactgctcccgagagaatacttgacgtggtttttttgctaaagtaaacaatagatcgaactctttaggcgtcagtccttcaattggccggttgtccagatacgcttctcgtgttttcgtattcatcttgaaatgactagtctcgatatcaaaatgatcatctgaaactactgcttcttctcttgcttctgccaactcactacggcgatgcaaagctttcattcgagcaataagcgtcagaggactgaaaggttttgtgacataatcatctgcccccatctctaagccgatcacctgatcgctttcagaatctctagctgtcagcatgataatcggcacagtacttgaaactttgcggatctctcttcctactagcataccgtccagtgtgggcaaattcaggtctagtgtaatcatatcccaatgttgtgggttttctaaaaaggcatcgagcccttcttttccatcatacttgaaagttgcttcccaaccttcatttaagaaaaacatctgcatcatttcagaaacagattgattatcttcaatcattaaaatattcattatcgttccctccagtttccaggtcatatttctgtaatttcttttctgtcataataaaaataggcataattggaaatactagcagaagcatttcaatcagaaaataattcgtatgcccagatgtctttaaataatagccgatcaatgccatcagtaagcccataagaaaaaaccagtttccgcttgtcttttgagccagccgccaatgagcgtctgtttttgcggcaagaggcgaatgatacccataaaaaggcagatttccttttgagggcagaatccgaaaaagactgccaattattaagaataagataccaatactgaaaaaaatcattctttccctcctaaattctcttcttatagtatactctaaattgttgactgaaccaatatgttcaggaattcttcacgaaaggtttgtcttttgttcattctttgttaagataaacttattccaataaaaaaggagttttatttgtgtcaaattatcgtgcaatcactttctttgatcttgatggaacattactagatgcgaaatcaaaaatcacacccgaagtggcaaaagctatgaacgcattaaaagaaaacaatgttctccccgtcatcgctacaggacgtacagaagcagaaatccactctatcatggaagatgcgggcattacttctgcggtcaccatgaatggttctttcattcgagtagacggcgaagaaatctattctcaaacattttcttcagaagaatgtcaaaaaatgtatgatcatgtacagttgaacggtcatgaactttcttactataacgatcagaaaatctggtgtaccggtcatagccaaacaatgatcaatgcttacgacttcattcattcagatgttccggaaattgatcctttaggctttaaagaaaacacagtaaatatgttgctgatcttatctcaatcaggtgacgaatactatcacgaacattttcctgagctaactttttatcggaatggtccttactcgatcgatacagtgaagaaaggaatctcaaaaggggcaggtgtcaaacgtctgcaaaaagaacttcagctggaaaaagttcctacttttggatttggcgatggtccgaatgattttgccttgttggaagcttgcgacaacaaaatcgctatgggcaacgcctatgacggattaaaagaactttctacctttatcacaaagaaaaatacagaaggcggaattgtccacgcattgaagtattttgatctgatttaagatctttttttgaagctacctcttttcttaagaaaatcgcttattttttcttaagaaaggggcagttattatataaataatgggatatgattcgcttttttattgaatttatcccaatatatgctatactaattttgtatgaaaaatacacgtaacccttgttagctaacggggacgttacggattcgacaggcacagtcgagcttgaattgcgtttcgtaggttacgtctacgtaaaaacgttacagttaaatataactgctaaaaacgaaaacaactcttacgctttagctgcctaaaaacagttagcgtagatcctctcggcatcgcccatgtgctcgagtaagggtcctaactttagtgggatacgtttcaactttccgtctgtaagttgaaaaagagaacatcagactagcgatacagaatgcctgtcactcggcaagctgtaaagtgaatccttaaatgagttgactatgaacgtagatttttaagtggcgatgtgtttggacgcgggttcgactcccgccgtctccattgtgagatttcagcagatttcgctagatgcttaaatccttattttataagggtttgagcattttttattttcgcagattttcgttaaatgaatgaaaatggcattcaaaatagcattcaaaaagaacactttttaatatatatgttccatccatattatcaatgatattcctactttacaaaaagaacattagttcgtatactctttttgaggtgaacattatgttgatggaaggaaaaacacaattatggtttaaatttgatccttcgaatagatttgtcaaagatttttataaggtgtgggattcagaagttttctttttagcaatcgaagatagcttattaatcaatctctattactctaataagaactactttaaaattccggcaacaaaaaccagaatgaagaaagatgtgtattttttgtttgatatcgtgactgatgtgccagacgcacggagcgatcatcggcgttatgactatttgaagtatactttcgttgatccagaaaggtataaagattaaagtaggctacctaaaaaaggtagcccggaacggattttatcaccatacttataaaagggatattttttaagttagtattaagattgtgtaatatgatgatatctatattttatagtatcagtgctataaaatcaaaaataagtcactaattgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatgttacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacggtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctccactaattaactaccactccaattataagtctttttcccattattttttacagttatatggtatgctttttaatggcttcaaatataaaagagtttaaagcgtaacacacttatggggaagtggtttttggggaacgctttaaactcttctttattattatctcacaatataacccaaatgtctttccatttaaaaatcaaagtaaaacttttcaaatatacagaagtataactatgtgaaacatcctttcattaatccataaaaggatacataaaaaagccactcatttgagtggcaatgaagaaaagctttagcttgtataatactcttcaaaaaattctaacacagaacgattcaattggctacattaatgtaccctgtaggactcgaacctacgaccggacggttatgagccgtctgctctgaccaactgagctaagggtagtggttgttgccacataaagccataaacaatcaaccagtagaatgcgtggcaacaaacctgttatcgcatatcttggagtgtgactatttatgagtgatagtgaagatatgcgtctccatatatgtatggttgagacagataaacatgtatgaaaaacgttgttaaatcaacgtttttttattttggtcaaggagagaaaagtagagaaatacaaaattttttgcattgattttgcattcaaaaaaacattcaaacatttagaaatccccaatacgtattcaggaaaatctattttaaggtttacaaaaagaacttttgttcgtacactctttttgaggtgaacttttatgctgatggaaggaaaaacacaattatggtttaagcatgttccttcaaataagttttttaattataaactctagagaaattaattcatcctaacataaaataattgttcactcaaaagtttttctagaacaattaaaacagcaggcttcacattcgctatacatttgtaagaagtaataattcctgtactaaaaggcataattgctttaattattttttgacttctcttcaaacacaagaagtagttgtgtaataattgcagaaataaggattccaataatagatataaaatttgacatggaaacgtctataacattaaaagaataaagtgttgaagaaagtaaactgattgaaataacccctccgtaaaaaatagtctgtgaatatacccactttttttcagaagacgtacttcgtttggttctaaaacctatccctgcatttctactcttatcaaaaaaccaaatatttagaagtaataatattgctattattaagataaaattactgtaaaaatccaaaagctatccgagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactgaagaagtaaatgcctttaaatccagagccttaaatgataagtatgtcgctatttttatggacgctacttacattccactaaaacgtcaaactgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaatatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaactttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctcccagctatcctcctagcaactatttaaatacccaaaaaaattacctctagataatatcatacctacgttttcacttataaattttttcataaaaaaagcgtttagaggcataatcgttaatacagatggtaaccaatgtatctggtttgaactgggatatcaccctctccatatatgtattactaagactaatagatactataaaagacttgatagttttgcattgattttgcctaatactgagcataggtgtatgctaaacgatactataaggagtgtgtacataatgaaaagaattctgtttatcagtttatcaaatttattgttacttactgcttgtgggacttctgcatcaaagaacataccttcagatacgcaaatttcgaatagtatcgattcaacaatttctacaaatgagaaaaattctccggtagaaacttccgatataaaagtttctacctctgcaaaaaacagggtaaagaaactgtcagcacgtctcctttatttcaaacaaactctgaattagcttcttcatcttcttcagcaaataatgatgatagtttcgcgtttactcctaactaaatgcaacctttacaaatgctttacgataacaagcctgagctaaatgatcctgatatcagttttgcattttttgaaatgattggatcggatgatctttttaaaactactagtttgtctatccgaaaataggacagttctggcagtataggtttttatcgagtttctccaccaggcctcgttacagagacagattctctaggcgaaccttttgaataaatcaaaaatcatgaacaatcactgccaactaaataaagtgccttcaaaagcttggtcttctcgcttttgaaggcactttatttaaatctttatgaaactaaagtatgttcatatttgttgctatagttatatagatattctgttgtttccaactcataaacgtgagtatattttgccactacttttccgcatttttctaatatttcattgcgatcgacgtcatgatattcgtctacgcagatcacaacacaattttctaatttactgattacttctccaaccactttttgtttcaagccaataggttggcaaatatatttttttcctaaaatgatagtttcgttattcatatttcatccatccttaatgtttttccattatttaaaatgataataccattaaaatatgattatgaaaatcaataacacttgtgattttataaaaaaataaaaaaaccgaaaaacagaaatgcccactgtctttccggctctttttattcttgatttctcttcttttttgtttcaatagacgattttagttattaataaatgaaaaagcatttatattaaaatttgctaataaaagatctacatatttttctagaaatgcttgatcgatttcatcataccctttcgttactccgcaatcgatatctaaaacaccgattaaattaccttcttttaccattggcactacgatttctgattgtgcggctgaatcgcaggaaatgtaatttgcatgggttttgacatcatcaacgatcaatgtttcttgtttttcagctgattctccacaaactccttttcccatcttgatacgtgtgcaagaaactcgcccttggaacggtcctaaaatcaattcattaccatcgaataaataatatcctgcaaagacagtctcaggcaaagtctcattcaacaatgcagatgaatttgctaaatttgctaaccagttatcttctgcttctaataatccttgttgctgtaataataaaatttcgtatgcatcttttttctgtttttctgtccacatgataaaaaccgctcctttttgatctatggagaagattatagctcagtttttttgtaaacgctaggtttcctcctcaaaaaaacgagatacgtcaggttaatcaccttgaacgcatctcgctgtctttttctattctgcttgttggatttctgctgctaaatcagcataatcaatcgtttcgtgaacaaaagtcggatcatcaactggaaaatgctgtacaagggacgagatgcggctaatctcaacttttccttcagccacttcaaaatccattacatgtccgccaaatgtatgtgtatcatcgataaaatgcaagtgaaatcccgctgcagcaactccttggaataattcaggcgtaaagaacccgactaatgttccttggacattgctttgttggaattctggttgagactctgaaatttttgctagtcttctgtaaggtttttcttgcttcggcatgatacggatgtgcatatttttgaataatccagttatcttcactgccaaaaataggttttccccggcttctcttactaatatgtcttttttcaattgttctccatctgcagtttttgagacagaaaaactagtatctggcgtaaaatctgtaattgctgcatagggggtaagttcacttccatctaattgggcaactgagccatctgatcttccttgataagctacgccatctaaaaagatgacttcaccatcaagcccatgcaatgttcccaatcccagagttcctttttctaatatatgagcaatcgtttctgttccatccatcaagccagccatcaaagctcctaatgtcccgtgctggtataagattttttcagtcatgtcgacacttccttaatagaattgatctggtaagattgtttctcccaatttctcattatcacggtaatcaatcggaatatcaataattacgggtccttctgtcgcaaatccttcttctaaagctttttctaattcctctacacttgtagctcggattcctttagcgccaaaagcttctgcatatttcacaaaatcaactggaccaaagtctacacctgacgcccgctgatatttcattttttcttggaactctaccatattgtagtgtccatcattccaaatcaaatgaacgatattcaattttttacgtaccgccgtttctaaatcctgggcagagaataaaaatcccccatcgccggaaactgatacgatttgtgtatttggacgcaccaatgcagcagaaatcgcccatggcaatgcaacaccaagcgtttgcataccattactgaataacaaatgacgaggttcataacttctaaagtggcgtgccatccaaatataatgactacctacatctacggtaacagtcatatcatctgttacttttgactgaagcgtgttaataacttctaaaggatgcaagatacctgcttctccttttgattgaacaatgtcccgctccgttaattctgcttgaagagatgctaaatattcttttgcatcttctgacacttgttgaggctctaatgaacctgtcaataaatcaagagtggctgagatatcaccgatcaattctctttcaggctgcataaaaggatcgatttcagctggcgcttcatcgatcacaatgatccgcgcatctttttccgcattccagtttcttgcttcatattcgattggatcatagccaatagcaataactagatcacttcgtttcaaaagcatatctcctggttggtttctaaataaacccacacgaccaaagaaatgcgcttctaattcacgtgagatcactccagctgcttggaatgtctctacaacaggcaatgctgtctttccaactaattgcctgatggctaacgtttctttttcacttgatcctcgcatacctactaatagtaccggtagttttgcttctctaatgcgttcagctaggtaacggatatcatctgcagaagcagaacctaatttaggatcgctcaatggcttgatgacattcccttggacaggtgcatccactacatcttgcgggatactgataaagctcgcgcctttttttgaactcttagccatacgataagcattggcaatcacttctgaaattgtttctggatcttggatttctgcactgtattttgtgattggctggaacagtgctgcattatccatgctttgatgggtcaacttcaatagatcgcttcgttttacttgtccggcaattgctaaaactgggtcaccttctgctgtcgctgttaccaaacctgtagctaagttactagcaccaggaccacttgttgcgataactactcctggctctcctgtaatacgtccgattgcttgtgccataaatgcagcattttgttcgtgacgagtcacgattaattcaggaccttgatcctctaattcattaaatacaccatcgatttttgcacctggtataccgaatacataatcaacatgatgattaatcaaactttctactacagatttcgaaccttgtttcattttttcgtccattgaacatcgtcctttttatgctttatttttaattattagttagaaataatcacaaataattgatacagtttctaaacctgtttcattcaaaagtatagcacgttttatttcatttgtttagccatatgtttcaaaaaatgaaaaagaatgacagtttttacataaaaactgtcattcttaattgaaagtttcaatttataaagtctacagatccatagttctcatcaatttacgattgttgaagtaaatcaaaccaaatacgatagaaggacctagtagaatacaccattggggctttacgaaaaagaagagaaacaaacttgtcaatagtaaaaaatctagtaaactcacataccattttttcaacgtatagtagaacgctatccgtagaacttgatttggtttcgacgctggatttctcacctgaaaataccagtagttgatgctaaaggaaactgataaacaagcaagtaaaacaaacaacggaatcaaccattttccataagaaaaacgtataaaaaagaaacaatcaaaaatcattatcacactaactatccaagcaaatagccaataaaaaaatccctttagccaaaattggcgaaacgtctttatgaacaaacgtactggtgaaaaacttttttcttttgctaattcttctgtcatacctatcatcacgatgcaacgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatattacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacagtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgaatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctcgatgcaacctggaccaataaaaagtaaagaaaaaataaaggaaaagacattccttccatctatcgacaaaaggaacgcagctgctatatacaagatattgacacaccaaaaacaaaggctacttgccaatgattgatacaaccaataaaagaattccatataaacatttttgtcaaaacgctgctctttcataatcacctcctattccttcattcctgatgaagcgatcccttctacaaaatatttttgcatcgctaaaaatataaaagcaacaggaagaacagaaacaactgaggcagccatgattaatgcgtactctgcatcaaatagcccaataaacattttcaaccctaactggattgttttattttccgtagaagacaaataaatgaatggccccatataatcgttccatgtattaacgaatgtgatgatcgtcaaactggcaatcgccggttttgtaagaggtaaaatgatcttgcgatagattccccactctgataagccatcgatccgcgcactctcacataaagaatctgggatactactgtagtattgcttcaacaagaacacaccaaaagcattgaacgcttgtaatagcaccaacgaccacaacgtatatgttaaacccacttttctcatcataatgaactgcgggatcatataagactgccaagggacagcaatcgtgccgatatatgctaaaaataaaatatcgcgccctttaaaatttagtttagaaaacccgtaagcagcaaaactagaagtaaacaactgaatcaacgtgatcacaacgcttaaaaaagctgtattcttaaaaaatgtcactaaaggaatacgagaccaaataaccagataattctctaaatgccaagttttagggatccattgaatcggaatcgtgaacacttcattatttgctttgaatgaagcagaaaccatccataaaaaaggaatgatcgtcaataaagctaatacaatcagcagaatcatacccaaccattgaataaagggcatgttttttgaacgaatttttgcttttttctttcatttcgaacacctccaaagttataatcttcctttctttgtaatgattacaatccagaacaacggttattatagctgattcatttccgttcttcttatgtttgtaagcgcttatttaacaagttatgtaaatctctttattttttttgatttaaaaatgaaaaaatacaaaagcaagactgtcatacgtctcgcttttgtattgaaatttcttcgattagagatacttattactgttcaaaagcttctttgaaacggtgaatcaattcattgactacaggtgataaaatccgattctttttccagactagcatgcagttcgtttcaatcattgggtcaagcggaacgaatgtcactcgctttgaaagatgacttacagcaccttctatgactaaagcagcacctacctgattctcaattagcgcaaatacattgaaaatcaaattgtacgttcctgtgatcagcaactgctccttttttatgcctaaccagtcagcaaacattcgctgtatttctggacgctttgagatcaaaagaggtacattcgcaaagtcttcttttgttatcacgtctttttttgctaaaacagaattttctaaaatgagcaatccccatttttcctttcttggtaacaaaatcgtttcgtatttctctgtatctactggatctagcaaaatcgctaaatctaacaggcttttttctagtcactccgtgatatcatcacttgttccgctgtggatatgaaattgaacgctgggataatcacggatcaacttttctagtaatagtgccaatgtattcgaattatcagcttccacacagccgatcgtaaatcggccgctgaataattgtttttttctgttctcgaattcttgagtggtttgattcgttaaatctaaaatttcttctgctcggcttttttagaaaataacctgcttctgtcaagatcattttgcggttttcgcgtacaaacagttctgttcctagttcctcttctaactccttcagttgtcggcttaaggttggttgtgtaagatgtagaacttctgcggcttgagagattgttccttcttctgcaattgtccaaaaatattttagtaagcgtaactccatagcgatgctccttgatttttttacttgatacattccattttatttctagataacacacgatcatatttcttgatttttccttgtaaacgttccaaacactcttgcatttcagcaatttctttcgtcaaaagttcactttcttcaatcaaaagcttacgccgctcaaatacagttgcttctccttcgctagataggcgaatatattcaatcaaagactcgatcgataatccggcatttcgcatacagatcgtaaagtcgacccattttaggtcttcttctgtataatcacggattccgccttttgtccgattaactggtggaatcaacccgattcgttcataatagcgcaatgtatcggccgaaatgcccttttcttcactgacttgtttgatattcatctgatcactctttctcttaatttcttgccactttacttatgtattttatttattctacaactttaagtgtactccaagtcaatactcatttctattaaaactaagctggattatctatatcggttgtttgtgtattatttcaaataaaaaagtcttgtttttttattcttttttggatatacttttaacaatttagggaaattttaggaaaaggggtataaaaatgacaacgtatcagcgaaaggtattattatcgacatcggcgggaattgctttagagaatatggatattatgtttttagctttttcattatcttcaatgattacttcttttcatattagtggtacgcaagcgggtttcatttcaacgatcactaatttggggatgctcattggaggtattttttttggcatcatagctgataaatatggacgtgtgaaagtattttctcaaacggtccttctgttttcgattgcttctttattgatgtattttgcttcaaacatctacttggtttatctctttcgctttatcgcaggtgtaggagcgggaggagaatacggggcgtgtatgtccttgatttccgaaagtttttcaaaaaaacaaattggacgagcttcttcggttgctggtattggtgcgcaggtcggtgcggctttggctgcgattttagctgctgtgatcattccaacgtttggttggaagatgttgtatgtcgtaggtgtactgccggtgttgatggtcttgttcattcgtcgcggcttgactgaaccaaaggaattcaaatctgtacaatctgccgaaaagaaaaccaaacttagcagactgtttgaatcaaaacatcttgcttggcaaacatgtggccttagtatcatggtaactgtccaaattgccggctattttgggttaatgaattggctgccttcaattatgcaaaatcgattagggctttcggtttctgggtcttcattgtggatggtcagtactattttaggcatgtctttggggatgatgacttttggcataatcatggataaattggggcctaaactagccttttctttgtttttaatttgttcatccttatctgtctatctacttgtgttagcccatagccagtggagtttggtagcagccgctgtgatagtcggctactttatcaatggcatgtatggtggatatggcgcagtgattagtagtttgtatccaacagaaatccgcgcgacggcgaataatttcattatgaaccttggacgagctgttggtggtttttcttctatcgtcatcggtttcttgatggatcattatagtttaactgccgtaatcttgtttttgagcggtatttacctagtcagtctgctggtcttgacaactcttactggtgttacagcattaagggaaagcttgcagcattgatagttgagtctgtaaatgacaagaaagaggtgtggcaaaagcttgcatctgcggtaataagaccagccaaatcaaaaacatgagacactgtttccgtttggctggtcgtattacttgatgcagggcagctttttcaactgctaatttccttctatctggcggcgactattctttgacgtccgtcatttcaaagtactttactaataacttagcataacgaaaaactgtggatacactcgtatattgagcgtctgcataatcttccaaatttttctcaggatgttgatacatgaattcaatcaaatgataattatatgattttctgtagaaatgaagataaataatgtagattgggaagttctcctgcttttccatagaaaagcgccgattattctcattcttcaaaatgaccttatcaggatatttttggaacaattcttctaaatctgttagataattcaagatagacttacttgataccttcaattcgttttgtagttcttctattgaacaccaacgttctgtttcaagcagtaaatgaatcattttaattttcttttgagaaacttttgttaaaaaagtctgcatattttctcctcctgtatctactttactatactacatacaagaaaaaaaacggatacaaatatcatattgtcacaccgtcaatagtgcataaacctgttattatttctctttttttcctaagtattctattgatatgaatcatttaatcgtttattatataaatgtcaataatctaataataaaataacgtacatattttattattgcatacttaataacagaactatagcaaaaaatcccgtgtatcaacacgggattagattaagtttcctcaatcactattcataacacaattattataacaagtaagtaaacaattgaaaaggacatttattgaaaacggttgttttttacttaaggaggaaatttagcgaaaaaattagttgcattgtttttggtcgcaggaagtttgttgagtgggtgtggtgctactacgtctactactcaaagcacaagttcagatcaggcttccagcagcagtaccacgatctccgaaagtacggcagattcatcgaaagaacaagaacaaattgaaaagaaaaaagaagagaaacaaaaagcggaaaaagctgcactagaaaaaaagtgacagaagcggaatctgctttgtcacaagctgaagcaaatcctacaaaagaaaactatgcaactgcttcagcagctatccaagcgctacctgaaaacaaacaagagttgacaagccgtcttgctgcaattgattccacaatcaaagcaaaagaagcagaagaagaacggaaaaagcaagaagaaattgcacgacaacaagcagaacaagcgcaacaagaagcaatcgcacagcaacaagcagaacaggcgaggcaagaagcaatcgcacagcaacaagcagaacaggcgcgacagcaatcagcagctgaacaggcctctcagcaggcacaagccgcagctcctgagcaaaataatgaacaaactgtctatgtcacaccgaccggttcaaaataccatacacataaatgtggaaatggtacgtatacccctgccactttaagcgaagctcaagctcgtggtttaaccccttgctccaaatgttatggaaactaattcaaaagttatactataataataaaattcttctgaaacataaaaaaatagaagatggcgttccagatagtaaaccaaaaataacagtttacacgtccatttcgtcagcttctctcttttttcatttagtctgttccctctgcttttttggacatcttcattcattctttctcaatcaaatagtacacctctttttcttttcgcagtttatatcttccttttttcaatttcattgaaaactgtttcgaatgtttatgttttacatggattttaagcaggagctcctcatgttgcaagcgatagttcctgccttttaaatcagaaaatctcactagtccgtattcatcagaagctttcacaaatggaactttttctctagtaatatagtgtttgccgttgagcgtttttacagaaaagaccattccttcgattggtcgtccgtttgtgttctttacataaaaagataaaggatagtttcgcttagcgatggccaaagaatctaaataagcgatgagtagccaaactaagccgattgatccaagtagtataccgataaaccaaataaaaaatttccattttttccattgatcaattccttggatcgctttttttgcctcttttgcttgataaggaatacgatgccccgtcacaagcagtcgatgtgtattgaccatataaggagtacaggtaagcaaagtcacgagatctctgcctttttggatacccaaagaatctacttcatcaggtaagaccacttggattttttctacttgatacgccaatgtctttccattgatctggatgaaaaactggtctccttttttcaacttaggcaaatctgtaaataattttgcttctgggagtccacgatgcccagaaagaacggcatgggtgtttttcccgccagtcggataagaactttcttccaataatgacgttcctttttgcaaaaatatttccgttgtctgatcgaatataggtaagctgacattgatttttgggatttcgatgactccaagcatatgttccataaaaaaggcattactaggtaaatcttttaatgcttttgcatcaactgcttggttgaaactgcctatccctggtgatacgttttgctctgccaactgttggtttttctttgtcattttttcctgctgtttttttatttcctctgaattcttattcgatgcttgcttttgataatggatgatcatttgctgggcaagaaaatcattcagtgaatcttctacaaaaggataagaaaagatcccgatcccaacgactaaaatgattgccatgaagatgtccagtattcttattctgcttttattcatcatgtccacctattttctaatatgtatatgaagaggttgtgaaatcagcgccttgacctgagtattagcgaagcaaacggcaaaatagttcctcctattttgccgtttgttgagcgaataccaagagaccgaccacttgtcacaacctttctccccatttgaatcactatcgtttatttatcgtatgatttttgtttccaatagtttaagcttctgtttcttgatggcgttttttgaaatagatcactgctcctccaactaaagcagtacctaccaagatgaatacgatgatccccataccaccagttgaaggcaagattcctttaggttggttatcgatcgttgtttcatcagaagttgttggatcatcatctactgtaaattcagtgtacgcagcttcattcttaggtaatgcgtagccttctggtgcttttgtttcttgaaggcagtatgccccttgtttcagcccttcgattgaaaatttcccttctgaatcagaaatcaatttcacttcttcccagtcagaacctgtgacttcatctgaccaagcatatgggtattctcctgaggcaaggtttgctatttttttcattaatttaacagttggatcttttgctcttagaatagaaaattctgcatcggctaatttttcttgcgtgttcacatcttgtttgatgaagtggaaatcaccgtagttttggacattttctacagtaatcgtgttatccgtagttgtattttcccgattgactacaccgtttggattcccaagattggcttcatctgcgccatggatgataccggttgtttgttgcaattttccgttttttactataaaagtagtttctttttgtggattggttaattgataaccatctggtgcttttgtttcaactaaagtataattgccgtctattaatccattgacactgatggatccttcagtatcagttgtgaatgtcaacgctgactcagcaggatcatagagagcgacaccagtgttttcatcaaaaccggtcacgaattgattctctgaatttttgatctggaattgcgcccctgctaacttatctacccctgaaaagttcccagctttctggattttgatattgctttctttgatgacatttttagcatataggtgaatcgtgtctaaaggtttgtcagggtctagggtaagcttaacacgatatttggcgacgtttcgacaccgggctttggtgtttctacaaagacgtatacagcatctttcccatcagatttacctggaagagtcaggttagctaatccttcaccagaagtcgttacacttgcgaagggtgtagcgtctgctggaactgctgtgtctttacttggatagtacgtagcagtgatgtcatatacgttgaattcaacgccgttcaacggttcgctattcggaaatgtcaattccgttccgttgtttatttgattttctggtgctgaagtgaatttcaatttatgcaaattaaccgtaacattttctggtgtaggtgatacggctgcagaaacctctgcagttcctaggccgagaacgaaaggaagcagcatgatagcagttcctaaaaacgtccatatttttgttttgatgtttttcattttatttccctcctattgtttcctttttgttgttttttataaaaccaagctgtccctgttgaaaggactagcaataaccctaaaattgagaaacctccaagcatctcttcgcttgtttttggaaagcttcctccatttttttcatttgatggaccatttgtctgcatctgaactggcgtttttccattattcgtcggatttgcttttggttcgttgatgatttccaatggtataggatgaagcggatcataactgcctttttcaacttcaaagagaatggttgattgactcaatatatatcctttaggcggtttaatctccactagttcgtaacttccaaaagacaatccatggacagaaaatgttccatctttactggaagtaaaaatcgttgctcttgaatcatctttggctacccaatgatttatcccgttttcttgcgctaagtattggtcattttttttgactagaaattgagcatctgctagtttttgtttcgtttgccgatccactttgacaaattgtttgcctcctgtttggatggcaagatgtgtttctactgtttgattgtcagtcgtcaaacgtacatcgttatcaaatgtcgttttttcactgttttctttcaatgtcatttggtaacggatcgttaatttttttccagcaaacgaactaagatcttttccagaatctgataagacaaaaccatgttttattttttgtgtgtgaaatgtatgaatcttgtctccaccaatcaaaaaatcgatcgtttctggttctagccataactgaggatcagctgtatctttgatcgtataggttcctatctcgttgatgttctcaggaattgttacggtgatgagataagggactttatccccatctgcaaaatctgtctgcttattctctactgtttttgttaatgtgagtgcagcaggtattttttgttcgctctttggatacaagtggatggtcgtcaatttatgattagatgaatctgtcacaggaagcacaacgacaaatggtgctgatttttcttttacttaatctgaagtctttatttccgtaaatcggtaaacagcgtcacgaccttgctcatctttgtccgatgcactaaaagaagcaatgccctcttcctcgtctactgtttttgtcacattttctgccagtattttttcactatcacttttttgtgctagttttctttgtgcgtcttccacactacttccttctgaccgcagcttgtaaaattcatccgagacatcatatatagcgaaagtaacgccgttcaacccttttactccttgaaagttatccgggatatttattccgtcgttttgactgatacttggcatcttatcgctttcgaacattcgattatgcaaagtaaatgtaataggtgattctctagctgacacagtcggagaacctataaaaaagaccagtaggataaaaaagagaacagcaaatatatccacacgtacattttttgtttttttcatcgctgttcacctgcttttttcttacgatggataaaataaaagaagccagaaaaaataaagatcagtcctaaaaagacaaagggcagtagacctatcccacctgtcgaaggaagcaagagagtcggattgatcgtcaacttagcggtatctgttgcgataatcgtataattattgtttacacttccttcgcctaaactaatcgttactatttgtgatccaatatctgtccggctgttaactgttagggtataatccaatgattcgcctaagacaacaccggtaacgtggagatttccaaccgaaatcgagtgactttgggcatcataattaaaggcagcgtcatcgacagtaatcactgcgttagctttatagatggtataagttcctgatgtgttggctatatcagtaaatgacaacttgggatttgctgctttgactttgtctattccgctattcgttagtttaattgtatagctgccagcattaaccatattttttgctgattgtgcatctgctgtgtaatccatactgctaagtgccacttgtactggagtaagcgaactagtgacaccctctgctagcttgacatggattgacgggacacctgcttttccatcatatgtcttactgccactgagctctaccgcaccgctgatttgcttaatcgtatagacatcagatgtctgcacgatagtaaataaatagtttgttctggcagctagtttagctagtccgctttttgtcaattgccaagacgtataggttccaatttcagtaggcgcagttacttcaactcccttttcattcatcgctttgaaatcagttggattccatgtgatttgatcaatactgagatcattgtttaaaagggatgttgattctgttttatcattaaaggcatatttaacgatcggtacaacagaaagaccatcatagtacttactgccatttgcattgattgatactgttgcatttgtcttataatataggatgacttcagaaatctgttttccatttgcgtcctttacgattacatttccatttgtatctaaactagctaaaacactcattgctgattggttctttgtttctatcgctgaaacagctgtaaaggtatatccgttgatagtaggcgtattagtcgtcaggtcttgtgcagcacttccgtaagtaagattcattattttagaaggagcaatcatctgtccaaaatagtcttgatacttaatagtgattggtgtttgtttgcctgtataggtcaccgtatcgacgttactttctagggctgtgaaagaaccgtttgtttgtgcaaaagaatagcccgttactgctgttggagtgataaccactttgtcacccacatggattccagataatgtagtcccgtacgttccgatttttgctgctccaccattgactgtataagaaaaagttcctgtccgattcgcattgacctgaaccgttgctgcttgataggttggaaaatttgaaacatttcccttaccatcaacgatctgcccatttttgatcgagtaccccgtgaatggaatatcatttgctaactgtataccgattgaaaaagtactcatacctcctccggcaggaagccctccccatgttgagggtgtaaaagaataacttttatccgcattgggtgtaactgaatcgatcgtatttccagcggtagccacccccatatagatactttttgggaatgtgatagtagtaccatttactgtggagccaataaacagattatggatatctggacggttatcaataaaagcgattgctttggttacgccttgtaacgcagttttatccgcactcatcgatccgttaaccgcaacaatgactccatctttggcatatatcactgtatatccatctggtatggtatgtccgttgaaattcgcagtggccgcaacagtactaaatgtctggcttctacctgtttctgaataagctttctcccctgctgcttttgctgctgtgatttctttttctgtcggatcaatcagttgagtcgaggatgtggttgaggttgtctcgttgttgctagactgattggtgctttctatggactgtatttcagaatagggtggactatttgtctcctctgtcgtttggttagcaaaatttgacgtttctgtataaacgtttacataaatacttgataagctccctaagaaagtaaaaatcaagatgatcgaaatcataatgggatgtaagtattttcttttagatacagctttgagtctagaaacaaaatgtttttgacatatacgttggattttattttgagttttcttaatcattttcatccctcctctcaataaaaaatcatcaaataatcctttacacgttattctaaatttaatttttattattttattgatgtatagaaagtttggggctttttttctctttttattctaaggttattttagtcttgtcctttaatacaaagattttatttttaaataaaaaatactctttttttacgattattgaaaaaaaaagataaaacttgattaattgaagtattgcttaaatttggaagctatgagggaagaataaaagagttaggacgggattatctactatttttctttgttttaaatatttgttatctttgaacataaaagagaaatgtgtcgactgcagtgttgtgtccctcatcacgaataaacggtgttcaattagctgatcttgtattcacttaaaaaatggtaaagtacgagttgctattccccattttcaattttctaacgctcaggacaaaatactgttttcacaacctcattggaataaaagcatatatattgtttcaagaacgaaatcttgttatctttttaaagggcatctgtccaaaatctaattttaggaggtacgttttggtatttattcgtacaaataaaagagaattatctttattcatgtaacgcatccaattgattttttcatgtacgctcctggaacgattttactgacgattgcttatttaactgcgaatcgctcattagcttttatcatagctatccatattttgaataacgttcttggctttgtattatagatacagatgacaaaaaaagttcaagtatgcggtgtagaaccaatatcgcatacttgaacttttttcaatgagtataaattaaaacttctaattttcaattcccatcatctgatatgcccgaccgtctgaacttcttttgaaaaagccaaatgtgattagataacgtctttgttcgacataatcgccactagaaaatacgttcagcagtatcgaattaacctctgtttctgtataagtcactccatggtcaaagcgtttcaagacttctttcaataggatgtatttcttttttgttgaacttggtacttgttttacttttccatcattcatgaatgtgtctaaaactttcatcttttcttgctccgtataagtataaaccatcttctttctccttttgattctaagaatactccatttatgttagaatattctggattttttattaaagcggttactcttaagaaagatattatcatagtgctcttttttttactactacttataggtagatttattctaatccattattctcccctaccaataattaaagaaaaaactggatcagggtgttcaaattacatgctaagaaaaaagaacccttgaataccaagggttctttctcagtctgataacaatgattaacgacggatttctttgatacttgtgaaaagtcgttaaagtattgatataaaaggatttttattacctctgactacatattgactaatttgttaaaaaatcgtttttcaagaatcctgtaataccagtgctttcaccgtttttttaactctctaaagaactaaaagcaatcagaggttttaccttttcatttgacgttaagtggcgataaattttcgaagttgtttggtcagtatggcctaagcgatctttcaagacttcccagctacagtgttccgctactaagcttgccattgtatgacgagctaaatgagtatgaaatggcttattaattcctgagcgattcacgcaccgtttgacgtgatcatttacatactctcgacgataaggaacaccacgtttactagaatcaagatacacaaacaaatatgtttcttctataataaacctgtaatgttgcctcatctcacccaaagccttaatcaactgttgtagcttttccataactagaggagttactagaactcgtctagcagaactaactgtcttagtagtttcaattcgaaaatccttactcttacctttaactgccgtttgcttatagaacagaatttcatttcttttgaaatctatatctccaggctgtagagcaagcgcctcgctgactcggcagccagtgtaaaatagaacatggaaaagtacagacatcggtaattcctcatgaacaatgccataattcaaaaaagttctcaattcatcgacagtaagaaacttgtcctcaatattatttatggcttcttttaaatcagttaccgttaactgatattttggcattctcacagacttcattggattttcacttatcaaattctttctttgacaatatttaaaaatcatatttagaacttgaataagtgattgtaaactatttttggcatagccaacatttgttccattaacgccacattcctttaaggtaaaaagcaattcttgaaggcactctggtgtcaaatcagacaactttttatcaccaatccatcgaacaataatttttaattgttcctctcgcttatcataggttatttccttttgttcatttaacgaacggtaatattggaaccattgctcacctacaacactaaacttgtcattgcttgcaacaatttttttcttaagcctttgttgtttctccatttccagataagcgagttgcgcctcacgttttgaattaaagccacgtcttgttgttcgatatgcttgaaagtaccatgtgatcctaccagtagaactgatttgcttcttgaatcgatctgttttttccatttattgattcctcctattttgaaggaacccaacaagcagaaaccctttggaaatctttctatctatgtcatcattgtaccgcatcttagaaagaaaatgtaacttataaagatcgaagtagtcgcaatttttctcgatagtcattcgaatcactctttctcatccattctaaaacatcatcacgaaaatagtgtcctcgaatcccgtaccaacagggaggaaactcaccaagttttactaaacggttcagtgtactatcacttatctgaaatagtcgctttaaatcagtatttgttaataccagaggtaaatgactgactgcaagcaatttttccgtgtaatcttccagttttttttgtaaaattgaatagaactctatttccagagaattaacatttgttttaacttccaactccatcacccttctctctcaaaatcaaaacgaccaccacggtaccccttaaaattgtaaaaaaacactccagtactccatcaaaacggactagaaaagaggaatttttaatatgaaacaaggaattgcagacataaaaataattaaagaaattcttgaaaaatctacggctaatgcaatagcattcggaacaggaatcaacttgagtacagtaaaaaaacttaaaagtggagagagagctgaagaaaaattaaatcttgccgatgctattaaaatcacagaatttggcatgaaaaatatgccaaccaaaatcgaaatatggaaatagtagtttttctgatctatcagctgttttgccaaagcacataggaatctcacctccccccagtaatggcgggccgatttggttacggaagtatcattatcgtagtcgcgattctcatattaaaatttgtcgcttaaaagctaaccttgtcatggcgtaactagagaatcaaaatctacatgtactgatagatttgctattcatttgtcaaagagcgctaggctattttcagcctatggaaatcctttattttgacccgataaaaaacttccatagaatgaaaaggaaagggaaaaaatactttaacgagttgtatcaaattcaagtatcttctcaatcaattttgtttccagttgtctacgcatatattcatctacatacataaccattcctttttcttcttcataaactggtttcatggctaaccgtgaaatataattttgatattttgacagaacgatggacatggcaattgaatcaccagaagctgcggctttgattgtcgttagtggtatgaatggtatatatcgtttattttgcttcatatttgacacccaaatactttcctagctcttccaaagccatttgtcgttggtaccaaacactgccgagacttttcccaataatatcgccaatttcacgatcattaagaccgatgaagaaggacataaaaatgatttcttgtctttgactaggtaatgctgcaatcgcatttgccaactcctcattggaaataaagattttcataccaaggacaataaaagtaccactactattcaaatttggttccaaataatagaactctgtacctaaccctttttgttccaatatttccattgatatttgccgttggcgaaatctagcgtacttcttttgaatatttaacgcctcattgcagactactttcttacaaaaactgtcaaacgtatgttgaatgtgggtttcctctgagtcgcccataatattctccccctcaaaaaattcattcaactcgttttacttctatccctttccattattactacaatctaggaggtaagcgccccatagaacagtacctgtacgtcaaataacccgacctatagaatagaatcgggaatgtttggcgtttttagttacgagaaaaatgttgttgtacatccttgttccaaggcaacagttgatctaaagtttctgctgaaagtacgggaagatttggtatcttatcaaatagaaactctagatactttacaggattcaatccgttaagttctgctgttttatatacactcagaatgattcctgaagttcgtgctccttcaagacttgtggaatgcaaccaatttttccgtcctatcaccagctctttgatatttcgctccgcacgattatttgtgagttctaaacgaccatcttcaaaaataggttcaaaaccacttcgtagtttacacgcatattgaacggctgcatccaacttggattttgcaacaggatctatcgttgccatccactcataaaaagcaataaataatggacgcagttcttgttgccgacagcttaatcgcttctcaggagaaaagtctttccatttcttttctaggacaaaccatttatccaattgtttgactgcttgagctgcgggaatatccgtgtttttctttccttttggaattgcttcgaaaaatttccgccgaacatgcgcgaaacaatagacaagtcgtacactttccacggcattatacccgctatagccgtcacagtgtaaataccctgtaaactccttgagaaaagttttcggaacatctccagcacgactttcgtcgtggtgataataaacgatgggatgctgactgtcttttcctgtacaaaactgccagtaataggtatctgttttggcactttcaatcacacgataacttgtttcatccccgtgtagaatctcttcttgattaagatagactcttaatcgttctcctaaagggtctaacgcgttttgcactgctttaatatgccaattggtgatattatctctcgaaatatccaacccatgtgtttgtttccaatagttctcttgccgataggcaggaactttctgaccaaatttcatccggatcgtttccgccactaaactattggaacctaagctattagaaatcaaaggtttaggaacgatcgcttttttaaaagaagaaagtccttctttttcgcagcttttacaacaataggtatgttgataatgggtgagacaatccaacatagcctgatggaaacgaatttcttctcgtacttttgtccgtccgatatctttcatctgtgaaccgcaatgttcacaaaattgttcttccaaaggaaggagatgttctttctctgttataggtaagtgtttgattttgtctgctttcgttcctacaactcgttgatgtccttttactggaataatggtggcagctgcttctggaacacttacagaaatttcttcatcactaaaaagattcaattgcccattcgtttcctcaaagagagtctctttagagcgtccaaataatttgttggttaaataattgaccttttcattcaatagttggatttcagttgtaagattctgaatggtttgttgttgtgcttgattggttttatgggcttcttgaagcaactgaagcaacgtatctgtagtttccaaaatttttcaccaccttgaatcgaactgattttgttacagaataccacaagaaacgcacaagaaataggggttcaacacattttttgtgttaaccccccagcttaaaaaactcctttttttcctggcaaatagctcgaggttgatcgatacttaatccttctaacaaccatcgaacctgttggttcgttaaggttcgaacttcgtctttcgtccgaggccattttaacttgccgttttctatccgcttataacagagaagaaaaccatcaccgtcccaatagagaagtttgaaacggtcttgacggttcccgcaaaataaaaaaacggcatcttcgtaaagctcgagttgatactcttgttgaataagactggcaagaccatcaattccttttcgcaaatctgtttttccgcacacaatataaatatgtttggtttgaagtaaatcataaagcattggacaacagttctttcaaaatagcttgaagaatataattgttaataccgttatagatcaaaacttcagaaccattctctcttttgatgcgcatcgctaacttggcagccgcgggtttacctttttctggtgcactcttttcgtttcctaattggacaggaacaatctcatttaatttatacatagaaaacctccagacttcttgatagctcaagtatatcttgaggtgcatttgttagtaaggtactgttctatggggcgcttactctaggagtgagcatttttcgaaaaatactaaaaatttttcaaaataaaaaaaggcatacagacaataaactgtctatacgcctcacagactctattctatacatctaattttggctgtcctgcaaaaaatatgtgttagcctccatcgaaagatcaaactttggaaaacatcattataactttgcttggtaagagctttgctaaaacatgatatgacttgtatacaaaatgtggagtgtattccaataaataggaaggattacaaaatttgaaaccaaataagtaaaaaatactgtcactttgaattaatttgaaatagtaaattctcattaaactattgaaatgctgataccaaaaaatgaagtacttttcgttcataccaacttagagcacttcgttatctatttatttcttcatttggcttatctctataatctcatgatttggtccgtagaaattaaagtaacggattccattttcccagaacggtaattccataatatttttatctaataattcatatcctaaatcttgaattgaattgaatacctcatctatgtcatccgtatctaatgctagatgatcaatggctcctctacactcagtagttttatcttcccatatttctattatcgttccattcaactcgaaaaagccgactttacttcccacattcatttcttcattaatcagactaaaccctaaggattcataaaagatttttgaagctccaaaatcttttgttggaattccaatatgttgtaaaccatttaatttcacttacatcatcccttcaattgttttaaaatccacattcataatttattgaatagtctagtttatctaccttgattgctccctccgtaacagtcatacttaatgctgttccgactttatcatacattctagtacttaaagcaacattatcaatatataaaacagctatcgtatcatcaacaattaactttagttcatattctttgcctatttccaaaaatagtggtcgttgcagccccttatcaaacatttgaggccaaggatagttcggagtttttccgaaagtaagctgattattaatcaatgaaatacgaaattcgtatccttcttgagtatcactatctacaaataattttaaagcaaactcctttgttaacgatgtaatagtcaaagttgtttcaaatagaaaataatcttcgattttaggaacaattactctttctttttttccaaattctttctctaacttaaaacttgaaaatggagtgatttctttaaaattctcaattattttttcaggcagtttaacaccaagagttttgtctgtcttttgaataatttgatgtggaacaagtgcaccgccccaatcccagttattttgatcgttctccccttcttttgttgccacccagccagttagaaaacggccagtttcattagttccgactgttcttgctgcataataggcttttccgtcgaaagcttcgtctactggtgatttccaatctgaaaataatcctgctccgactcgatatttagtctttttatcttcacaatactctgaaaaaagtaaataccacgttccatcaatttcaaatatatcaggcatttcaatcatgttaaattcattattagcccagtagtctcctttgaaattccaatcttttaaatcttcggattcaaaatagaccaatctccccgtcggctttttcttacttgctggttttctagctcctagtatcaaaacgtattttccatgatcttgatcaaaaattgcaaaaggatcgcgccaatcattcttatcatatccttcttgaggaacaagttttgctgcttcgccatcctttttccaatgaattaaatctttagaacttgcaatcattaacacttctgaagtttttccatccaacttagctttgcgattatgtccagtatacaaagctaaatactcattgattccttggacaatacttccagcgtaaatgtattgatcaatgtcatcgttgccaccacgatgaattacttccccgtattcttcaaatttcacaaaatcagtggttgtaactagtgaccacccaaaaggatcagttaaaggtttaggatttctcgtatctcgttgatgaaatagataaaaagttccatctttataaaaaggcatgcaatccccaaaccaaaaatctttaggcttgtaaaaaattttttgcatttatcactcatcctcttcgttagtatgtctttgcatatctgcaagacacgcaattgtattcatatttcttagattttcgatgatatcatcgcttttttttccttgtaatctcaaattgacagcctcaatcaaaattcctaaattcatgccaccaagaagttgaaacccattttgaaatacttcacttcttttagcaaattcgttgaaaggtgttccaccaatcaagtcagcaaataccataacttcttgattttttacttgagaaactattttttcaatgttttcacggaattcttcaatgcctgcatctccaagtgttaccacatgacaatttaaattatcgccaaaaaacatttttaatgtatctacaaatccaatggcaatatttccatgagatgtaattataaactccatccactcatcctctgttcttaataaataaaatcctttaaaaattcttttgaatctctaggagtttgtatcactgtcacttcaactccatcactaattagttctttaaaagcctctctctcttcttcagtaatatttatcgtcggacggatgcgttctgttccattccttcttgataaatttcctacgtttacacttgttattggtaaaccgttatcaatcaaaaatttaacatcgattggagaaactgcaacaataagaactttttgtccttcatatttaccagaaagaatatttttaactgctacttcccttgtaattattgaagttctaacattaggtggtgcagcgaggcgaactacagctttttttacgtcatcattggctacttcattattaataaccataattctgttagcactcaattgatttgtccattgtgttgctacttgtccatgaatcattcgatcatcaatacgaacatgtataatacctttcattttttcatccatattcaacacctacttcaaaatatttaacgctcttaacgcaatagaaactactaagattaatagaattacataaactggtttaacctttcgtcctaacaaataatacacaattgctactacacatgcaggtaataaaccaggcataacttgatcaaagatttcatttccggtcattgttaagtcgccttgtttaaattcaaagccaacattcacttttacaactgtggcaatgagtgcaccgaccaccattaaccctaaaattgatactgcatcagtaatagactttaattttgtttcaatttgagttagtaggctcgcacccgattctttcccagcaaggtataaaggataagcagtaatccttaataaaattgatgccagtatccacaaaataattccaacaaaactaccttccaatgccatattagctgcaattgctccaaaaatagtccatggaataactacaaatacactatctccaattcccgctaaaggacccattagacctgttttcagagcacttactgcttccaaagacttatttttttcttctttttcaattccaacattcataccaataatgtaaggcgctgtatacggcgtagtgttaaaaaattgtaagtgagctaaaacggattgtttcattccttcaggatcatctttatatgtgtccttgataaaaggaagcatagaatacgcataacccaacccttccattttttcataatttaatgaagttgcaccattgagaatccaccggaaaattacttgtttgtcgatttttgtcagtttcttattcatcttcgtcaaaacctcctgttgcagctggtgctacttgagtattatttgatctatttttatatacgattagtgcgattgcagcgccaagtaacgaaatccctaaaattggtatttggaaataaactgccaaaacgaaaccaactaacaaataggcaaagtaatcttttgtaggtaaatatttaagtagcattcctatcccaacagcaggtaatagtccccctgctacctttaaaccaccggtaacccattcaggaatataattgattgcacttcccactaacgttgggcctaatatcacagttaacaaaacaggaattccagatacaaagcttgtattaattgatgccaaatattgcatccactctaatttttgataatcttctttttgtgcgaatttttctgccttttgttgaaaaaaaatgtttgttgaccactttagaacatctagttgtacaattaacattgctaccggtattgctaaagttattcctatagaagcatcctggttagttgagattgctaaataagtaccgatcaatgctgctgtttgataatccggtactgatgcaccaccaaaactagtaatacctagtgtcattaattgcaaagtcccaccgatataaagtccagtttgaatatctcccataataagtccggtcaagaaacctgcaacgacaggttgggaggttccgattttgggcccttccttatcccagttaatgaaaaatccatacaacacaactaaaaatgtttgccaaaacgccattttgttctctcctttcttcttatacttttatataagcaattactgtgccaactaacattatccaataaagcgggaaaatacagtaaatattaattaaatgagcgtctaaatatactttggacaccctttcatttttttagacgctagtatgctatttagaaaatagtctgctcaaaaattgtatagattaactcatactctcctttgggtatttcaatacagtaaatatctttgatttctgaaaaaaaatcttttgatacatttaaaaaagtatcaaatagttgcgctccctctttcaaatgttcatttgttattccatcaccaatcataattcgttcaatcattccagaaagatgtagaaatagattaattctcagaaaacttgggattttgacatcgtaatatttttcatacaaatatagtactttttctatctcattgaatacttttttggaatctaaaaagcgaagcttagtactagcgccttcaatagtaaagagtttaactaattcatttaagcagaactcacagctatccgagtccatatacttatttaatttttctaaggtttgattcccattaattagattttctaaatttaaacaatcgattccttgaatgtaaaattcagtggttgaaagaacacaaattgtattcttaaaaatcatagtatctttttcctttgctattttctttaatgcgttaaaatcaaaaatcaaaatctccacttgattatcgagataccgttttaaaatatccttaactttttcagaaatcccctcaccagagagacaagatactattacatttttcttttgtgataatcctttataatactgaactttaacttgaaacgaatcaaaatccatctggtaaaaatgactaattggctttttttggcaaacttgaatcccacattcaatcgctaaagctgtagaaacattgtttaaaattaccaaatcacctattacattggattcaattttttcatacatttgttccaatgatcccatatcaactagcagaatgagtccattcgtcgtatctatacttttacaaaaattgttgattaggttaattaagtcactagtctcaccttcaattggcatatcgaaagcctcataaacatatgtattcagcaacttatttgtttcccttgcgatcgcagaagctgttattttaccgtgcataactatcagacaatgggtttctggtattttcacatagaacttctttacaagaaaaagtatccatttcaacaaaagttcttgtttactttcttcgacttctaaactactccaaatctcatttgccaataatttttgtttatcatttttcatacgaaattttctgaacttagacagcaaaaaatttcttgatgtttcttcaattacatcaataaacattataaatagactgatatccgccaagaattcatctaataaacatagacctgtcgaatcaataattggtgatattttattaacaacatagtttcttaatgctataaattcgtcactttctaaataattatactcagaagaacctgcacactctttaagtattctatctcttaattgactcatgctttcttcaattgaaatgtgattttgaaaaagttcaatcaaatcaatttcagaaagtgatttaagaaacattttttttaaatctatactaatttctggatctatccaaaaaccgctgtctagtttgtcccctaaataaattgaagactttctcttatttcctaaataaccttctgcacaaagaagcttgatttcattcctcaattctccaacatttccttcaaatgttttcgataaaagatcagtaaaaagttcaatcgaacaaaatatttttgaatcaatcgtaattgcttcatctttaagaaattcaaataataattgaattttttcagatgtacttctattattgtaatctggcagagtgatttcagctgggatgcgtcttctaaaagttgctaacaaagaggtatttttatcttctgttgtggctaagataaggcgaacatttgcatactcccattgcacactttcaccaagtttacgatacttttgagaatccataagaagaaacaatttctcttggttttctgcacttagattgtgaacctcatctaaaaaaaggtatcctccattagcagaagatagcatccctgcagtatctttttcagccccagtaaaggctccttttttatatccaaataaaactgctgacaatagctctggattatttgcataatctgcacaattcacaacaacaaattttgcgtcattatgaattacttttctatcaagagcatactgatagatcaaacttgctaaaaaactttttccaacgccactgtttccttttattattaatgggaggccattagggggatacattacagtagctttgcatttatctatagtggatttcaaagatatgtctgctccaataaacttagaaaagcagtcttttggcttttgttgattatacttgaacattactggtctaacagaatcattctttagtaattttccatctgaaaataactgattcaaatagtgggaagcgacatttcttttaatacaaaatttcattgcaatatcttgagcagaaaaatcgtaatactttaaattatttttgatatactctaatacttcatctttcatttttttttcacttttaggcgtcccttcaattactaattgaaaaaaagatcgcatcaaccaaacaaatagtcgagacgatcttttttccaaattaagatttttctttaacgtctcttgctaaagctaaacaacctacaataccagaattatctaacaattttggtgtcataatataattgtcaacatcgggaatagcgacatatccgttgatcaactcaataaacttatcttgtactttcttttttaagtgtttttgtttcattactccgccaccaaatataatgacatcaggtgataacatcaatgttgtattatatgcacactgagcaatgtaataagcttctatttcccaagtaacgtcattttcagtcacttcttgtccctttttccctgatcttctttcgattgccggaccagcagctaagccctctaaacagtctccgtggaatggacatgtcccagaaaagttgtctttattgtgtcgttttacaagcatatgtcccatttctggatgactaaaaccttcaatgaagtttccgttttggatagcgccacctcctatgcccgttcctacggtatagtaaacaacacttgaaaggcctctgccatttccagaaacatattcaccatagcaagaggcatttacatcagtcgtccaagcagttggaatattaagttgcttttttaaacttccaataaaatcaaaatcctgccaagcaagttttggcgttgatgtaatgaagccatacgttttagattcacaatgaatatcaataggaccgaacgatcccactccgataccttctaaatcatctttatgatgattaaaaaaatctaaaactaaattcattgtttctttgggtgtagtcgtgggaaagctgactttttcaaatatgttcaaatctttatctccaatggcacaaacaaattttgttccaccagcttcaatagccccaaaaaccatacattttcctcgattctattattaattacttatcattagccaagaacaaacaattcttgtccttgttttacttcttcaagtttcggaatgaaaatttcgtcttggtagtctggaaaaacaacaatgacatctttagtcttgtgattcttttcaaaaactacaaaattaatggtcataagaatatccccagccttaactttttgtccttcttgaactttaatatcaaatccctcaccatttagctcaactgtatctattcctacatgaacaagtatctcaattcctgattttgtttttattcctaaggcatgttttgtaggaaaaatacttgaaacaaaaccatcgattggagatacaatcgtttcgttttttgcatcaattgcaaatccttgtcccatcattccttttgaaaagactggatcacttaatttctccagtttttcaaaaacaccggttgcaggtgctacaacgcttatttcattttttctaaaaaaatttaacatgctctcatctcactttacttgaactggcaatttttttgagtcagttttttctgcaaatttacggtgtttagcttcagggataaacactttatatttatcataagcgagaataaaaatgattggtaaaatgaatgctatgagattaccaaatatataaggaagaactggattagcaatagtcagacctggcaatacagtcaatccttgtccaatggcttttacatcaaaaattttcataaatgctccaccaaaaccagcaccaataaacgagcaaacaaaaggaacgattgaatatttcaaattaacagcaaagatagccggttcagtaatacctaccagtgttggaataaagcttgaaatcgcaatatctctatctttagattttttcttaaagagtaaatacataccaatacaaccgccaccttgggcaataattgaaactgaccaaataggttggatataattgaatccagttgttgcgactaagtttgcctcaataccttgaatagcatgttgtgttcctgttacaactaatggttgtaacgcgcctgcaaaaacaaaagcaccaaaggcacccatcttcatatataggaaatcaatgattccacctaaaacattaccgataaaattccccaatggaccaaacactaaaaatagtgcaaagttggcaagaacaattgtcacagttgggactaaaatgtaagcaagtacttgaggagaatatttatttgtaattttctcaacttttgctaaaaaccaagaagtcaaaattgctggaaaaacacccccttgaaacgcaactgctggaatgcttaatccaaataaatgccaataatcaggctttatagttcccatgacgaaatcattccgattggctagtcctggatgaatcataacaaatcctacaagtaatcctaaaatagggtttccgccaaaacgttttgttgcagaatacataactaaaactggtaaataatcaaatgtggttgcaataatacccagaaatttggataaatcatttaggaatacattgtgatcagcgaatgagccatccattccaaacattccaggagtggtaatcaacgaacgaattcctaaaaccattgctgccccaataaaagctggaatgatcggaataaagatatccgagaaaactttaaaagctcgttgaagtctatttcctgaattattgactccttcgtctttcatttcagaaacggatacttccttagctcctgtcaattcaacgaactctttgtaaaccttttcaattatacctgttccgaaaattacttgtaactgtccactattgaaaagaacaccttttgcaccttctatttcctcaagcatttccatattcgctttgcttttgtctttaagaattaaacgtaaacgagtaatgcagtgtgtagcgcttgagatattctcttttcctccaacgttttccaatacatcttcggcaatttttttgtagtccattcatttatcctcccttttaaatgtgacaggtcatgtttgattttcagacctgccacatgattgacgtttattatttctttatttcatttgaaaacttggtatttattgcagtcattgatccatttgttgctgtaatagtaattgcttgaccaaaacaaccatgtacacgagcgttaagagcgattccatcaatataaagtgtcattatattgtcatcaacaatcacttttagtttataagattggttaggctttaaagatataggtctaataagtcctttatccatatattgaaaccaagggtaacaagggtttttatcaaatgtaagacgcccctcatctaaattgaagcgatattcgtaagattcatctgtctcaaggtttttatataatctcagtgaaaagtcactaagattctcatcaaatgaaattgttgtttctaaattaaacaaagttccactatttttgacaagcgttacttcttctcttgtgtctgctgtttctatctctacatcggcaatatcatgtaaatttatgaatgcattccacacttcgtctatgggttttaccccaagtgaaaaatcctctttttgatagacttcatgaggaaccaaagtacctccccataaataattgtttttatcattttcttgatcttttgttggtacccatccaaataggactcgacgttttccatcataagctgttctacctgcataataagcccgtccatcaaaagcttcatctttaggcttaatccaaggaccttccaaactttgactcattcgatagagtattttatttccatctgagtattctgaatagacaagataccaccagtcaccaatcttgaaaagttctggcatttcaaacatggtatacaatcccggagcccaaaaatcacctttgaattcccaattagttaaatcttttgatgtaaattccactaaacgtccggtttgtagatgtttatcctgaccctttcgcgcccctaaaattagcaaatattcttctttttcatcatcccaaacgacaaatggatctctccagtttcgaatatcatacccttcttgtggttctaactccaatgctgtttctgatttttcccaatgaacaaaatcatcactctcagcatgaagcaacacttgagatgtctttccctgcgctaagaattcacgattataccctgtataaaatgcgtgaacctttccatttgcctcaaatacagaaccagcgtagataaactggtctctctcattgtcatcccctcttaaaagagattccccaaagtcttcaaaatgaacaaaatctttcgtagttgctaaagcccagccaaacggttctccaaaaggaactggatttctagtatcacgttgatgataaataaagaattttccttctttcccgtaaggcataacatctccgacccaaacatccttaggttggtagtaaagttgatgattattgcttttaattaataatttctccattttcttcctccagtgaaaaggtttttatcttcacaactaatatatgtcaacccgtttcatatgtcaacccgtttcataaaaatatttttaaatcgacgaaggaatttttcgccgatttaacttatgctgtatttttttttatgagctttactggaagtgaaagttcatccgtctccttttcgcccttaatcatattcaataatttttttactgctactttagatatttgatctataggctgttgaatagttgataattctggattataaatcaatgtttgttgagctccatcaaatccaatcactttaacctcttttggaactcttttgcccgaacttcctaagttgttaatcgccaaagaagccaataaatcatctcctgcaaaaaccccgtcaatatttggatgagtttccagatatgtcttaattatttcatttttttcattgatttcttttacaaatggtacttctaggactaacggttccagcatgaatttattcaaaacatctttatatgctaaagtcctactattcgcgggtagctttatcttactatctccccgaatacacagtatattctgacagccatgatttacaagtagttgagtagctaattccccacccctgtaattatcacaagatactgtaactgtattttcaccaagacttctatcaatcgctacaataggtagccctggaatatcataatccgcaatatctttattgtgcgttcctactataattccatcaacctgattctttctcaacatcgtcaagtactctttttcttttgttggattgtttaagctattgcacagcaacactttatatcccctgctggaaagctcgaactcgatatcttgaattaactcagcgtgaaatggattagtaattgtaggaaaaatcaaacctacggtatatgtttcgtttttaaaaagtgctctcgccagttcattaggatagtattctaattttttcatggcatcaaaaacttttctttttgtttcctcactcaaatatccacgatcattcaataccctcgacacagtcgtaggagaaacatttgcctctttcgcaacttctctaattccaatttttttcatttttaaacaacaaggttgtagatagaaaatctacctactcgactattcgacattccaagaaccttgactctctcattccccttttcggataagtatttatatatataatatcatttatttttatctggcaatagctgtttaaagatatatgtggaatggcaacactttttttgacaaaaattataaggtattgcgtaagcttgctgctggtgttccgactgcccttgacaacgagcctcctcgaatctgattctctaaggcagaagctcattcaaataattaaggtgcctcgccaccggtatcacatccgagctcattatcaaggattcgctgcgccaatctctgctgtcgaaaactgatcggtgtctcatagcctaacgtgccgtgcagccggatggtattccaccaatggacgtaatcaaatagctctaatcgcaaattagccaatgtctcaaagcggtattgatgaacgaattctactttgacagatttataggtggattctgcaacggcgttatcataggggcagccttttttgcttaaggaacgcgtgatattaaaggcccataaaatttcgtcaatcgtctggttatcgaattcttttccacgatccgtgtgaaaaagttgtacattattcaacgagtacggaatctttgcaaaagcttccttgactaacgtcgcatctttcttctccccgcatgaatagccgatgatttctcgattaaacaaatcaagaatcaggcagatatactgccatttcttcccaacacgaacataggtaaggtcggttacaatcgcttctaatgacttttcctgtaggaaggttccgtctagaatattggcggtcttggcttcgttacaagtagaagaatggaatttgaaatgagccaatgtgtatgttgaacgcaagccacgctgtttcatcatacggccgattctgcgttgactcacttgaagacctagattggccaagcactgcttcagcttcctggtaccataagcttttcgattgcgaataaattcttcttgaacgagttcttccagttctgattcatcttcaactggtttggcttgataataataggtttggcaagagatgtttaacactttacacatcgctgatattgagtatttgtgcttattggtatcaattacttgtcttttcgtcccaatatcagcgccgcttgctttaaaatgtcattctccatttcaagctgtttatttttctttcgtaatgcaattagttctacttgttcagggatcaagttatctttttcctgaaacgagccagtagtttgcgcttgcttgacccacttatcaaaggccgaggtagtcagctcataatctcgaatgatttcagctcggggctttcctgcgagataaagatcgacgacttgttgtttgaattcttttgaataggttctacgttgacgtcttgacataaaaattcctccagtgtgttttcatttattttacacaccttattttttctgtctagtctagtgtagccgattcaaaaatcatttttttcatgtcaatcttcctttcttgtcagacttacttgatattcattgattgtataagatactttttctagaatctgtttaatggttgaaatttggtctggtgagaatgattctaacgcttcatttattgagctataaagctcttcatgtaaataattatgtgattcgtacacctttcgaccatattttgttaacgatacaagtttagttttcttatttccttttttttgagaaatgcttataagattcattttctctaaagtgggaatctgttgggatacagctcctttggtaacgcctaatcgatcagctaattccgtaatactagtttcaggataatttccaatcacatcaatcaaatgaatcatactcgtactgagttttagatcattagttattctgattggtcgtttttgaatatgggtcattaaattatttactttgatgaattcttctataacttgattaaactgaattttatcaaccacataaacacctctttctattccttgtaccaatatagtatagccctaaacaataaaacacaaataatttgtttagggctatactaatttctatttatcaaatttataagaaaaaataaataaaaagctgattatccgctaaaacactggacttatcaatgattacatgtgatttaaaagtagattttaccacttatgatagagccttgatacaataaaataaaacgagaaatgataaaggtctaaacctataattcatttctcgttttttatcacgccgtttgtataattaagcgagacaaataaaaaaaccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaaccaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatatcattaaaaagttagtaaataattgccctctaagttccacggtctgttcattaataactttatatcctcgtttttcaaaaaatggctttgcggtaatggaagcgtgggtagtgattttttgcataccagtttctaaaacatggttttccaattcatctgcaattttagtcgcaataccttttccttgatggctatgtttttgtcacaacttcagtattcctgtaacaatacggatttcagtatacaacaacagcttttgaaaagatacttgcaaaaggattaagatatctatgacctgctatgctcactgatgttgaaaagaatgttttattaggattgaggtaagcaagatagtgaatatgtccggaaagcctgtaaaataaggcttttcggacatatgtgaagttataaaaagatagcgaaaaatctatttagtatcactaatgttgcgaacatatcgtcagaatagtctgacatttatttcttgctaaaaatttcaaaaaagtcaagtgctgacgcagcggatgactattttccagaaaattttagtatgtattcaaaaatcaaacgtgacaacagctattaactacatcctcatccaggtctgtaacgtttgaaccactcttctgcgggctcaaacattaagtaatggaaggtacgtttcaattgaaacagcgtcgctgtcgtattcaactcaatttttatcacataagtgagaagcgttgcgattaaggtgaggatgacttgatttatcgccccttgttcactatgtgaatatagtcgtttaatggtcagattttgttttaagtgtttgaacaacaattcaatctgccaacgggcttgatacatgtcggccacttcgtttggcgatacatcaaagagattggtcaccattcgcaggattttttgtcccttggtaagaaccgttaccaacctaaaacgctctgtcacatggttgacaccgccgacaagaatcacttgttggtcactgattatcgtcccatcacgggttgttgtatctgctacttcaatttgatccaagatggtaatttttgtattagattttgtccgtgtaacgaagaaatagccgtcacgatttagtttgtctaacaacttgtaatcaaagtagccgcgatccaccacatacgttgcttgcgttttatcaacaagaacttcaaggtgattacggtcatgctcactcgcatttgtcatcgtaaaactttcaggatactgattggttttatcaagataacagagattcaaatgtagcttgatgccagactttgttttccgaaacttggcccatggaaaccatgctttgttcaacggaatagtcgttgaatcaatcaattgtagactggttgtttttgagcttggctgctgagcagaaattctggcgactaattgcgtaaaaatttccatcaatacttcttgcttgatttctggcgctctacgagataacgagctgtaacacagggaatcaatgccaagttccttgcagaggcgctgatctaaaaaggcgcgatcaatctcgcgatagcttggcaattcttcataaaccgcatgaagtaacactttaagcgtcgtttggaagtctagttttttactgtagaaatcaaagtcgctaattaagctttgagagttttctgataaaccagaaaaatttattgcagaaaaccatttttgaaatgaggtttttacgttatacttatccatgcgtgagtcctttttattggtcttggataagtcatccgagaatagtataaaggacttttttgcgtttggatagctttgtattaggcttttgatgggttaaaaagtctttgcaacactagtaatttagtatttatgtataaattgaaagatattttaccaccacttagtcttcttaaaagtgatccaacattttgtttgtggcagaatttaactacacactaatgcagccgaaagtacacaactatgcagcagtttgactgcgaactggtttccttccatcataagtttgaatgacttagtgatggaggtacagaaaggttgttaactttggatgatattaaaacaataaaacatttgagaaataatcgtgatcagtcaattgatcagataagaaaagcaatgaatatcaattggcgaacagcgaaaaaatacgccgatagtgatcaactattcattacagatcccactcgaaaaaacaaatccatgatggatgatggttggggagaaatcatcggtagttggctagaagaagacctacgtttacgcagaaaacttcgtagaacggccaaagctatccatgaacaattgaaacctttgggtttccctggctcctatcgaacagtttgtgtatacatttctcaatggaaaaagcagcgttacgacgaaacgaattaccaagctgtcgatcgtcttgatcatccgatcggagaagcacaggtcgattttggaacaatggaagttatgcatgaagatcacatgaaagatatacaacttcttatcatgtcatttccctatagtaatgcgacgtccgcaagtgccatgccagctcaaaaccaagagtgtttcctggaagcattaaaacaactatttaatcaatgcggcggcgttccaaaaacgatcagaatagataacttaactccagcggtgaaaaaaacaaaatcaaaatttgaagaagcacaactaaccgatgaattcttacgtttcaccattcattatggttgtgatgttcaagtctgtaacccacgtagtgggcatgaaaaaggacatgtcgaaaataaagtgggttatgtccgatacaatttcttctcgacttcgccaatcatggactcttttgagtccctaaataagcaacttgaagaacaattaaaagcagatcgaaaaaggacgcattattcaaaacatcaattaatcgaagatttgtggaagaaagaaaataaagcgttacattctcttccacaagaggattacccaatttttaaagaagtggaagctaaactaaatcgttatcacgaaatgaaattggatcaaacggttattcatattcctaaagcatatggctattctcaattgactgttgttttgacttggaataaattcaaagttcttacgcctcatggagaaatattaatgaacgaatatcgcccctatatgaacaaaaaaagattgatcccatggagtgacatcatgaaacaatggagtaataaattgaatgtcgttagttattcgaggtattggaagtacttgcctgcacgccttcaaaattatctagcgattgataataatcacctgaaatacagacggataaaacaattactaagtttattagcgacctacgatatccaacaaattaatgaacaattttacgaattagtcgttcaagaagacgccccctctgactttgatgtgaattggtcaaactatgatgcattaacaaaaacaggaggtgtgcaaaaatgattggacagacgttagaagattattgtaaaaagcttcgattaagccatatcatcacgaacataccaagagcttctttcgaagctccagaacaatttattaccgatttattccgtttagaactggagaccagacagcagatcaaattagaacggatggaaaaattagccaaatttcctgtaccaaaatcgctaaagaactatgaatggcacgaagatatttttctaccatctcatctagataaggagacccttgtctctcttgattttctaaaaaggcaagaaaacattgtttgtgttggctctcctggtacagggaaaacacatctagcgatcgcattagggagaaaagcctgtagtgaaggtgtttcaaccaaatttttccgagttaacaatctcgtagagcaattagagaatgcattaaaaaaacaacagctagccagtttcaagaagcgattcgaaacaacagaattaattattcttgatgaaatggggtacttaccattgacaaaagaaggagctgaacttctcttccaactgatttcagattggtatgagcaaaagagcattattattacctctaatttagaattcagtcaatggaatcgagtgtttatggattctcgattaacagctgctctcgttgatcggctaatccatcacgctcacattatcagcttcaaaggcgaaagtttcagattgaaaaattcattatctaaatcatattgaaggaaaaaactagttgcagcaaaactctgcactttcggctgcatttttttgtaaaaagctattgcacaacacaaacatttgaacgacgtaattccaaatgttggattgcttttagataatcttttatttattcacaattgctaatagtccaattttcatttttgtatagttttaatctatactgaaaaacacttgttgttttggacaactcatcaagatactcaacaccaacaatcacttgaatcgctttacccttttgtttgtaaataggattcactaattccacaaatttcaaattagtattaattggttgcatcgcgtctttttcaacataatgctctagttctttttctgaggctgctggataaagcctgaaaaacgtctctaaaaactcggtgatttcttccgttgtctttgaatcaatttttgaatcactttttacttgtcttactttatgttttgccttttctggcttaccaatcatagtgggtaaactcgttacaatatgattgcctttttcatcttcaaagatcatcagacgatatgcagaagaaattgattgtgtctttttcccttctgtaatcttttgatctaccacaaatgaaacgacaaattcttccgagtgtttttcaacatctagaatttttactgatacaacctcggaactagtgggaatatccgctcgaaccatatcttggctcaaagcgagcccttcttctgtaaggtactgctcaagattagtcattctcttttcaattacctccttgttattcttccatgaaaaatattctttcacaaaatctacagtaaaattttctactccagaggtattcactattttctctttcacgaccactttctcatgagttgtatgctgatcaatggccgtgaagtttttgtagattccaaaagcaaggctacaagacaataaaagccaaagggcaagcaccatttttcgatgcttgcccacggatactactcgttctttcttcttttttggaatcttttccttgttacttcgctcaatttttatcttcattttccattcctcttttctattgtttataccgaccagcaccaataatgtgctgttgccaatagctatcggtaagattggtccaacccaccggatctcctgcatgaaacattctgttctctcctgcataaatgcccacatgagtcacataagtaccggcatcataagttgaatgaaagaaaatcaaatcgcctggtttggcatcttttaagtcaatatgagtcatagcatcatattgatcctgagccacccgagggagtttcaaaccaactttggcataacaccattgagttaaaccactacaatcaaacccagttccgggacttgacccaccaaatacataagccgttccttcatacttgaacgcctcgtcaaaaattccttggactgttttatcatcaaactgtgttgtagttaggtactgcttcactaataagcaataaaacatattgccatagttataccgccacccactattttccttaatcgcgatgggattgggataatcgactttttgaccacccgatttttcttttgaaaaagattcggctaaagcaaaactatgcttctttccgtttttcgcgacataatccaaatacccgtcaccatagttataagcctgaatgatactatcttgatcgcatcctagttctttggaacacttaaccaaagacgaaaaatagagacacacttgtttgatggatgcctcggtacttaatgaattcggtgataaacctgctgattcagaactttgcatgacatcttccattgtacctccagattcgacttgaataatcgccaaaagaatcgaaacatactctgttatatctgattctttggcatacttttccaccattgaacggtgtttcaaaactacttctgagacactactacctccaggagaagttccagaactaccacttccctcaccgtcctcaccaaacaacaaacccacacacatcaagatgcccacaaaagagatggtcaggaaggttaacgaaataatactcaatttttttaagttcatcttttctcacctggctttggttttgggcgagtgttcttttttctttgtacttgttgattggttcgctttggaaaagtgaatctctgtttcacttgttgaaaggaattgttcttgcttagtggctgagtgcttccgtttggaatgacttcttgactagaaagtttccgtttgatttcaggattcgaatgtacttgtacccttggttttaaagacctattttctggtagttcatttttctgtggttttatctccttttttatcggaacattttcccttcctttctcatgacgattccatgcttcgttcaatactttgcgtttttcatccatttttgcgtctcttcgttgtcgttgtttttctcgcaactcccctcgatttgctttttcttcgaaaggccctcgcttaaagtcctctggtacttttttcgtcttttccatgcctttatgaaggctgtatttcaagttagttggtgcatcggttacttgattttttgcttgtttcgctttgtccttcacgatttcttttgtatcgagtacttttccaacttttctaccaactaaatttattcgtgattctttcttcgtgcccactggttgttcttgttttttcagatcagaatttagctcgttaatgcttctcgcggaatggttctttctattggacactctattgatttttgaactacctttcccttttgtagaactggtagctagtttcccaccaactgctgcaccgccaccaaaagcaaaagttcgacccacatttcgattaagctgtcgcaattttcgattcatcaacatttgcggtttccgcatgactcgccttcccattgactgactatcattactttgaaggttaaacatgctcataatgtcacctaatttgaaatagataccggcaaaggtcacaatttgtagaaaagctaccataaagaagggataggtggccgaaatattgaaaaacatcgtggagatactgaatgcagtcgtaatgactaaggtaactcccgctcgcatcataatcgtattgaacaaacgaataatcgcccttttgcccaaactctcatacgtcggcaacatcgacaataagaaactaatgggcagaaacatcgcaaagataatgaaaaggatttgtgagaacaacataatccctgtcagaagaaacacaaaaaaggaaatcccaatattaaacaacactaaaaagaccacggttcctaaacggttcatggtcttggtaatactgagattcgcattgtcattatcttcaatctctgctttgactgcttcttcccgatccttacccttattttcatccggactcacggataaaatcttattaacccgaccctcgccaatttcttctatattggaatcatcgaattgtaatagtaaccagggttgttgaacttgaatcgaaaataaactgtctcgaatcaaatccacactatcttttccctggctttctgaattaggtacaacaatcttggttccaaggctaagagccgcttcactaacgtctgagctaaagtcattgatttttgtaatataggtgggcgcatacgcaatgaaagaacccgagagtagaaaaatcatcacaaaattaatgacggttcggactgctttggtagtttctcgttttaataatccggtatacgccacataaactcctagagctaaaatcatcaataataggaacccaaagtagaatcccgaagtctgtaatccattttcagtgataccggctaaagtttggatattctttccaatacttttagccgtatccgaaatgaaatccaacttgtaagcttcttgaaccacatagcccgtggcgtttgataaatacagacttactgtccaaataaaattggtaatggcataaagaccatacatcacgcttttccctaagccatccccccaattccaaggtaaccaatcccaagaactatccacaaagaaatccagttgataattgttcagagaatatttggaataaaggtttccggcttcaactgtatcatcaaccagacctgtcgcctcagctaccgtaccgactaaactcaatagaactgtcagagtgacgatgctaataaaaacgattcccacaatccgaaaaagtttctttttcatcccctcactccattctctcttgaaccggcggacgagtgtcaaaagcatggaagagttcttcaaagactggatgaacttgaaccacacctactcgcccatacaagtcttgcatcaagcattgaccgttttcagtcaagtccacaatcttgtgtaaaagttcaacctcatcaaaagcacaatgttttgcgttgtgaacctaactgccatgcctttctttctgaggagagaggtcaggagcagtagcgcagcgactcttgatgtctctcctcagaaagaagagactcgcacaggttcatggtgctaaatgttattcgaattaaattctaaatattttcgtggagaagccagccactcagtgtctttttccatcaaaagtgttccaattatccgagtgatggaattgatatttggaaaaatccgaatcactcgttctctccggcgaatctcttcgttcaaccgttccaacacattggttgtacgaatccttcggcggatattttcaggaaaagacaaaatttgaatagcatcttcaaagccgttttctaaaatgtcgcaagcagcacttaattttgaatcacaaccatatttttccaagaagtgctcttttctttcacgtgtcaattcaagttcagaggctttaaagatactcttcaactcgtcttttacatcagaagaaactttctttggcagcttatcaaaaatatttctcaaaaagtgggcttggcatctttgccagctcgcacctaaaaagttcttgcgaacagccttaactaaccctttgtgtgcatcagaaatgaccagttttacaccgaacaaacctcgttgaacgaacgattgaaaaacggtatcccaattatcttccgattcgccgtcttgaacatcaaaaccaagaatcgtacgtcgtccatcagaatcaatgccgataccaatatatacaccttttgagacaatacgatgattttcccttactttcatatacagggcatcacacatgaaaaatggatattccgagccttctaggctccggtttctccactcaaaaacaaatggatccaactgtttcatcagatttgaaacgaatgatttagaaacagtcgcaccatccgttagcagttcaactgttttagttactttgcgagtggagacaccagaaatgaccatttcaatcatggcagcgatcaaagctttttcgcttcgctgatatctttcaaagatagtaggactaaacttaccgtctctggttcgtggaacatgaagttctaacgtaccaattcgagttgtaaacgaacgatcgtagtaaccatttctttgtgattgccgttcttctgaacgttcataggcatttgcctgaatatattgatttcgttgttcttccatcagctgattaaacatgatagtcataagtgtttttgcggtatcattcgcaccgctttcgtttataattgcttgaatttcttcgctttcaaaagtaaaatgtacttgagtcattgatatcagtcctattcgagtatgttttctgcaaaaaacattgtactcctaactgagatcaatggcttttttgatgcttcacttttacacaattatatggacgtaatcccgttttccaaatctcgcaggcgtttttgattgctttgatcctcctgatccaaaccaaagaattccaaggttttcttgatttcatgaatatcggtactgcgaaaagcaaacttcaacccgatattattttttaaacgttcatctaataaatcgtcgctattttgagtgacgaaatagaccccagcattcatggcccgaccagcacgaacaagcttattcgataacgtttttccttgagccacttgaagaaaactccaagcctcatccaaatcgacaattttgaagatttctcggttactatggataaagtccaaggcaaaagtggaaatgacgattagcatcgaaacactaagcaattccatggtggtatattcttcaaaagtcgtttctgcatccggtaaaaccaaatccgccacttgaatgatatttagctgtttatctaaactaatcgattgggtaatcgagccgtctgagaaaagcaaatgagcaaaatcataatcggtaaaggactcgatatgatcggcgatattttccgcgattggtgacccgtcttttcgcaattcgttaataacttgtaataacccccgttgatcactttgagtcaccgttcgaatggctttacgtaacacaggaaacttctccccgtctcgacttgaaattcctgttaaaaaagtcagaatatcaattgctaaactttccgagtctttctttttcttcataatcacataaggatcaagcagaccttgattttctgacttactcgtcaagttgaggatactgatttcatccgcaatttctggcaaggtttctttccaccctcctcgctccccttttggatcgacaatcacagcttgaccaccgaacaaaacagcatagtagactaagagattgttactaaaggatttacctccaccaagagaacccaggaaagcggcggccagcgcattggttactgaacccttgactccttgtgaagccaatgccggtttcaggtaaacattacgacctgtatccacattgtagccaaagtaaatcccttctaattctcctagcatctgagtagccccaaaaccaagccccgccaaaaaatcagacgtaacatactgaatatagtcgttcatatatcgtttacttgagggtaagaattcttcatgtagccccatcatatcgccaaagggccggactagttttacattggtatcatcataaaaatcgagcacttcatcacagcgtcgctttagttcatccactgattcggcactcactcgaaccacataactcagtttgtacatagattcttttgactgatccaaggtggtttccaattcatccacggaatccaaagcatctaagacattggaattcgtttcattgtcagattggtaagcatgattgtctaaatctttcagttcttttttcttattacgaacggtagctaaagcctttttattcgtcacaatctctacattcatacttgtgtcgattgggaatgtaaattgttgttgctggtaatagaaaagttctgaggaaggaaattccatctcccccacaattgtattaattgttaaatacgctacgtacgactcatgattctcatgttccatccgtaagcaccttggtttttcttcaattaaacaacgatttggacgtaataagtcataacgtttcaccagtgtttctgattttagctttttctttggtagctgaaattcgtattcttcaaacggtatccctttttcgccataaatatgttcaatcaaatacgtcaggtcactcggtgtgactcgcctgactttaaatcttcgagccaatttgctttccattaatttttcaagcttagaatagcagcgaatttcttcattggataaggaaacaaaatcgcccatcaaatgatgattcactccatagacaaattcttgaagcccagaaaagaaagatttcttgagactctttagattgacttcttcatctgtcgcaattagtttaaagccaataaaaaagcgataatcaatctgactatcgccaatcatggatactaatgcatctgtctgtatatcaattcgttgtttcgctacttctttgagtctaccggtaatttctttttttgatcgttcttgtgtggcgcgaatactactttctgtggcaatttgtaacgcatggatcttgccttcacgattttgcgcaattagttggcgaaagttatcatgcacttgaaatttctgttcgggtgacaaaaaggagtaattgtaaggcactaattcatagtaggcaaaacactcgccttcttggttaaagacgagattattttcaatatacttaatcggatacatagttcacactccttacaagagtactgggttcatcccatcgtttcttctgttctttgactttctttcctgcaaaagtcaccttaaatcgcaagtgatagctgataaaggatcgtaaaaatcccagtggtttcttgccatcaaacgtcttttgcgacataaaccaagtgacagccaccggtatgcctaagtattttaaaaagacctcctctatcatagatagtggaggcacatgggcaaatacgatgacaaacagtaaagataaaacgaaccaagccatttggttaaaagtcacaggaaaaggcaactgaaaatcattgattgcgtaaatgactttttcaactgcccagatactggtatagctttttatttttttcatttttcctcctaaaaagggcggacataataatatgtctcaccctctagtgttattctacaatttgtttaaaaccatagcgtttcgctctatttgtaaaagcatcctcgccaccttccatcacagtacatattcttggcttgatattgggttcatctaccgacccgcactgatcagccgatatttcttttgaatctcccatgctaatcaaccattctgaatcaccattaactgggatatttgcattatgagttacaattaaaatttgtctgttttccttttttgtaatgatacttcttacgattaagttattaattaattgactatccaaatcatcttcaggctgatccaatatgagtggtgaatttccatacgccaaaatcatagaaagaattgcagatgtcttttgaccagcactagcattcgataaactaactttttttccatttagttcaagtcggataactactaaatcatttggcttaagggtttgtaattcaagaacttgtgcatcattcaattttcttatagaattgattaattttttatctgaaaaaatactactttccccactaactcttatatcaagtatgtcattatatatatcttgattagtaatggaattttttgtcagcttatcaataagagatccaaactcactgtcaaaagtgtcctccttattaatacaagctctgagctctttaacataattattgaaatccctatttggttgaatagtagcctctattcctgtaatatcagaaaaaatttcgcgcgaggaactacttctctcagaatagagattttgatatgatttattcattcttgacattgctgagtcaacctcaacttggtaatctttaagctttatttcttgttgaataatttcttccaatcgctcttcagtttttgataaagattgatataaagaatcaaggttttgtaacatttttaattcatcttgagataactcttcactaagtttttgatacctctttgatacctctttgaaacctcattatagttaactttccaatctgatttattcagctctgctctataactatcaatttcatctgacatttcattaattattgtttgaatcttagcccgattggtcactaaattcttaatcaattctccgcggtgttcatcaatttcgtctgtaacttttataccattgccaaagtcaattttgtcaacactatcagttagatttttgggaatttccttaagtgcctccacatcacgtttcagttccctataaatatctgtctcttttgaatactcatcataaacatctttataactcttatgagatagcttttctacttgtttttttaaatcttcaatttcaagctctaccttcgccttatcttgtatttcttttttcacagaaacaatatcccaatttaattttcttatttcgtttacacatgtttcaatctcatttttatactctgaaatcaaatcagagttatatccatctagtaattctagtatactagtttgattttttgaaatttcataaatttgtttttgagagtatatactcaccttatcggaaatcattctcaaccgttctgtttctttttcaaccagaccattctcttgtgtaaattcataaatagaatgtctatcctgtgttcttattatttgatattttgtccccttatagaaaatattcagtttcacaattgtatccttcaaaaatattccagagccattatgttcaatttgtgcaaagttctgataatcactttgtatttcagaaaattgatcaagttctgcttcctttccaaggacatagaccaagaatcttgtaatacaagatttgcctgttcctcttcctccaataattgaagttaaattatcgctgaattcgactacaacttcttttgtgctaagagtggtcccagaaaagcttaatttttccaataaaacttcattttcattaatggagaaattagaaaaatcagaatgaactcgagtttcgcctagcattaaagcatcgcgaagtgatcccaagtcaggttcgtccttcatttttatataggaatatcttgtgcctattccccaaagtccatgttttgaatttcctttcgagtgtgggttatcagaaaagctaagaaatgtcatattatttttttctgcctcaacaactgatttataccaagattccaaagtatcttttccaactctaccatcatatctggcattcacactatcatagatagtgtcacgcttagatgagggaatcatttgtgagcgattttcaaaaaattctttttgaaccgtctgtactgcatatatattttctgattcaaatatctttcctagatttccaaattttgctgaagaaattccattaaactcatctatatgtgcaggaataacgagcaagccctcgtgctcagcaaaatcaataacttctaaaactgatttcattgagcaagctgcagcgctggcccaatcctctctttttatacccatcttggttaagaaatcagagatatcatttgtacatgcacttttatcaaataggactagtaaatgagttccattttctccacacgttaattccactccaggaaaaaaatctaagccattttcgatagccactttcttatattcatcaatattttcccctgtattgtgatcagttaatgcaacacaatcgagtcctttgtttaaacattcttctacccattccttagcagtaacctttttatcctgaaagcactgactcgcagttgaatgaatatgaagatcacatttgtaccacttattgccaaccattagtaacacccctatcaacaaatattttctatttcagtatatcaaatagaaaagtaaaagtacgatagaaatttctggtcaattctaacaaatgatttacattagttcaaaaacccctcgactcgtaaccaaataattcccgccaatctccaagtctcgaccacacgcatcaaaatcaatatacgtcttcaagtgttctggtacttcgcctaaatcaccagcttctacaatcaagtaatacgctacatcactcatgtcattacaatcgggataatagatgatatcatccacatgctctaccatttcctcgaaagaattgaagaaggcatgttgaatctctgaagcgacctcaccaattggcgttcctttaagctcttccgctaaaccacacaaccgattaatttcctcaattggtgtatactcatcaatctcaaaaggcagttcataatcatgaattgcgtactcttcatattcgtcatttaatccaatccgttctttcacttcatcaaaatcgacgggtggggtaaaccatgcccccaccaactcaccttcattgtattttccaaggttcgcaatataaacacgtatctgttccattgtgattccccctcaggcaccgacaattcggttaaacaaattgagtaagacatccttcacaccagaagcattaaagaccagacctaccgcaatcaaagcaatcaccaagaagccaatcagtttggaaaactcgcgtttaaatcctaaaaacaaaccaatgaccacaatcgctagtaagactaaagattgagcattggttaaaaaccattgatatatggataggtaagttcctgatattataaatatctcaaacttttccccccattcacacggagcgtgcgactttcaccgcactccgcgttccatcgtgtttatattgaaaagtatttatgtagtagacctatatcaagtttaattcttgattgccagctaatactctatatttatttagtcttatgagctggactttatttagcttcaatagagctatatatttttgtattgtttcttctgttttagcgtgtattagacggtgtaccgcctcttttaccaaaataagatttttataatcgtcatttccaccagctccagttggtacaatatgatgacaatgtatttcattagcttgttgaaattcttccagagttatagcacattttccatgttgagcagaaaatagcgaaattcgattgtctgcgtattctattgtgcgattttccaaagataatttcattaactggtacatcagtaatttatcaacacttagattggtgtggataaattttcttccctctagagtgtagcaattcgctaaatacacctttgccattggttttctgtgttggatatatccaacagggaaaataggttcgccctcgccagcaacataccgaagcattttagatttaccatatcttgttgcctcctttgtcgtaagttgtctgcctgtttttctcaatctgccccttttgtttgtacctaatctgttagtgaagatagccattacagctctattcagtttcatacaatccagatttacattcgttgcaatctgataataattttgcatacctaataccattgaattataaagtcttgtttcttctaattccgttttcccttttgagggagaagcaattttctttgcctgtgataccagcttgtctttttggtttttgaattgtttatcacttatatgtgatttaacaactaacttctttcttctcggtatcattttaatcttgaaaccaagaaagtcggagtatctttttctaacatttacaattcttgttttttcttgtgatacttccaattttaatcgttgttcaatccattgagtgattgctattttggctttttcagcactttccttgtagcggcagaaaactctaaaatcatctgcataacgaaccatatacatttcctttaactttgttttcttcatttctttgtaagcgttgcttttacatgggctaccgcttttattgatatgaaccacatagttttttgtaacaggattttcctgccattggctttctacccaatggtctaactcattaagaacaatgtttgctagtagtggggatattattcccccttgcggagttcctttctctggatatgttattgtaccgttagtcattttgattggagcttttaatatcctttttaaaatgaatatcaagtgcttgtcccgtattcccatagcccatatctgttttatcagcttggaatggttcacgttgtcaaagaaacccttaatatcaaattcaatcacataatgtagctggctgatttgtaggcggttataggttgcttttattgcattttcaactgacctattaggtctaaaaccatagctgttttcactaaatttagcttcgcagattggttctaatacttgttttatacattgttgtataagcctgtcccacatacaaggaatacctagaggtctggttttaccatttggttttggtatttcttttcgcctcactggcttaggtcgatacccatgtggactgcctgcaacaatgtatcttacttttttgacaactgtttctgctggcaatttgccaatatctttaattattgtaccgtctgttcctgctgttttactgcctgcatttgctttgatatttcgatatgccagtaatatattttctctcgataggataatatccataagatgagtgaaaatatctccattcttacttttggcatataaatcatcaaaggtgttttgcatttcgtaatattcagcgtgtcttaaatcttctacacacaatgtttcatttttatttttaggcataaggcttcactcctttacttgaaattgagtgagcttttttatcttactcgtaatccttattgaaacaacataatacttttctaatatatacacgacttgagggcattcctccattctcattacaagaatttcttaggttcgccctctgcttttcagcattagttcaactgcttattgttcttcgtcagtttattctcttgatgagaacccaatacctttcctcgttccgataatcttatctatacatatatatccttaggtcactagctataagcctgctggcttgataccgcctgtaacgttatatggcatttcataacctatattcttactttgccacaccagctacgatttctcgtacctttgcatttctacaaagttcaaatttagacccgtacattcgctgtttcgtcagttccttatagaacattctaaccatagatattttatagacccccgacctgttggatacgctacccacctctggatagttttcgatagaagatatatgttcatcaactattacggtatctttcagccgtctttaccgagcttcaaacattctgagtttcctcatacaatgcttgtcggaggctcagggcaggcgtttcagagcgttacttcatcattccacctgtcagattatcagttctcctaataaccaaactttttcgttcttttattagtgccttagcttttcactaaggaacgagtcgcacacaaattttgaccgaaattcatttcatcactttcctttcttttccattgctcggtccgccgctgcacttgcatgcatcaagcacatcacagtaacaccaagcatactgccaccaaacaccaataaaatatctttcacaatttccatcacgattcctcttttcatataatcaaattttcaattgccatactttgttgctccaaaatctttttgtgccggtctgatagtcgagtattatttaccatatcctgaatgtacgttgtctgattcaaccgatccaactccttggccatcttccacgtaggggcgacttgtcgtccaagccagttcaacgttcgttcaatggtataaggcttcggttcagaagttaattgaatttccttctgattccgtccaatgaagcgcccccattgttcattcaagggccagttagttcgccttttgccttccaccttatccgcaaatcgcaagtaccggttaataatggaaaatgtggtactttcaatactgcgaccttttaacaaatcttgaattgcatgataagctcgatcatttttcagtcggatttcaaaacgatttttcgtttcggtctggtctaaaggaatccctaacttgatatattgctcatagtctttttcgtacaaacagaaatagacctcactcttaagactgccaatatacaaagtattgcccataccatctttatcatcaggtttcaacagttccccggaacgatagcttttgaaggtacgaaacaaggagatacattcttccttctgacattttttcgttaaatcaggaatatctaacaggccaactcgatcattgattgccaggtctaagcgtttcatcacgccaccggcttttagacaatcttcgaaaaagtcataccagctacgcttttgggcgagtaaaaaagtttcaaactgccgacaaccacgaccctttaattctaaaaggacgcctttatcttcttcatgtgacaacatcaccacaatatctcccataacatattgttcttgataggagtaaaaggcgtaatcttcgtggagcatataatcaaatttcaaatggagaatctcttgaatgattttcctcgcatccgttgtgggaaagcgaatccttacatagtcaaacagtaacgttaaaggtaactcgggattgaaactttccagttggtcaaaaattttcctcatggtttttgtcgatgcggttacgccaccattttctatctgatttaagtacgggcgactaagtccacaagtcgtagctaatttattttgtgaaacgccatattcattacgccggtcttttaatagccgataatctaaattcctttgtgccaagttctcacctccaaatttaaggtgttaactttttcaaatcagttaacatctacacaaattgcttattatccttgataggacagccattccttatcgttgcttgcttattttttgtgtttttgtacccccctgttagatacggggggtgagacatcatggccggctaacgccgtccataaacaggcacagcaccacggaggatttctgcttcgcaaatcccccgcggtcagtgcctatcagtggtttatttggccgttactccgcggtaataccctcaatttccaactctgcttttatctcaaacaagtattggcggatatcaggttctttagcaaagtccgcaattcgttccaattcactgatgacttgattcagctccattcgagcatccgtttcctcatcaattacatacggatcatcagggactttcaccccgtttttgcgaatatcaaaattgagccggtacagttcttcttccaattccggatctgactgaatcttgccaatcacccagtagattccccaatcaactcatcataaatcatctgtttttacctcctttaatcttctagcaatatcaaaaatgaccggaactgttacagaatttccagcctgcttatacaactgactatctgaattgacttgagaagctcgatcaaaagcccagtccggaaagccctgaagccgccagcactccctaggtgttaactttcgaatttgatactgatccgtgacgactgcttgttggtctcctgttaataaggtatgcacactttgttttcccagacggcctcgacgacttgtggaattaggaaaagccaggttcacactgttccctggcttcacctcttgatattctgtttcgtttttccgaagcatgatcttcgttccgccttgtttcgttgacaaagtaggcgctgttccagttatctcataaacccgattgccttgttcaaaatttcccagtaacatacccgctacagaaattccatcatctaccggcaatgcgattttgattccttcatcaccggtcaaggtaggcgctacgtcatctgacccatagacttgtccccccattcctcgattggaagggttgatatttaataagtttctgatgttttgatcagatgttggagacgatccaatgataggaaatacttgttcggtacatgcgtctcgagaatgtccgataaggaagatccgctcacggttttggggaacgtaggcctttgagttaagcacttgccattccacatcataccccaatccatccagcgttcggaggatcgtctcgaacgtagcccctccttcgtgattgagtaatccccggacgttctcaaggaataaaaacttaggttggagaatagcggcgaaccgagcgatttcaaagaataaagtacctcgagtatcggaaaatccttgccgctttcccgcaattgaaaaagcttggcacggaaatccaccgcaaaggatatccactggtccgagagattgaataaactcgtctgatacacttgtgatgtcatgcatttccacctccttacttgtatcatggattgccttataactctggcgagcaaaatcatcaatttcacaaaagccgatacactggtgacccgcttgttccatacctaagcaaaagccaccaatcccagcgaataaatctaaaaatgtcataaatcacctcgtaaaaaaagcccaggattcttgacactcctaggctacatactattattttatccttccgtattaacgtttaatccaccaatgtcgctaatttcccttaagaaatcatatccttttggtacaagtggcgtataaaactcactaatcacactccctcccgtatctacatagcctcgacctttgatacgcttcataaagaattttttatcaacctcgccaaacatcatggaatatcccagttcactcatacgacccaaagccacccggaaattaaattgatcgcgaatcccgtctcctaaatatttcgcatccggtctttgacaagctagaatcagaaagaaaccagattgacgacctaacatcacgatttgtttgagcttattcaaaatcaccgcactttccttcgtcgttaacatttccatataaaccacgtattcatcaaagattaaaaagtttggtggaagtccaagaaacgcataattctctcctgttttgtagttgggcatttctttcattgccttgctacgagtcatcatgcgctcatagaaatcttccacacaagcagaaatttcctccttttgggaatagacatgaggcattaccgtacctaaatcggctaagtccgcatttttgggatcaagaacaaaaagctcggcatcagattttaataaagcctcgatgatagtgagtaaaaagtaagtcttcccaccacctgtgccgccagcgattaacatatgaggtaaagaatcataagcccatacttgatttttcatcaatcgcaaagccccactttctgccactacttcgtctatcccaattcgattggcaattatatcatacagtaaagtgtactccacataggagtctttgagttccttttctactagttcacaatatagaccactttctaacttcttttccagctttaaaagctgatcttgatattttcccagtgaaatttgaacgcgaatagaaagtaaaccatccttcatacggtaatagattttggggaagtaactgattgtctctttggttcgactactattgaggtctttgaaaaatccttcactctgagtttgttttacttcgtaccaatgattttctagaatcatccgggctagcttttgtcgatgccacaaactgcgccaatgatcctgaaaaaagtgtatataaagcaacatcgtgcttcctgaaagaacgagacttcctagcaaatagattaaatcttttatagaacgaacgatttctatagtagaaagtgatagcttagaaatatcaaattgtctaagctcttgaaaataaaagacgctcatccaaccgatgaacagagcgagtagccagccaagaacaaagtgataaaccaagtgctgatctcctgcccgtatacgatgccctttgtacatttttatggtttccacctccaatcgaaaaaagcttcataggatttcattgatccaatttcaagcagttatgctagtcatttactgctatagggagttgtttcgtttccactagttgctttaaaaaaacttcaatggcatccggcatttccacaccaatttcttccaatacggtttcggcttctcgacatagactttcatttacttcgataaccataaagaaggactcttcttcccctaaccaattcagtacatcaaaatcttcttcggcatcgttacctacttccagtaacccttgatgcataatcagaaacattttttcatcataggttaatgctttagtgagttgttcctccgttagctcaccttttccatattgatcgagacaatctaaaatatgttcaacattaatttccatacgcttcacctatttctttccttcattttggtttgtagaatttccctgatctggttgtcgtttcaagactaaatcatcggccttaatgaaccaattgacagtagttccttctcggaaaacataattggcgaccgtatccatgattggattgaccaactctacctctgcgtcataggcaaactcgcgtaagggtacatttgctgggatactaacttggatcattcgaccttgcgcagaggatttcaaattataagtccgttcttttacctcgttactaaccgttccatcctcattttgcttccgtacttctcggcgtaatgcggaaaatcgtaatttcccaaacgttagtcctgaatctacaacaataccttctgttaatctcatcttcttttcctcctatgctttcactaaatcatcgacatacaacacgtagtcggtaaacccacgattctcaatctcatagcctttggcaaccaaatggggattcacggcttttagtggttgatcttgatcaaaatccttttcgccggcttccgcagctaccaccacttcaatatcatcggctcgttgcttactggaatacaaatgataactacgaccaattactgtagtattccgcccatatccttcagttaaaacttcgccttcgccggcataccttatctttccaaaggtttcggccatatctggcacaacaaatttcaattccatcttcttttcctcttttcatttttagttttggatacaaaaatagcgcgaccactttttttaggaggcggtcgcgcacgttggtttttcctatttagttgtttcatcacatcaccttagtttcggcgattccagaaataatacccagcagtcgcaaagatcaaggtaaacccaataaacagcagaacattagaatttttctcccctgtttgtgggaatgtctttactgtaggactagattcttgagagtcacttggaacagttggtatttccggttgttctggtgcacttggtgttgtcggaacttttttaggtgttaaagtttgagttttttcttttagatcctcattgtgtttcccattgatgtttccgtctttgccatagttaatttctttgaaggtaaaacttgtaccttctggatatttacttgtgtccactttttccgcaagtacggttttagtgaattctttgtcattcacttcataatcaattttgccagatttccaaatttctttggtcgtattatccggaagtaatgcatacagaattgtttcaaaagcttcttttgagccatccagtacatcatgggtaatcgacacatcatcgaacatatccaccacatccccatgagtaaaggtttgcgaaccatcttctaggtgggcttttgtttggatggaaacatggcgttccaccgtacaattgacagtttgggcttgattgttcaagctagcatctttcgctactggatcatcacctgcttcatagggtttcttgttttcatacacatagttgaataagacgatggttttatccaaaacttgttctgcggttaatttatgcaaaattttccaagttcctgttttctctttattcgccaacgttgcggttgtttcggcaattaccactggtttggctttttcatctttttcttgggcagcttttgtcgcttccacatcaatggcttgcgctaccacataccagtcttctttgatttcatgcaagttatagctcaatttatcaactagctcggtagaatcaaggtctgtcaattctttgcctccgtctttccaagtcccaagagaagttaagctatcttcttcttcaggtaaatcatagagcatcaaacgattcaagctaacagaaaatgctttattcgtcagtttctcgtaaggaacggtcaccgttttaattggttgtttttgtcctttttcggtaatcgtaaaaatgtattcactcttagtgtaatccgctttattttctttaaaagtagaacggatttctaatggcgtaattttttgaaatccttctggagcctctacttcttcaagtaaataatccccataaggaagattttcaaacttgccatagccatcaaaacctagttgctcgttataagctgtaattgcttcatcttcggcacctgtaatctcactggttccttccaatggcgatactttaaaggtcagatcattgaagccagtttcggcagtcccagcagctgatccagcaaatttaaagaaatcaaagccaaagcgaatgacttgttcttttgccgtaacatctcgggtaatcacggcatttttttcgttatcatccacctttttgatggaaacagggtactttgtttcatccaaggtatatccttcaggtgctttggtttcttgccagtaatactcattaatcgctaagtgtttaacagcaacttgattcttttcatctaaagtcaaagtcaccgtttcatcagaagctttcgttcccttcactaactctggtttaaaagcctcactccatttgaccgcttgaccatcttttgcagtaaagagagtatattcagctcctttaaactcagctttaccttgagtttcattaccggtatctttgtcttcttttgtcaaagtggtttcaccagtgatttcttggttttgcccttttacgttactggtaacaagagccacggtttgattgacatagttcaattcgacttttactggtttaaaggtattcacaaagccattactagctttggtttcggtcacataataggttcccaattccaacgcattggcaatctcttttggtgtttccgcatgacctttttcatccgtggtcatttcttggacaatttcaccggttggactgtctttgcgaatggcaaacgtatttccggctaatgagtatttgtcgttccaaagatcagttcctgtttccacccccattttattcaaaatgatttgacctttttcgcgagtattttttgaagtcacagaaatagtctcaccagatttaatggttgcggtgattggtgtagtgtcaatcgtataaggagctggcactgatttttcagtaatggttactttcgcgccatgaggaatctcatccaatgtcgcaatgccttctttatcggtggtcacgtcttttgcaggtaatgtttttccaaagtctaaatggaaaacggttcccggtacaacatttcctgtttctttatcgacttttttaatcttcaaagaaccctcagtttccacatcaattttgattgtgtaggtattgggcttatcaattgcccccgccatcaaagtttgttgaccagccattttataagctaccggtgttcctgtattagctgacttctttagggttaattcaccactctcttttgaattggcatttggagtaatcactagttgattgccgttcacacgataatcaatatttgcgatattctcgacaacttcatcaaactccgataaattcaagccgttcgtatctgtcacagtagtcgattgacctaacacggttttcactgtggagttatggaagcttggtttcttttgataatccgcaatggcttgattgatttttgactcaatggctgcgatatttactgcactaccatcagaacgtttaattgagtgaagcgtgtagccattaacttcttgccaaatcatcttctgggccacaatatgtgtatccacatccgtaccagcttccttccataaaacggaaactaatttcgctttctccgacatatcaggcaatggatttttctcataaccaggagtgaactcattgtaaatcggcacccctggctcaatacagaaaatatcttgcttcacaccattgtaaactgcatagtgcggaacggtaacttctgacatgggacgaccatcgctaaatgtaccttcgacagcatactggtgagccaaatccaattccacagttaccgtttgtggatgagtaatttcatcagcaaaggcaatcgttgggccaagcgatccaccaattgtttggcataatagactcagtgttgcgagcaaacgccaattcttaaatcttggctttttcataaaataaatctcctttcgtttttgggtaataaaaaagacgtccaaattttaattttgaacgtctgatttagagtgatactatttagttttctttgtcttggataggttgtttctctgcttataaattttgattcttcgataatcaaatccaatctctgccatcaattcctcccaatttttgttcgttcttttcataattgtatcaactgatggtagttttggggattgaactagttttcgaaactttgtcattgataaatcatcctgtagttttaatcggattatttcattttttagttctaacagcagttcgaaatcagtaaatcgagatccatcatttttttctttaaaaagtggacgtatatctcctaacatctttttaatggtactaagtgaaggaatattcttccctactgatttttgttcgtacattcgttgagaggttatcttctcgcacttaataaaggcttctactatttccaataattcttgttctgacattctagcccattttccatacccagtattttctcgtcctatactaatcaataaattctcccatgatccatattttttgttaatgaaccacatacttggtgcagaatttggattttctgatagctttttctggtattgacggctagatgtaattccgtgtttttcgatgaattcattaattgttaaaatcagttttaactcactttgatttttccaaatgatacgtccatcattttgcttcacgataaaaactcctaatagttatttagatagaagcctatcacatcaactttttagtagaaaagtacatgttttgtcttttttgctaatagctgaccctttgagaaacttgggttcaaaagttgctaaattcggtaaatgttttggtatttttcgtattatatttgtcgtcaagctgactactaaattttgccctattttgacgacactgatagtcaatgtcggacaatctaggacaatttttaagggaatatgattgaaaaatggtccaaaacagccaaaaatggcttaaaactgtgatagagaaaaaagaaaaagcccttgatatacaaggacttttcacaaatttcagatttccaaggaagttttccgtgtttatcttctgatttctttgatacgagcagcttttccgtgtaatgcacgtaggtagtacaattttgcacgacgtactttaccgtagcgaactacttcgatttttgcaacacgtggtgtatgcaatgggaatgtacgttcaacgcccactccgttagaaactttacgtactgtataagtttcgctgattccagcaccgcggcgtttgataacaacaccttcaaataactggatacgttcacgagtaccttcaacaacttttgcgtgaacacgcacagtgtcaccagggcggaacgctgggatgtcagaacgtaattgttcttttgttaattcttcgattaatggattcatggttttcttctccttattccaaatattcttatgagcttttctcacagcggaatatcgtaatagttaagtgcttttgcactcaccataaaatactaacatattatcaacctactgtaaagaagattttagaaaaagtcacttggcttcatctgctgttttttcttgttcttctttcttgatttcttctaaaaatttcgtcatttgaggtgtccattcaagtgtttccaaaagatcaggccgacgttgataggtccttcttagtgattcttttaattgccattcttcaatcaatttatgatttccatttgtcaatacttctggtactttcatccctttatattctgccgggcgagtatattggggatgttccaataaaccggttgaataagaatccgtttgagctgaagtctgattccctaacacatctggcaaaagccgaactgttgcatcgatcatgaccatcgcacctaattctcccccagtaaggacataatctcctaaggaaacttcatctgtcactaatgtgcggatacgttcatcatatccctcataatgaccacaaatgaatactaagtgttcttcttgtgaaaattcttctgccattttctgatcgaatcgtttaccagctgggtcaagaagaattactctttttttgacatccggtgcagctttttcaatggcttggatgttatcatagatgggctggactttgagcagcatacctgctccaccgccgtatggataatcatctactgtctgatgtttgttatctgaataatcgcggaagttagagatattgatatctaataatcctttatctacagccttaccgatgatggattcccccataggaccttcaaacattcttggaaataaagtcaatacatcaatcttcatcgtcaatcagtccttctggaatttctacacggaccactccagcttctaaatcgacttctttgacgacagaagcgatatatggaagcaatatatcagcttttttcggacgttgaacgacccaaacatcattggcacctggtgacaagatttcttttactttacctaactcagttccatcttctaatacatgcagaccgatgatctcatggtaatagaattcattttcagctagatctacagagttgtcttttgacacttttaatatgccatcccgatatttttccacatcattgatagaaggatgtccttcaaaactcaataagtcaaaatttttatgtttgcgatgacttttgactgttaattccacaggtgcttttccgtcttggaatagtgttagcaccgttccttttttgtaacgttcttctgggaaatccgttgttgagataacacggacttcgcctttgataccttgtgtgtttacgatttttcctacattcaagtattcagtcaacttatatccccatttcttttttgtctgttttattttagcatgtgtgaagaggcaattctagttttcttttaaggtattaagccaaaattatgcaaaaatgcggcgtgctatttttgattacttcctgtgacttggagttaaatgatgggctcagatcagcgcgctgatttcacaacctcttcatagaaactgccatcttcaacgcagacataggatcttgatgagtgatcgtataggcatttttcggttcttgccagcttacttctacggctcgattcgtcgtatcacccatatcaacagtaattttaccaaattgttcaggtgctggtagactgttttcttccaaataagctacgatttctttagctaatagtaagggatcttggccttctatattattcccacggattcgaatacgccagtttccttcttgccattcaagaaaacttgaacctgctgcaccttgctgataccctgtgattcgagaacctaagtccacttgctgaccatttgtgtcgatctcaaatggctgcaaaacttggattgtttcttgactagaagcaaacccatattgatatagataggttgcaataggcgtttcttgattcaattcgtcagcattcaacccgaggggacgatctgttctgtaatataaaatagaataaccttgctttgtatgtgtcgctgcgatattgagatagcctgaagagactggtacatctagaggcatgggaacatttggctgttgttctttcaactggtctaaagcagtctttttctcattatttgaggtagccattgtttgttcagtggtggaagccgttttggtactacttttttctggactggtaacagtttcagatatactgcttgatagatgtgtattgtctgattcttgagtaaccgaactacaagcgcttaacaatagagcaaatggaataaataacattttctttctcattggctgttcactccctcctcctataaggatacgctttcttgcttgttttgccaaataatcatttcttcaattaataaaaaaacaaaaaagctgcactcgaaaattcgagtacagcacgtttatttacttttccttatcatcgatgatattcaaacgcacttttttcggtgcattgatccgaacaccgtaaacgattgtgcggattgctttagcaacacgcccttgttttccaatgatacggccaatatcttcaggagccactgttagattgtactcgtaaaagtctttcgactctacgacgtctaacttgacttgatcaggataagtgactagcggacgaacgattgttaagactaagtcgcttaaatctttcatatccggtcaccttatttctttgagaatttagcttcgtggtgtttttgcataacgccttcttttgaaaggatgttacgtacagtgtcagaaggttgtgcaccttttgataaccagtcaagaactaagtcttcttttaaaactacttctgcagggtctttcaaaggattgtaagtacctacagtttcgatgaaacgtccatcacgaggagaacgtgaatcagctacgacgatacggtaaaacggactctttttagaacccatacgttttaaacggattttaactgccattatttatttccacctccattgttttattcacaagatgtagtgtaacagtttttttttaccctgtaaagctttttttctttacagcttgattaaattcgattttttttagaaaatagaagattttagacttcttttttgttaaaaataagtaatctatcttctatgtagcttttgtcagtaagtgtttttatttgctccagttacttatcttttgtaagattattatagatagtttgaaggaggaaaaatcgtatgacaaaaaaaattggattttttattggtagtttaagaaaagattcttacaacaaaaaagtagcagaagcttttgcgaaattgcttcctgaagggtacgaaagtgtatttgtaaaaatcgatgatctgccattttacaatgaggatctcgaaactccagaacaggctcctgctgaatggactcgttttcgtgaggaagtgaggggactagacggtgtcgttttcgttactcctgaatacaaccgttctgtgccagcagtattgaaaaatgctttagatgtaggctcaagaccttatggacacagtgtttgggatcataaaccaggtttagtcgttactgcatcaccaggtgggatcggcggctttggcgcaaaccaccatctacgccaatcacttgtctttttgaatgtgccaaccttgcagcaaccggaagcatatatcggaaacgttgcgaatctaattgatgaaaatggtaatatcgttgaaggaacattaagtttcttccaaacgattttagatgcgtatctagatttttctaacaaattaacagagtaaaaagcataacggtaataaaaaaggcaactatgtacaggacatttctgcatatagttgccttttttattttatttacttctactttcgtacataatgcaattcgataaattcaccgaatcgtgtcgtgtctagcatttcaaaacgcgcttcatatgttcctttttggaataaaggaatcccgtcccctaataatacaggggtaatctggatataccattcatcaatcatttgatgttccaatagcggtttgatcaatcgaccgccacccacaacccagatatcttttccttctgtcatttgtagattttttagaaaagcaacaggatcttcgtttacgacctcagcatctggcaattgtaattgtgcgtgggtggaaaaaacgaaattctttttctctggataaattgcttcggtctccaaatatttttttgcttcctgataagtttttctgcccatgatggtcgtatcgattgtttcataaaaagcttcataagtagtttgcttacctgttggagtgtcaaaaagccattgaagatcatccgttttcgttgccaaatagccatctaaacttatagcaccataaaatatgatttttcgcatgctttattcgccctttctgccgatacgtacgacctcttctttgcggaaacaactgtcaaggtgatcattgatgatcccgacagcttctaaaaaagcatagattgttgtgcttccgataaatttaaatcctcttttctttagatcttttgctaattcatctgaaagaggacttgttgttgggacttcttcttgtgaatgataagaagaatcaacgatttttccattagaaaacgaccaaagatactctgaaaaactgccgatttcttcttgaattttcaagactgctttggcgttttggacggctgcttcgatttttcttcggttacgaataattcctttgttttccattagttcactgatttttgtttctccataatttgcgacttttttgatatcgaatcgatcatatgcttcatcgaatgcttcacttttatttaaaatcgtctgccagctcaatccggcttgattaatatcaagcatcaattttcggaacagcttttggtcatcatattcaggaacaccccagacagtatcatgatattgccgcatactttctgtttgttcactccacggacatctcatctgtgccacctcttcgtttagagtaattgtattagtaaagaataaaaattgctgatagaaaagctccggcagtagacattttcagtctgtaccgaagctgtttttttcatcttatttccgttttttctttttcttcttatttttcttgatcattcgattcatcgccattttgcctagttttcctttgacgcctgaaccaaacatttggtccatacctgggatgttcatatcccctttggacatttgctgcatcatttttcttgattccttgaattgtttgatcattcgattcacttcaacaacactgtttccagaaccggcagcaattcggcgacgacggcttgggttcaacagatcaggatttgctctttctgctggcgtcatagaataaaccatcgcttttttgcgttcaacatcttttggatctaccttgacgttttcgattccagggacttgattcattcctgggatcattttgattagatcttccagtgggcccatacccatcacttgatcaagctgttcaataaagtcattgaaatcgaatgaattttcccgcattttctgtgcaagttcttccgcttttttctcgtcgtagtcttgctgcgctttttcaatcaatgtcagcatatcccccataccaaggatacggctagccatacgatctgggtggaatacttctaagtcagtcaatttttcaccagaaccgatgaatttgattggtgcgcctgtcactgagcggatcgatagtgctgccccgcctcgagtatccccatcaagtttagtgatgacgacccctgtaatacctaattgctggttgaagctatcagctacgttgacggcatcttgaccagtcatggcatcgacaacaagcaaaatctcatttggttgcgtcaattctttgatttgtttcaactcatccatcaatgtttcatcgatatgcagacgtcctgccgtatcgatcaatacatagtcgtttttcttttcttttgctaactccatcccttgacggacgatctctaccgggctgacttcagttcccatatcaaatacaggaacgtctagctgttgacctaatactttcaattggtcgatcgcagctggtcgatatacgtcccctgcgattaggagcggacgagcattttcatttttctttaaataattggctaatttaccagtaaaggtcgttttacctgccccttgaagaccagccatcatgataacagttggtatttttggtgatttatttaactctgctgtttcagaaccaagtgtgatcgtcaattcttcatcaacgatttttacgatttgttgtgcaggtgataaactttccagcacttctgcccctaccgcacgttcgcgtacgcgcttagtaaaatctttgactacttgcaagttaacatcggcttctagtaaggcaaggcggatttcccgcatcatttcttttacgtcagcttctgatacttttcctttttttcttatttttcccatcgcctgctggagacgttcagttaagctttcaaatgccatattttcttcattccttttatttattcttcgattgcttgaatttgctgtacatattcaagtagttttttatcttccgggtacttatctgtaatatatgcagtcatattttccaatacctgttctcgaacaatataattagaaaaaagatggagttttttttcataatcctccaagatcttgcttgtccgcttgatattgtcatatactgcttgtcggcttacttcgtattcttccgcgatctcacctaatgaaaaatcatctgcataatataattccatgtagttcatttgtttttctgtcaataaggtcgaataaaattcaaagagcgcgttcattcgattggtcttttcgatttccattctgctcacctctagttttcagccattcttcatcagagagcacagtcattttttgctgaataaaataagcagtagccactccggcaccatttttttttattccggaaaaacttccgtcataaatcgaatgggttccgcatgaagggcttttttccttcatgatgactagatcaatgtgtttttcctgcaatttttgataggctttgatcgcgccatttttgtacgcttccgttacatcttcgccgcttgtcgtccatacttttgcttgatctttccacacatcgaatccatttccaccaatgatttcagcgggatctctaggaattggtaatccgccgatcacttctggacagaccatgacagcttctccagtttcaactagttccatcaattctggtacttcttttttctgtccatcatagcgacaggccagaccgcctaaacatgcactgattccaatcattgactgctcttcctttctattcagcaaagtgccttcctattataccatttatttcttttgtaaaatagccctttgtactgattctatgctaaaatataaacagaatgaaacctatttaaaggagatttgaatgaaaaaaatactagttgttgatgatgaaccttctattgtaacgctcttgacgttcaatttggaaaaagaaggctacaaggtaaccagtgccacagatggaggcgaaggattagaattagcattagaacaatcatttgatttcatcattttagatgtgatgcttccaacgatggatggcatggagatcactcagcggctgcgtcaagaaaaaaatgaaacaccgattttgatgctgacggctaaagatgaccaagtggatcggatcattggcctagaaataggtgctgacgactatttgaccaaaccatttagtcctcgcgaagtattagcccgtatgaaagcaatattcagacgaattgaacctcgtaagcaatcaaaagatgaagctgagcctgaatatctatcgattggacaaatcactgctgatttgaccaattatcaagtgaccgtagacgaccatctgattgaactaacaccgaaagaatttgaattacttgtttatttcatgaaacgaaaagaccgtgtgatcgaccgagacacattgctagaccgcatttggaattttgacttcgcaggacaaagccgaatcgtagatgtacacgttagtcatttgcgagaaaaaatcgagcgagatccaaaacacccaaagtacttggtgactattagaggatttggctataagtttcaggaacccaaacgatgaaatggaaaaaaatttatgaacgtctcttctttcttattcttttagttagtttgttttttggtggctggcaattgatttcccattattttcaacagcagatcgtggaacagcaagaaagctacctgacaaaaaaagcacaactgctgatccggcaattagatgtcgaaaacctccaagcagcgcaaaacaaaactgctttggaagaattcgtccatcagtcgaacgaacggattactttaatggatgctactggaaagatcttatttgacacaaacaatgaaacattgaatgaacagcgaaactcccgtcccgaaatcaaagccgtattgaatggtgggaacctaggtagcgctttgcgcaaaagtactactttgaatgaggatcttttatatgtcgcattaccagtcaaaaaaagtggccagttagaagccattttacgtatcgcagaaccgacaagcggttttttaccgagaactgagagttttcgccgttgggtctttttcttctttctgtctttcttccttgttcttgcaggaatgatctattatctgatctatcaaaaaaaccagccattgaaaaccgtgctgcccgtactaaaaaaaatggtgcaaaatcctaatcaggcggaagtaatcatgcaaacacccgatcaatgggaagaattgtatcagacgattaatgcgttgagcgaacaaatgagtaagatgtatcgggcgtgtactaccacagaagagcaattatatacgttactgaacgaactgatgattggcgtattcctgattgatgatgctgattctcgtttactactgcttaatccaaagatgcagctacatttaaacgtggtaagctatcaacctgaacagcggtacacagaagtcattcaagagccaaaactcattcagctgattcatcaagtgactcctgagcatccgctgatccatcaggagatcacccttacagaaggtcggcagacattagacttgagtttgcgctactttactaattcagaaggtaccggacagattctaggggtggcgtatgacttaacgaaagtgcgacgtttagaaaagctacaaaaggatttcgttggcaacgtctctcacgaattaaaaactcctgtgacttcactgattggttttaccgagactttactggatggtgcaaaagatgacccgcaaactctgacttcttttcttgagatcatgcaaaaagatgcgatccggttagataaactgattcgggaaatcatccagctgtcaaaagatggcgagaattcttacgagatccagacaatttatacagaaccttatttccagcaaatcgttcaaaattatcagccaatcatcgaaaagaaacggttgacgattcgattgattggaaagaacgaaccatttactactaaaacagatatcctttatccaattatcaaaaatctaattgaaaatgctgtccaatattcaaaaagcgacagcgagattattatccgctatcaggcaacagatgatctatcgttttctgtccaagactttggtataggtatcgacattgaggatcaggaacggatctttgagcgtttttaccgcgtagacaaggcgcgaagccgacattcaggcgggaccggattagggttagcgattgtaaaagactacgtgcaactccttaatggtacgattactgtagacagtcatcttggaacaggttcgactttcaccgttaccattccgaaaatgtaaaaaagagcaactgctcgtgcgttttaaagttggatgactcatcctgcttcgaaagatacacgagtggttgttcttttttactcttttttgagatacttttcgtcaattttctcgtttaaatatcgatagaaattttttagctacgcgactaaacggcttttgctctttttcatttttacgttcaaacaaatattctaccaatgtggtcaaatgcctaaaaatcgaatctgccgagaaaaatagaatgctcaacagcaaaagtgatacagctgagataccggtgattgaaaacagcttatgcaaaaagatgaccgaaaaaaagttaccgctagcacagaaaagaatgatctgacttctgaatttattcagcggtgaacagattttatagagaacgaggaaccctactgcaatcaaaagcatggtagatgctgtagaaacatctgttttatttagattcaaagtcaccccgcagatcaccaacgcaccgactacgatcatatctgttagtccacctggcacagctttttccatcacattcatgatgaatttccctctgattcgctttttgttttcttctagagcaagcaagaaagatggaagtccgatagtaaacaaactaatcaatgtgatttgtgatggttctaaaggataggtcagagcaaagatcactgaaaacagtgagagcaaaaaggagaaaatattcttcactaaaaacaagctggctgatcgctcaatattgttcacaacgcgccgtccttctgcaacaacttctggcatgcgtgaaaagtcagaatcaagtaagaccacttgtgaggcctgcatggcggcttcatttccggaagccatcgctatactgcagtctgcttctttcatggctagaatatcattcacgccatcacctgtcatagctactgtattgttacgctttatcaattgaacgaagattttcttttgttctggcttgacgcgtccaaaaactgtatatttttcgacagctgcttcatattcttcttctgataatttagatgcatcaacgtactgatcagcatgtgaaatccctgcttggacagctacattggatacggtgagcggattatctccagaaatcactttgatggctacttgctgttttttgaagtaatcaaatgtggctcttgcttcttttctgataggattagcaatcagaatatagcctaatggtgtgactgcttctgtcaatactggttcttcaagaatcccatcgtacacaccaaagaccaacacgcgatagcctttttcagcgaaagaaacaaactcttccgcatattccggcaattgatcgcgcaaaaccatttcgggcgctcctaaaacatacaccttgtctgccaacgctacactgctgaatttttggacagaagaaaaaggaataacatggtgataggattgatcagtggtttttgtaaaatatgctttaacagcttccattgttgcattgtctcctgccatcgcttttgcatagtcagcaatgcatgcttccaattgatctgactgactgattatttcttgttttttagagacgatcattttttgaacagacattttattttctgtgatcgttcctgttttatctacacaaaggacatttacccttgccaatgtctcaatgcttttcatattgtgtaaaagaactctttgctttgctagtttagtcgcacttaatgctaatgcaatcgtcgtcagcaagtacagtccttcaggtatcataccgatcaatgctgcttccattgcaacgacactttctttgatcgtgtttccattaaaaaagtaactttgagaaaaaagcaggataccgataggaataatgatgatcccaatccatttgatcaattgattaagagaagcaatcatctccgactgttctccttctcccattgtcttggctttgactgtcagctgggaaatatacgaatctgctccaactttgtctaatcgggcgtaagcttttccggaaacaatgaaactgccggacattaatggatcacctatttctttggttatttcatctgcttcgcctgtcaataaagcctcattaacttgcagtttcccttccacgacctctgcatctgctggaatttgatatccagtctctaaaataacaatgtcatctattacaaggtcttctatatctattgtttgttctatcccgtctcgtatgacattgacttttgctgtatttaaaacatttagttcgtccaagatctttttggatcgaatttcctgaaaaatggcgattcctgtattggctatgataactggtaaaaaagtcaagttcttataggattctactaaacaaagcaaaatggctaagataagaaagatcaaattgaaatacgtaaatatgttttccaatacgatttgctgatttgttttgaatgtgggatcgactgaattatttgctgcacctttttctattcgttccttgacttgatctgccgttaatccttctttatacgatggaaaaagacggatgactttatctgatgatctttgtgttactttcttttttttacttcgatttatccatttattcttcatgtggctacctcgattgatttcgttttctggatatttccaaacttctcctatccagtatagaacagatatggaaagtgttcctcacattaagcttgcaaacacctttcattcctgtcatatagcaaaaaaaaagggttctataatattttgtgttggtggaaaatcgaaggcgattttctactaacactttttcttcgtttcaactcaaaaagagactcacttttggtaaaatttagtcgaccaaaacgtcatcctaccaaaggagtctctcaatggataatcatactagaaaattactcggattaacagataaacatttattttttgatgaagaatggctgattgaaaaagaatataaaggcgttcaagcgcagtttattaaaggaaaattggatgactcttcttcctattgtgaacactgtcgatcggttcgtattatccgcaacggttcctatacgacacgcactcagatgttgaaagtcaaagaaaagttaactattttagaattaaaacgtacccgttttctctgccatgattgtggaaggaccttttctgcgaaaacggacttagttgatgaacatcatcaactaacaaaggaactgaagcaggtgattctcatggaactgtacgaaaatcaatcacgtaaactaatcgctaagaagtacttcgtctcggatgggacggtgacacggatcttgcgtgaagcaacgaagcattaccagccacgtatgaacttccttccgacggtgttgtgtatggatgagttcaaatcaatgaattctgtttctggttccatgagttttatttgtgttgatgggacaaccaatcagctatttacgatccttgaagatcgcagactttacaaactaactcaatacttcctgcgctttcctagaaaggcccgtttaaaggtcaagtacctagtgatggacatgaatgccagctattgtcagttgcttaaaacagtctttccaaatgcggagatcgtaactgaccgctttcatattgtccaacacatcaatcgcagcttcaatcaattacgtgtccagatcatgaatcgttttcgaacctcacactctgaaaatcagaagaagtaccgtcggctcaagcgatattggaaactcttactcaaagattccacgacattggagccactcaaacggcattatcatcgactgtttaaacgaccaattagtcaaacagaaatcgttgatgagctgttaagctacaacgaagaattgcgaactgcgtatcatttttgtcaattattacgctattatttcgttaaacgaggtacggaaggctttcaagaaacccttaaacaatttcatctacgttacctcagtcgtttaaaaagaaattcacgatcttccatcgctaccaatcgggtatttcaaatgcctttaaggtgtcccactcaaacggcgtcactgaggggctgaataacaagatcaagctgattaaacgaattgcgtttggttatcgcaacttttataactttcgggcacggatctatttacaacggctctatactttttgatgttggtgaacttcaccaacatcttttttgtataaaaaaatatagaaaagacaccctgaaatcctttagaattaatttggctaccaattcataggaggattcaagatgtctcatactcagcttatcaaagataccctaaatattctagacctaaatatctatttcgaggaaaattgtttaactaaagaaaaatacaaagggcaaatttgcttgatttacaaaggaactcttctgtacaagccagaagagtgttcccattgtctttgtgtcgtcccctctaggatcattcgttgggggacgacaaccgttcggttgttactgaatgatgtgtctgagtatcgcacttatctggagctgaagaaacaacgatttaaatgtaagtcttgccaaagaacattcgtagcggatacctctgttgctgaaaaacactgtttcattagtcaaaaagttcgttggtctgtcattgctcgcttaaaagagaatacttccatgacggaaatcgctcgtcagaaaaatatttccacttcttcggtctatcgtgtcatgaagcgattctaccgcccattgaatcctttcaaacagactttgccaaaggtcttatgctttgatgaattcaaatcggttcgaagtgttgccagtgcaatgagttttatcatgatggacggacaaagccatgcattattggatattgtcgaaaatcgacgcttgccttatttagaacgctatttttctcggttttcattagcgactcgtgaagccgttcaattgattgttattgatatgtatgcgccttatgtttcgttggtgaaaaagctttttcccgaatgctcagttgatcatcgatcgtttccacatcgtccaacatattggcagaactttcttgaatcatcgagtgaaagaaaccacggtacgacttaaaggaaattcccactctcaacgagggttagggaaaaaattgaagcgctattggaaactcctacaaaaagaagaagcaaagttaaactatgaaaaacgggtttggcgtgccagttttaaagattatttgactgaaagtgagattgccgatcgactgttagctgcttgtcccaacttacgccaaggctatcagttataccaagacattctttatgcggtaaagaaaagagatcagtcactatttgaggattgtttaactagagacattagcggtctgccagaaacctatacaaccactttacgaacgtttaaaaagtttctgccacagatccaaaatgcgcttcactacagctattcaaacggaccattggaatgcttaaacaaccacatcaaagtattaaaacgcaatgcgtacggctttcgcaacttttacaatttcaaactacgaattatgattcgtcatggcaaaacatttttaaccaaataaacagaacagaaagaggttttcttctttctgttctgtccaaattattctaagatttctctttaccaacatcatttgacaaagagcctttacaacaaggtctgatctttgaaaactaaaaaaatatgcggcgcacagaacgcgccgcatatcggtctaagttttattcaaatttgtcttcaccaacacgatttgacgaagagccaaaaaaagttacgacagttctatgtcgtagctctttttttcgaataaacggtgttcaatcagctgaccctcggtattagctcaaaaaacggcaaaatatgaggaactatttttcacaattaaaggaaaaatgtatatgtggggaaacatagttgatttttccttaatagtaacgactaccgtggcatgtttatctgctagttatttgatatttccttcgtgatcacgttctacttccatcattgtgattggtaaatagcccaattctttgacaggtccttcttggatttcttctgtcatcatgtagtctaagaatttttggacttcaggggaaggttttccgttcgtgtacatatgttcatatgaccagattccccagctgttatctgctacattctcttcttttggttctacaccgtcgatacttagtgcttgtgtggaatcatcgagatatgagaaagctaaatagctgattgctcctggtgtttgacttaccagctgccgaactgttcctgatgaatcttgttcttgggactgcacaggggtagcaccatccagtccccatttttcgaatgtcgcgcgggtaccgctgccgtttgcacggttcacgacgttgattttttgatctttcccgccaacttccttccagttagtgatttttcctgtaaagatatcaatcaattcctgtttggtgatatctttgacatctgtatctttattgacgattggtgccatcccgaccactgctactttatgatccactaattttgaagcatcaactccgtctctttcttctgcaaatacatcagagtttccgatagtaactgctccagcttcgacttggctcaaaccagttccgcttcctcctccttgtacagagatttgataatttggattttcttgtacaaagctttcttgtgctgcatcgactaacggctgtaatgctgtcgaacctaccgcaacgatttttacttgttcatttgagtcacttgaattattttgtgtggcagagccatctgtatttcctgatcctgagccgcatccggctaaaagaattcccatcatacctagagtaaacaatacttttttcattttattgctcctttcttatttacaactaaagtttatcagtcgactgtaaatccctcgtatggttgctgtaaaaatatagttaagttatgtaaaaatcatgtaaacgtttttcgcattctttacataataataaaaaaagcatatgagaaacatgcattttacgcagctcatatgtttttttactgatgatccaccatcaatagttattttttatagatacagatcgttcactttttatcctgatttctgtccagaagtaaaaaaatgttgcaagaataaatgaggcaattactaaatagaaccatggtttgatcgtcaagaaatacatggaggaataagctaaatccttcaatccactctcgctcaaaccattagggccgataatcaagcgaggcagcaaagaaaacgtagatgtaaatactaataagcaagaaaagtaaagcagctgccaattgtagtgattgatcagagattttggtaataagagacctacacttatcactaaatagaaaacaatcaaagctggaaaattcctagaaaccacaaatccgcttccttggatcaggcctaatatctccgcaccttgtacaacagcatttacccatgtaaaaggtagcaaaacgataggaaaaaaccaaaaaaataaataaagccgatcgattactgcttttcttctcattaacgttcccccaaactactttttctctcatcatactatacaattttctatctaaaaaaattagggggaaaaactttttttttagagataatggcatgagagtttattcatttaatctagaaataatgaaaaagtaattgattattgcaggattcaatttacaataaaactaacaaaataataacacttgttaggtggtgatgaaagatgataaaaacttgctggaaaaaccttccgttgcttttatcttttgttccttatgtgcatttcgccttactgcttgattttcgttatcattccgtaagcgggttcatcacattgatatttttatctctttttgctggatattattttcaaaggaacaggcgtattatatctttattcattgccaatattatatctactgtcacttcctatttattttgcgccaattttactgaatggcgttacttctatcatcctttaaaaccgacccagctgatcttgcttcttgcaggtatttacttagttccacaaatccttgggtcgttatgggcggtagccttatcttataaaaaagctcggcatccataaaaacaaaccatatatgtacaaagagaagctactttcttctttttatacatatatgtttttcttatatcaccaaaactatcactagtttttctattttttacttcttttcttctctccaaacactaaaaacagttgtgtaataattgcagcaataatgattccaataatagatattgaatttgaggtggaaacatctataatattcaaagaataaagtgttgaagaaagtaaactaattaaaacaattcctccataaaaaatagtttgtgagtatacccaattttttttagaagacaaacttcgtttagttctaaaacctatacttgaatttctactcctatcaaaaatccatatattcagaagtaataatatcgctactattaagataaaattactataaaaaagcaaaatattacctcctaattaaatattaaataccgaaaaaattatgtttagataataccatagttaagtttttccttgtgatgttttaaaaagagtcaagtccacaatcttgtgtaaaagttcaacctcatcaaaagcacaatgttttgcgttgtgaacctaactgccatgcctttctttctgaggagagaggtcaggagcagtagcgcagcgactcttgatgtctctcctcagaaagaagagactcgcacaggttcatggtgctaaatgttattcgaattaaattctaaatattttcgtggagaagccagccactcagtgtctttttccatcaaaagtgttccaattatccgagtgatggaattgatatttggaaaaatccgaatcactcgttctctccggcgaatctcttcgttcaaccgttccaacacattggttgtacgaatccttcggcggatattttcaggaaaagacaaaatttgaatagcatcttcaaagccgttttctaaaatgtcgcaagcagcacttaattttgaatcacaaccatatttttccaagaagtgctcttttctttcacgtgtcaattcaagttcagaggctttaaagatactcttcaactcgtcttttacatcagaagaaactttctttggcagcttatcaaaaatatttctcaaaaagtgggcttggcatctttgccagctcgcacctaaaaagttcttgcgaacagccttaactaaccctttgtgtgcatcagaaatgaccagttttacaccgaacaaacctcgttgaacgaacgattgaaaaacggtatcccaattatcttccgattcgccgtcttgaacatcaaaaccaagaatcgtacgtcgtccatcagaatcaatgccgataccaatatatacaccttttgagacaatacgatgattttcccttactttcatatacagggcatcacacatgaaaaatggatattccgagccttctaggctccggtttctccactcaaaaacaaatggatccaactgtttcatcagatttgaaacgaatgatttagaaacagtcgcaccatccgttagcagttcaactgttttagttactttgcgagtggagacaccagaaatgaccatttcaatcatggcagcgatcaaagctttttcgcttcgctgatatctttcaaagatagtaggactaaacttaccgtctctggttcgtggaacatgaagttctaacgtaccaattcgagttgtaaacgaacgatcgtagtaaccatttctttgtgattgccgttcttctgaacgttcataggcatttgcctgaatatattgatttcgttgttcttccatcagctgattaaacatgatagtcataagtgtttttgcggtatcattcgcaccgctttcgtttataattgcttgaatttcttcgctttcaaaagtaaaatgtacttgagtcattgatatcagtcctattcgagtatgttttctgcaaaaaacattgtactcctaactgagatcaatggcttttttgatgcttcacttttacacaattatatggacgtaatcgtaaaaagatattttagcagcattatcgttacagtgcatagttaccatcggcgttatgactatataaagtatactttcgttgatccagaaaggtatatagattaaaataagttacctaaaaaggacaaatacaaattttattatcttattcacagtaagaagataattttaagattgcgaaatacgatactatttgtaatctatagtatcagtcctataaaataaacatctaattaattactctaaatcctaattataagccttttttctcactttttttcaaaaatatggtatgcttcttagtgaattcaaatataaaagagtttaaagcgtaatacacttatggggaagtggtttggggtgcgctttaaactcttctttattattatctcacagcatgcttaaaaggtctatggattaagttatgtaaaaaagtgcctctttaaacgtcctaaaatccaaacaaggatagcataatgtacactatcgttgatccagaaaacaggtaaataaattttgcaaaagcaataagttaaaaacattacaaaaaagacaaggatatcacatcaagaaaaaatggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacgactcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaagagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcgctaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagccgaaaaaatgttttgaaaatatctttgcctttttgtattatatctatattaaataatcaatcacaacacattaactaatttatatatttaatttgttgtttttctataattggataactaattaacttatgactatctaagtcttctttattcatatcaattgcagtaatttgactgtcttcatatgttcgataataatagattcctttgtcaacattgcaacaagaagaataaattgtatattcatattttccatcacctacatcacacaaacctttttgttgttctactgaacctaagatatggaaaaattgactaatactttctgactctgaatctccagatacagaattcagcttcgtaaaagtcgctttaacaaaacgagatactgaggataaatctccaggcaagcctatccctcccataccgcggctataggcattcaaacttatttgatttgaaaaattatttttaggagtttcactcgataagacacgataattgtttaaattaaataattgatagtcaaatgaaggattattggtaagaacgcccacagggttatcatatatatgaagtccatctttcatactttcaatgacaattgatttttctttatcagctaatagccaatgtaaaggggataaaggaagttcgtcactataatttatatttgctaaattgatattttttaacaattttttagcttctcctactgttgagcattgtcctaaaatccaaggaataaattcaaaaggagatacattgtctttcccttcttgtatttctttataatcagcatacccagaaaaatttagcccagccatactcaatcctttttcatttgtcgcatcgtaataaagagggtagtcagctataccagcggcaataccaatcattgcataatgagtatccaaatcatttacctttcgaaaattcaacttataatttcttggagtaacagtaactacttcattgtaagatatttcataatcaaaattccttccaaaataatgatcacttgttacataagtaatagacgtacacatagtttattcctcctcgtaaaatatcatttgtctaatagtttttattcaaaatgtttctagattataaaatttattgaataacacattcctaacggaatttgtttcgatattgtgtgatttctcagagtacaatggatgtatggaaaggatccaacgggaatttgctatttcctcctgtagcgtttgtctaccctgtttagtctgttacccgaaccactgttatcactaccaactcattagctgtttcgataatggactagactttcaaatagtagtttggaaggcagcttctagctcttttatcaccgtattctattaggcgaggttgtggctatacagtgagtttctgggaaatcccacagtatcgaagcattttccaaaatttatatcgaaaggaggtccttcttccatgaaattatttgtcggtattgacgttagctctgaaaaactagatgtttgttttttaacagacgacaatcaattgtctatcttatctgaaatctctgttgccaatgacatcgaaggtgcttcattcatacgagaaacaattcttgaattcaataacagctaccactttgatcaaaattgtgattggcatggagtcaacgtccatgtacagcttccatccttccatgttttttcatgaagatgagaaactaaagaagctcaacacacttgtaacgattgaaaatccttttcgggtgaaacaatttagtcgcatgtttgatgagaataaaactgatcgaaacgatgcattaagaatcgctgatttaacttgcgtattcaacgattcacaacttcccctatcaaagaagagaaatacatggccttacagcgtttaacacgtactcgctatcaacttattaagcaattgattcgtacaaagcaacattttcttgaaaatctaacgtacaaatgtaatacgcttgctcgagaaatgcgagacgaatcgacgagtctttttagtgcaaccctcatttcactcatgacggaagatttcacattggatgaacttgctgagcttcctttagaagctttctgtgatttacttcaagaaaaggaaaaggccgtttcaagcaaccagaaaaaatcgctaaagcaattcaacgtgcaattaccatgagttaccgcctaggtgctcttgcacaagaatcaattaatgttgttttaagtgttctcgtacgagaaatacgagcacttgaaaaaaatatcaaagaattagataaagccatcgaacaagtaattgttgtcattccagaatatcaatgcttaaccagtattccaggcgttggtaaagtctatgctgccggtttaatcgctgaaattggtcaaatcgaaagatttgaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaggttccaaagcatcaacacaaacgtgcactcgtcctaaccgcaagaaaatttacgcgtctggtggatacgctactacgtaaacaccaactctatacgccaccaaggagtgtgatagagaaataacaatccgttattgacgcaaatccttgaatcaacccgaaaaaaatttgattttgatcgggtctagtttcgtgcgcttcaaaacatattactcaataaagaaaatcttaaatttcatcttgacttatcaccattagactaaatatttttctgtccacgttcattttactccaaagttttcctcatttcaaaagaaaatcacagaatacacgaagaagcgtttctatttgtataaactatatcaaagttctatacttaaattatcaaataaaaaggacgtgaagataaatgtcaaatttagaaaacaaagaagaaaaagttgtaaacaaaattgtttctgttgtcaataaactggataaagagttagacgaacttgatacgttatctgaaaatccagaaaaaaaacataacctaaaaaaatggttagttgaacgaaaggctattcatgaaattaaaaaaagttcttcatgaagctgataaatatgaaaaatatgatgaaaaagaacttgataaagaatttaaagaaatcaatgacttattactataattgatttatacgactcatttttgagtcgtcagactgcaaacaacactctaaatttaggagtttgtctacagtctgaatagattttaaatttattgtccataatgttattatgaatttatagcattaagaaaagagataagactttacatttttttaggaatgtaaagtcttatctcttttcttaattgtacaattagtattatctgcactactttctaattaaataaatttttagttattaacttgattaaaatcagagataatatcatttaattcagtttgaagggttgtaacgattaaatggaaattttcttcatctgttttattatatggggatgttttcgttatatataacaacttttctttttcaattttcattaataactctgtcgaagtctgtactttatcttgataattaaatgcagacataccactttgtataattgtaattattgctgaagcaattgaaacaatcaatagtaaagacctgtgttcggaagcctgatcaattaatattgggatactagctgataagactatttttataatatttccgataccaattactctattataaaatcgaatttctttttttaatctatcgattgtagaatcaatagattcgataaacgctttttgatccatcattttctctccaatcattttattaaaatcattaacaaaaatattataataggatttaagtaagttctaactaatcacatataaaaataaaaaaacatttgtattttatcaaagttttattatacttgtcaatttgtgtacatcctaaaatataagctatttgtttacttctgtagaatatatactttgttgttagataagttgcacatgtttatagaatctaaataataaatttttatgtaccgcccctcaaagtgaactgaaccccaaaagttgaactatttaatggactgtttccgatattctactggagatagtccatttaactttagttttatccttttgttattataccacctaatatactcatttaatttactttgaaatatctcaattgatcggaatttttctcgataaaaaaactctgatttaagcacaccaaaaaaattttctattacagaattatctaagcaatttccttttctagacatgctttgaataatgttattctcttttaattttttttgatattgtggcatctgatactgccatccttgatctgaatgtagaatcagtgaaccctcagttccctttttttaattgcttgttgaagcatttcttcaatcagtttatatgttggactagttgatatactataactaattatttctccgttaaataaatcaagtataggagatagatagatttttcttccttttatcttgaattcagtgacgtctgtcacccattttttattgggtgtatctactgaaaaatttcgttttaacacattcttggcaatttttcctactgttcctttataagatttatatcgctttattcggatttgacaggtaagtcccatttgggacattaattttctaactgttttatgattgattgtatatcctttcatctttaacgctaaagtgactctacgataaccataagagtttcttgattcttttacaatcgctgtaatttcttgctttatcttgctatatttatctggcttatctaattttttacccagtaataataagttgacttcgctaattgtgcaattgaaagtaatagattcaatttaaattcttttttgagctgaaggattgttttaaccttgatttcttcttgctcaaatcttgttcttgaatcaaggtttctaacttttttaaatatgcgttctctgctcttaaacgaataacttcttcttcaagagactcatctttaagttttttaggaatgtttagcttggaattcatactaatttttctgccccttttttggctctcaagtgaagaagcaccgccttcttcatattgctctatccatttacttagagttctatttgaaccgatattaaattttttagcagtttcttggatagaaagaccatttgtttccatatattctataacatcaagtttaaattttgtagtgtagcttttgccacctccaaccaagccttcccaaccatgatagttataaatccttacccaatgtctaaccagtgtacgatttatttgatatttatgtgcaagatatttgtagccgccttcgttatttaaatagtctgaaactacttttttcttaaaaacaaatgtatatttccgcaaaaaaagcaccccttttaattagatttctagtctaacttttggggtgcacatcaaagtgggagcgtcaataattttgtgtaaataaattgtcctcctgcaaaataattagttactcagtaaacattgaaactaatgtatcggttacctgttgaaaaccttttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatattacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacagtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctcctcaaaaagtgatgtgcaccccaaaagttagactagaaatctaattaaaaggggtgctttttttgcggaaatatacatttgtttttaagaaaaaagtagtttcagactatttaaataacgaaggcggctacaaatatcttgcacataaatatcaaataaatcgtacactggttagacattgggtaaggatttataactatcatggttgggaaggcttggttggaggtggcaaaagctacactacaaaatttaaacttgatgttatagaatatatggaaacaaatggtctttctatccaagaaactgctaaaaaatttaatatcggttcaaatagaactctaagtaaatggatagagcaatatgaagaaggcggtgcttcttcacttgagagccaaaaaaggggcagaaaaattagtatgaattccaagctaaacattcctaaaaaacttaaagatgagtctcttgaagaagaagttattcgtttaagagcagagaacgcatatttaaaaaagttagaaaccttgattcaagaacaagatttgagcaagaagaaatcaaggttaaaacaatccttcagctcaaaaaagaatttaaattgaatctattactttcaattgcacaattagcgaagtcaacttattattactgggtaaaaaaattagataagccagataaatatagcaagataaagcaagaaattacagcgattgtaaaagaatcaagaaactcttatggttatcgtagagtcactttagcgttaaagatgaaaggatatacaatcaatcataaaacagttagaaaattaatgtcccaaatgggacttacctgtcaaatccgaataaagcgatataaatcttataaaggaacagtaggaaaaattgccaagaatgtgttaaaacgaaatttttcagtagatacacccaataaaaaatgggtgacagacgtcactgaattcaagataaaaggaagaaaaatctatctatctcctatacttgatttatttaacggagaaataattagttatagtatatcaactagtccaacatataaactgattgaagaaatgcttcaacaagcaattaaaaaaagggaactgagggttcactgattctacattcagatcaaggatggcagtatcagatgccacaatatcaaaaaaaattaaaagagaataacattattcaaagcatgtctagaaaaggaaattgcttagataattctgtaatagaaaatttttttggtgtgcttaaatcagagtttttttatcgagaaaaattccgatcaattgagatatttcaaagtaaattaaatgagtatattaggtggtataataacaaaaggataaaactaaagttaaatggactatctccagtagaatatcggaaacagtccattaaatagttcaacttttggggttcagttcaaagagggggggattttttatcgttgtggaatatttaaataccaacgcttgtcatgaaaatcttgtgctccacccttagtatttccttctggatcgtttgtcgcacgcatcatgacgtatactttcttattagggaaatcacgcatattgaaagatacatgatagccaacatttcctaaagtattataagcttgatttacgtctggtctataaatcccatcagctcttactctagctagttcttttccagtattgtagtccataatgaaaatatactcgtatttataattagcaatgtgccatccagctacatgcaagtttgcgttttcgatttctccgaactgatcaatgtgggcgtaatttgttccatctgtcagcgtagaatttgcagcacctgctcgagttggatcaattactggtttatcctccgaagtagttggattatcatccgtaaaaccatgagccaaatcataggctagtttttctttacttacacccatttcagaaagataaccgtaaggatctgtatgatcgccccaaatattttgtgttacccataaatgcgatttgattcctggttggttataaggagtgtctaatgttaatggaataccatatttcattgctgaatctcttgccaattcaacgtatactttatagttcttttcaaaagtttctttatcatgtgtatgttgtaactcgatttgcacaggacttttggctcacgaggttgtcctactctacatcttgctgatagatatgctgaaaggaaaacaccaacattatgttttgctttttcagctagaacgagacaagcaggaatacctttagaagatatcaaaggttttttaggtcataaagatgtttccactacacaagtctatgcccatatttctcccgaagtgaaaaaaagatcaatgaatcaactagaaaactatatagaagagcaaataaaaaagcactcaaattgagtgcttttttaagctcactatcactaaaactatcactaattttatttataagcgaacatgtttctatcactgattttttaaatctagcgaaaaacccttatcttaaaggcgttcgttcaattctttggcaaggtcttcaaagcctggcttgcctagaagtgcgaacatggttttcttatagctcatgtagaaaaattttcttgatgatgattttatccatcaattgagattgactgttttgctctcctatgatttcagctatgattgtccgattttgcggttttcttcttaactggtagttgattttcccagtttccatcaactcgctaagcatatccacgactccgccaaatccggtctttttcgtaataaaacctagtgctaccattcgttcatctagattttttgctgtaatcgtcacaccagtaatgagcgagtgctgtaatgtttgggccagctcttccatcccttcagcattggatacgacggaagctgttttgttaataggttcttcgtttatttcttttggttctttcctctccactttcactgtttgacgaaggacatctagttcttgcaagagcgtttcgtattgttcttgggtcagcatcacgccagctactttttcacgattaaatatatatacgccagttcccgcgtctcgcgcttgagcaaatacatccatcggcgatcgtttcacttctgtgatcgaagatgtgggaacttctaatttctttaattccaatggatttcctcctttactaatcgctttttattatagcacagactgacttgttttgatcttttttccaaaggttttatcggtttttgcctaaccagtaattgatatcggtaagaagtctttcgataccaaatgaaggatggtacagatacgttttttgatcttcgttatggtctagtggaaaaaaatgatcgatgatcactagatctgcataccgaggcggcttatttcgagtacatacatgtatagagatccgttttcgatgtcttagcgttttgttcagtaccccagcaagtcttcttgcttcttggtgttcatagcgaaaaaaaaagacgattttcacttcaggagggtggacatctaaataccctcgttcctggagtgttttcagtaaaagcatcccccactctactgcggggtgtgcaagtgcttgttggatcgctagccgaaattgatatagtttatctttggaattgggaaatttttctaatgtttcctgataataacgaacttcttctatcagccggtcatggataccaattacgtaacgaagtcattcttggtaaagtacttttgtcagctttgatttgctttcgctctcaaattcgctattcagccaaaacagcgaatcaagcttttcagtcacaatcgtcaatttccgatagtcttgtgtctcttctatccgtttccaccgcttttcagtaatctggttacagctcaagcgcaaaattgctagataatttttttcttttattggcaaaatctgctcctctctaaatagcaattcaggaaacaattcaaagaatagtgttcgactgtctcctaaaatctcgatttctgccggatcctttctttgcttcaataattggatgaacatctcagaaaaggactgctctccatcatctgcaaaaaaatgcggaaaatctttcaaaaagcaaaacagcagatatcttacttttctttctgaaccaaagatctgtgcttttttataagaaaaagaaaggtggtactcgccaaaccactttctcaatcgctcttgcgtagaacgatcgtacttctgctcgtaaggttcattcaatagcagatttttcagtaaacaaaacgggggtgattggatcagaaaaacaaacaagagataaggttcgctatatccttgatcataaactaactgaacggttttcttatgaagaatcagctgaatgggacagtcgctttccgccaaacgtttcagatgccgatccactgttttaacatcgattttcagttcttcagctaaatcagcttttcgccagatcaaatctttcattagattgattagtgaaaataaattctgtgcattttttgataatagtttttgccatctcatcgatcatttctcacctgatttctaaacatattgtttgatcaaaatgggttcactcctaaaaagataaaaaactccctttctatttatttaaatacgcaaatcttcctcattattttttattttactcaatttaatcgtattctcatttcaaaacgaatgtactttaaaaaaacataataagatcactttgcttgtaggatgtatccccttccattacaatgaaataaatagcgattttatgagaaggtgatgtgaaaatggaagaaaaaatagaagaatccaaacaaaaaatcgatcagttgatataagaattagaaaaagcggtcatcggcaaacgttcaactatccaattgatgatcgtggccctattagcaggtggtcatgtcttattcgaagatattcccggtgtaggtaaaacgttactggtcaaagcactagcaaaagctgtacagggaaccttcagcagagtccaatgtactcctgatctgctgcctagtgatattcttggtttttccgtatacaattcacaatcaaaagagtttgaatttcgtccgggaccgatctttaccacgatcttgttagcagatgagatcaatcgtacgactcctcgtactcagtcagcacttttagaagcaatggccgagaatcatgcaacgatcgacaacaatacataccctctagacaatcatttttttgtcttagctacgcaaaatccaatcgagtacgaaggaacatatcctttgccggaagcacagctcgatcgttttttattccgactacaaatcggttatccttcttttgatgacgaacttttgctacttttggataaattcgaaaaagtgttggataacttaaatgaagtattgaacagttatgaaatagaagaaataaaaacaaatgtggcgaatgtctttgtcagtcccgaagtggcatcttatgccttgcagttagtgtcagcaacaagaagtcatgctgccatccagcttggcatcagtccacgaggaagcctttcctttattcaggcagcaaaagcttatgctttaatccatgggagaaattacgtcacgcccaaagatttgcaggatttagttccttacgtgttttcccatcgcctgattttttacgatcgttcattgaaggaagacgaaaagaaacaaatcattcatactcttgttgcacaaattcctattcctgtgaggtagattgaggtagacaatggaaaaaatcaaagattatttcattaattttgtgttatttctggtatatttcatcattgtgctttttgctcttgtattcaacaattctttaggctggttcttgttggccttttttactctttatgtatcatggagcttgatttcattaagcagctttctaaagaaactttcggttacttgtacattgcagccactcgtttatcgcaaaaaaagtatgcaggttattttttccatagcaaaaaagagaactttttctttacctctccctcgtttacaaatcggcttcccagcaatctttgcagaaaaaaacaagagattttgattcttacaaataaaccgcaagaagtccaattgctttggcagccaaaagaaagaggatgccatgaaacattaactgtcatttttacagcctatgatagtctaggacttttcagaaaaagtgcaaaaagagagatctcttttcctgtgactgttctgcctgctttttgtaagattcaagcagaaaaattacagagagttctggaaaaaaaacagcagctgaacgcgtaccaaagaggtcttgattttcgggaacatcgcgcttatcgtccaggtgattctttcaaccgaatcgattggaaattgtctgctcatactcaagagtggttataccgtgaatacgattatcaagaagaagaatgttctcctcttttttgcttttggggttcgcccagtccaaaatttgaacctctgctagacttgtatttttctttatggcatttgagaaaagaaaagcagccggaacttctgatattaggcaaccgcgcctttcatggcaaagaccccggtcatacctattttgcttctttggaagctggcgatgagaaagcttttttcgcacacttgaaaaaatatgcaaaaaaacaaatcgtcctctttgttcctgagaattctcctgaagtctcagaagctattgaaacattgtcaaaagatcgaacggtttatcttgtttatttcgtagaaaaacaactcatggtccaagaaaaagacaagatatgttcattgccaggaggtgaatggattgacgattaaacgggaaaaatggctgcgtggcgtttactcctttgtgatactaagtgtaggtgctccgatatttgtagtagctaatcaattgcaaaacagctaccttcttatcctaactattggtgtcctatgccttattgtctgctgtattcctaaaaaatgggtacgtttgctgctttctttgccagtaatgataggttgtttgtttttatattttccttcgaagacattttccatattatggatcttacagtttttttcgtcagtcacagaggaattcttccatctatcccaaggtaaactttattatttgccagaaaagacagctttttttctcataatgttgctgatctatttatttattacattgaccgtggattacgactattggtacgcaccctttctttctttgatggcttacttcatgatgcttaccgtttttcggaaaaaagatttactgtacgaaatgattgcggtagtaactgttttgttcgtgtatctggcagcaaggcaatttttctccatccggttgttgtcgggaaacactcgattccagtcattgactacagttctgcttatttgtttcttaacttttagcgctatcttgcctttatatcttccgaaagtacaccaatctctcgaggaaacgagtgaaccgatccgagaatatcttaatgatgaagggctttatgacacactccatgagtatcaattaaccggaagtgcaagaacaggcttcagtgagaatgatgaacagcttggtggacctttatatgataatggcgaagttgtttttacagcgaaccaaaaaggaaatggctattggaagatcgaaaataaaaatcattacaccggttctggatggatagaagatcaggacgcacccatccaaccaatccaagaattccctgttgacatcacgagctaccaaaccgttatagaagacaaagaaaacattacattgaccctaaaaaaacaagttttcttaccttatccttatggaaatactaccttgactgatttttcattagctagtggacaaacgctttactatttgcctgaaagccagcgattcattcctgtcccgaatgaatcgacacgttctgcaactttacaaacagaaaggttagtttttacgagagaagaattaaaaagcagtcagttaaaagctgatgatttagaaaatcagcagacaaatcttcaattgccaaaaagtttgcctaaacgtattgaggacttggcggtcgaattgaccaaaaatgaagcaactttaattcgtaaagtcgaagctgtctaacagtatttaaaaacaagcggaaatttccgctattccaaaacggataccgggcatactccaaaagaacacgattatgtggattatttcctctttgattcaaaagtcggctattgtgacaacttttcaacttctatggtcgtccttcttcgaacacttggtatcccagctcgctggacaaaaggttttacaaatgggctcagaacaggcacagataatcaagggaatgaggaatacagcattctcaatagtcatgctcattcttggccagaggtatactttcctggatttggctggcttccatttgaaccaaccccttcatttgccaatccaatgggttcacaaccagttgctgaaacaaccgaaaccgtccagcctgctatcgaacaaccaaatgaaagcgaaaatatggcagaaactatttccagtgagagatctgaggtcattccatcagaagaaacaacactcacaccagcttataaaatcgtcttattcagccttggagtgtgtttatccgtcttgttgttctttctattgttattcagaaaatctctgcgctggacaagttatcttatctatcttcatttttttgcttctactaatacgattgcatatcaaaaacttcttaaccctttggaaacattggtaccgcgcaaacccgcagaatctttgcaggaatatagcctgcgaatagaacaagaattcaagctagatctgcgtttcattcgattaactactcaatatgaagcagaaatatatggacgacaagcagatccggtaaaattcgataaaaaaacctatttagaaataacgcatataataagaaaaatggtatacaaaaaaattctgacaaaagggagccgcttcaaaaaataagataaaatttctggagaatctacttctggaatgccgagaaccagctgattgagtatcgattactcgaaaaaaaggttgtgacacgttttttgtcacaaccttttttcattattatctgattttcaatgtcaaagcatttagagctacaactaccgtacttaacgacatcaagacagcaccaactgctggacttaatatgataccaattggcgcaagaattccggctgctagcggaattgcaagaatattgtaacctgccccccaccagaggttctggatcattttctttcgcgtttgcttggctagatcaagaaaatgcaaaatatcttttggatcgctgtttgtcaatacgacatccgcagaatcgattgcgatatctgtccctgcaccgattgccatcccgattgaagcacgggctaaacttggcgcatcattgatcccatcacccaccatgattacttttttcccttggtcaaggtatttctggacaacagcttctttatcatctggtaataaaccgccataatattcttcgatccctaaataatctgctactgcttgggcagcgtttttattgtcaccagtaagcatgacaggagtgatttttctttctttcaatgttcggataaattcttttgcttctgtttttactacgtcacctaaagcaacgattgcagctagatgattttctaaaatcaggaagctgatggtatttccttgttcttggtaaggtttcaataatgcttgttctacgtttaatccgagacgctcaacttctttttcattaactattttcacttgttgttttttgactgttgcctctagcccgactcctgaaagattttttagattttcagcttgataaggcttgatttcatgttctttcaaataattcataatgccaacagccaatggatgattggcattcgcttccaaggctcctagatattgaaggatttcatttttattgaacgcatcatcaagtacttcgacacccgttacagtaaattttccttctgttagtgttcctgttttgtccagcatgatcacatctagatcattggcttgctccagtgcattgcggtttttcaaaagtaatccgtttttagctgctattgatgtggaacgagcaacaactaatgggatagctaaacctagagcatgaggacaggcgatgataaagactgttaccatacgttctaatgcattaggaagatctgtcaagaacaaccaggcgatgaatgccaggatacccacaattaatgcgacataaaacagccattttgccactttgtcagataatgactctagcttggatttttctccttgtgcttttcgcaccatttccataaccttcgctagataaccattttcaccagttccagttacttcgatttcgatcgttccatccccattgatagaaccgccaatcactttgtcattggcttgttttttgattcctcttgattcgccagtcacagctgattcgtcaacaattgtttcacctttcaagattacaccatctgttggcattttatcaccagaccggacgatcaaacgatcaccttcgtttacttctttcaatgaaactgtctcttcttttccatctttcgtcaagcgtttcactgattctggcagtaattctgctagtttttgtaaagcattgctggcattcgacacagcattcatttcaatccagtgacctagtagcataataacgatcaaagtagccaattcccagaagaaatccatgacgtgtgtatgtggattgagcagatttgcgataaacgaatagacactataaatatatgcaactgtaatccccatcgcgatcagtgtcatcatagcaggacttttttgtttcaattccatcttagctccacttaaaaatggctgaccgccatagataaatagtatagttgctaagatcaatacgagccaatcagaaccaggaaacgttacttgaaatggaaattccattcccatcattggtgaaaaaagaatgattgggatagctaggataagcgatagccaaaatttttgtttgaaattccccatgtgcatggaatgatccatgccgccgtgttcgtgatccatgtgcatcgaatggtccatttgtttgctgtttgctatatctccatggttatgtcccatgtgcatggaatgatccatctgactatggtcatgtttcatctccatctgtttttcatgagattctgtactttctttgtttactacttcttttttatgctcatgttttttctccatatcgttcccattcatttttactccatcccttctcttactttttcatgtgtcgatttaagcacagggagttcaacaatacactgacggaactaaacgccatcgctcctcctgcaatgattggattcaaaaagcctagtgcggcaaaaggaataccaatcgtattatagacaaaagcccagaaaagattttgtttgatttttctcaatgtcaacctagacaactcgattgtttgtgcaatggatgccaaactgctattcatcagcgtcacatcggctgtttccatcgcaatgtccgttccacttcccattgccataccgacatcagctaatgctaaggccggtgcatcattgattccatcgcctgccataccgacttttttgccatctttctgaagtttttctacgtaggctgctttatcctctggaagtacttcagcaaagatatgctttggatcaataccaacttgtttaccaatcgtttcggctgccagtttgttgtctcctgtcagcataaaaacatctaatcctttattctggagctgcttgattgcttgtttgacttctagtttgatttgatcagccacggcaatcaacccgatcacttgcttttcatcagctaaaaacatgactgtttttccctgctgttctaattctaacgcgtgttcttggtattcatcaaatgataggttcaattcaattaatcgtttacgtgtacccgcaaaatagcgtactccgttaatcgtaccgctgattccagcacctgggtgggctgtaaaatcaatcatatcgtatgttgctgcttcttgcagttttccgtattccacgattgctttacctagtggatgttcagaagcttgttctaaagtataaaaaatagataggacttctttagaaccgactagatctgtaactttgggctttccttctgtaatcgttccagttttatccaaaacaatgctgtctaagtgagcagctgcttctaatgcttctccgcctttaattaaaattccatttcgtgcaccaacacccgttcctaccataatagctgttggagtcgctaaacctaatgcacatggacacgcaatgactaatacagagacactatggatcaatgcgagttgccaatcaccagtgatcaaacctgtagctatgagcgtgataaacgcgatgactaatacgatcggaacaaaaatccctgagatccgatctgcgattttttggattggggctttgctcccttgagcatcttccaccatttgaatgatttgcgctaatactgtctgcttgccgacttgtgtaacttccatgtgaagtagaccattcgtattgattgtcccgccaaagagcgtgtcatccggattcttttctacaggaagattttcaccagtaagcatactttcatctatcgcactgcttcctgaaataattcgaccatctgctggaatctgctcaccaggacggatgactagttgatcaccaacgactacttcttcaatcgctaacgtttcttctttcccgtttcttatcacttgggcggtttttgtttgaagagacatcaattgtttgattgcattacctgttttcgtttttgctgtatgttccaaatatttgccgagcaaaatcagcgtgatgatcatactgctgctttcaaaataaagatcttgggggtgtccacggaaaaatccgttgtaaatgctcaatgcaaaggcagccgatgttccaattgctaccaatacatccatatttggtgctttcgtcttgattgcatggtacgcacctttataaaaacgagcaccgacataaaattggacaggagcagacagcactaactggacgattggaaaatgaaaaaagtgaacaatcgccgcatggcttcctaacatcatagcaatcattgacaacatcaacggcaaagtcaaaaccgtactcaatataagatcgaatagcatttttttcaaatacgcttgcttttcttctgcaattttttgtttgtgggcttcatcgtacaaaattgcaccatagccgatgttttctacgctttggattaatttttcagtggtcgtcccttcatatttgacacttgctttttcagtggccaagttgactgtggcattgaccacaccaggttgtccgttcagctctttttcgatcctagcagaacaatttgcacaagtcatacctgtaatgacgaacgtatccattttggtttctgctgttgccatcaaatcacctctgctttataacccaatccattgattgcttgacaaatcttttcggattgaacttttgtttcatcaaacttgaccgtaccgtttgcttttttcaaatttactttcactttttgcacgccgtcaagtgcgcttactgtttcttctactcttgctgcacaatgattgcagctcataccttcgattgaaaattgttgtttcattttttcttcctcctattgatgttgtttacattcacattgacctgggatacagttacattcgatcgtatctactggttgcttttgttccagttgtttcaaaatctcattgatatcttcttgagtcaaagtggcttcttctactagatccgcaatcgtctctccaatcctttttgcacagatatgggaaaaaagattttccgtcgcactgcgaactgtttccatctccgagacagctggataataaatgaatttttttccttcttgttctgtccagatcacttctttttttaccaaacgacccagcaaagttttgatcgttgctggtttccaatccatcgaatcagctaagatctgcgtgatttcttgggctgtcgtctgtccaagtgtccaaataacacgcatgatctcccactctgaatcactgatctttactggcgttttgactttttccatttatttcacacctttcgtttacaaatgtaatcattatcttatgaatacagattacacttgtaaacaaaaactgtcaattatttttgctctctattttcaatttagttaaaaattcttgtttctctcgtcttgttttaaggatgatcagtttatttcttgcattagctacttggatcagctgctgtattttcggttcattgttttcttcaaaatgccagataaaagataaaaattctaagtattccctgtttagtttctccgaaaatgattcaggcatatctggccgagattttttgtttatctttctttttagagaacgccaaactactcggtagatggcgagataacgcggcactttaagccaaatgatcttatctgcttctttaatcctttcctctaatgtagaagtataatttccttcaacgatccatgacggattagataccataaacaattgctgttcttgcaaaaaccacttttttgcctgaatactgtagtctgttgtatgccataaaaggtctagcggcagtagcggaaagtcggtgatttctttgatcttccttgcgagggtcgattttcccgacccactttgtccaatcacgatgatcttcattcttctccctcacttctctttggaatttggttcgatcataccacttataacgccgcaaaaaaacaagggactgtgacaaaagtcgtgtcaaagtcccttgtttcgaataaaggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcgctaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgggacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagcccgaataaatggtgttcaatcagctgaccttcagcattagctcaaaaagcggcaaaatatgaggagctatttttccgtttgtttctctaatactcaggtcaaatcgctgattttacaacctcttccttaaacggtgttccaaagcttgcatctgcggtaataagcccagccaaacgaaaaatatgaggggctatttttgtttggctgttcttattacttgatgcaggacagctttttcacaacctctgattcacggtgttccagaagtagcttcttcgaaaaacaagccgaaacttcacaaaaatttgagaagcaattttcgtaaattccttcttatttcttgaagctgaccacttctgtcacaacctcttgtaacaagtatttctattttaaggctgaaccactgtttctggttcagtgatttctttgtttttgtctcgacgagcaattgctggcaagatcatacctaataagatcaagacgattggtgtgatgatattcgtaaataattggaaccaccatgctttaggatcagcagtataatctacttttggcaccattcctaggatacatgcaaacgcagtgaaggcaaagcaccaagcaccaaagataaaaccgatttttggatttttaacaaatttatattcagaattgaatttcttataagctttattcaacatcatatatgccaagaacacccataggtaacgcattggcatgacaactgagttcaagttcgtcaaccattttactaattcattcatatctttgataccaaaaatcggcaacaaaataatgattcctactagtatacctgtcagaagataaccattcaccaatgtacctttacgattacgtttacgtagccagtttggtacaaattctggatccgcatctgctaacaagatttttagtggtgcatcaattgaaaaggctaatgcggagatttgtccaatcatgtttgtcaatgcgtaaatgatcatcaatgagttaccgataccatagtaattacctaaaatttgaaaagcactgtatgccccatttgccatcaagtctttaggaatattatcactagcaaacagcatacccattgcgactgagcctaatacagcacaaatccctaccattgctgctaagaagatcatccctttaggaaattcctttgcaggatttcttgtagagttgacataaggggatattttttccgcccctccaactgcaaatactagcatcgaaacggttgtgaaataactgaaatcaaatgttggaatatatgttttcacttgattcatatgtggtgtggcaaattccatcgttggattgatgaacggtgccgttacagctaaaagaataaataagatcgacatgacgaacatcgctgttccggccagtccgccaatcactttcaaagtagaaagtccttttgttgataaatataaaaaggcaagaaatataataagtgaaataactgctaccatttgtactgacatcgtatttacgatatttccatttccttggactgcccaaccaccagcaatcagaattgcttgaggcttttgtgccaaataaggaatatggacgacccagtaagtccaagcggcatagtatgccagtcgtttattagatgtcgtattttcgacccatgaactgacgcctcctttactatccttgaaggctgatcctaattgtccaacgatcaatgcgtatggaataaaataaatggccaaaatcaatagccaagaggtgacaactgatactccttgctgagcatagttattaactacattccccatgccccaaaccatgttaaatgcaattaacgcaacagtaaaccagcgtaattgtttgttgttcattcgttctctcctttatgataaaaatttgttatccagatgtaatcatattcaatttttaacaaacttacaagacagtgttattttatgtgtgtattcttttatttaatacacatcgttttttcatattttttccatcaaaaaaataagttattttcttttatttcattgaccttattgaatttcaagctattttgaattttctgcaaaattaaaaacattagttattttataatcctatctattttctttacatttttcattaagaaaaggatataaaaaaaagaggacgttcattcgtcctctttttttacatgcaagcttcgcatggcattcaaaacagctaatactgtcaccccaacatctgcaaatactgcatctcccattgatgcaaaaccaaaagcacctaaggcaagtaccaaaatttttatcccaatagcaaagacaatgttttgtttgacgattttcaatgttttctttgctaaatggattgcttctgcaatcttcgatggttgatcattcatgatgactacatctgctgcttcaattgcagcatcgcttcccaatccacccattgcgattcctacatctgctcttgctagcaccggtgcatcgttgattccatctccgacaaatgcggtctttttattgtttctttgtaagatttcctctaaccgctgcactttatcttcaggaagcaattcgctatatatcttgtccacgcctacttgcttcccgatatgatcagcaatttttttcgagtcgcccgtcaacatgactgtgttcttcacaccagcctgttttaattgaaccaatgcgtctacggcatcttctttcaaggtatctgcaataacaagataaccactgtaactttgatcgatcgctagataaagcaatgtaccgatttcttgacttaaaggaaaagagatttcaaatctttccatcaatttgtgattacctgctaatacttgtttgccatcaacttcagctaagatcccttcacctgcaaattcctggatattagttgttggtaaaagcggacctgcgtagccttctaaaacagattgagcaatcggatgtgtagaaaactgttctgcactcgcaatatattgcatgaatttctttggatcgatttttgtatcgatcgtctggatcgaaaagtcacctttcgttaatgtgccggttttatcgaataccactgtctcggtttgcgcaagcaactccaagtaatttgaaccttttactaatacaccgattttacttgcgcctccgataccgccaaagaaactaagtggcacggaaatcactaatgcacatggacatgagatcactaaaaatgtcaatgctcgatagatccattcagaaaacgccgctccagaaacaacaagtggaggtaaaacagctaataaaacggccaatcctacaacgactggtgtgtaatagcgcgcgaatttagtaatgaaattttcagctggtgcttttttactgctggcattttctactaattctaataatttgctgatagtagaattttcataagatttttctacttgaactaaaaatggtttatttttattgataaatccgcttaatactgtttcaccaacatatacagatttagggactgattctcctgtaagtgctgacgtatcgactaatgattctccttcgatgatcgttccatctaacggtacacgttcaccaggcttcacaagtacaaactgaccgatctgcacgtcttcagggttcacggtcatcaatccttccgtcgtctgcacgtgagctgtttctggacggatcgccatcaattcgcgaatcgattttcttgaatgactgactgccaatccttggaaatactcgccgatttgataaaatagcatcactgctacggcttctggatattcaccgatcaacatagcgccaatcgtagcaacagacataagaaaattctcatcaaagatttttcctttgacgatattcatcactgccttcttcactacatcatatcctatcagcagataaatcaataaataccctatcaagcgaattggttcattaaaatcaaataatagcaataaagcgatacctgcaagggaaaataaaatccaggaacagcgtatttctctctttttcatttccatgttcagatactttttccttatctatttctgttactttgacatctggttctaattccttcactactttttttgtttcttgttcaatcgtagccaaatgatcttcctctgcgtcaatcagttagttttccagaagtgaagtttaccgttgcttccttgactccattgatcttctgaactcctttttcgattttcattgcacagttcgcacaatctaaaccttctaatctgtaacttttcattttaatgacctcctcgcctcaacatatgaacatctcttcataactaattataaatgaatggttattcatatgtcaaggtatccgaaagaaaaaatgaaaaacatctgcatcggaaaatttcttccatacagatgttttggcttattctttctttttctcttcgatcattgcccctgctcttatccaacccgcacttgccttcttgatcttgacaggatagcaactaagtttgaagcctgttgctggcaatttgtctaaattcattaatttttcgataggacaatatcttttttcaatccctgcaaaatgtccttcccagatattcgaagctccactacgctttcaaaaatatagaaagagttctttaatgaaaattatttcaactttccataaacagtaatcccatataaataaaagacgtaaaagtcacatgggagaacttatacaggaaaacacatagagtcaggtgaaatacatgtatcccacctgactctatgcgttttctaacctttattattctctttttatacaatttctgcaccgaatggcatcaacgccaatcgagcaagtttgaaagattgcttggcaaaaggtatccctatgatcgtgatacatagaaggatgccgctgacgacatgtgcgagagcaattggtaggcctgaaacgatcagccagatgatattaacgatcaatgacatgccagactggtgataaattacttctttgccaaaaggcgcaaaagaaagggaggcgatcttaaaacattgcataccgattgggatacctatgatcgtgatacaccaaagtatccccgctgctaaccagctaagaccaccgattagtccgccgaatataaaccagatgacatttcctaaacaactcattgtatttctccttctattactgtttttgattaaaactgggcaaaaattgattttattcttctttttttagcttccagcatcaagtattctgcaaattttttttggatttcttccgtattttcttttgttactaatgtgtgttggattagttttcctgatggtcgctgatccacccgttcttctgactgttgcacgtccgcttgcgcaaatccgataatccgtttttcttttgttacagcaacgagcaatagtttattcttatcatttaggtcagctgccgtttttgcttttacgaatgattctggatgatcagtaatcagctgattgatttgaggtaaatcttcttttactgcccaccgtatttccatcatttctcacttttctttcgctcatttttatctccactaaaaaaatcgactgcggcaattgcatctatccagctttgtgcaatgatctcatgtccgccaatcgttgggtggaccccatcttctcttgtatatttcgaaaaaccataagcaatccctaaagcattgaatatgccatctaaaggaaccagcaatgcgccatattccttagcaagtttacgaacaatttggattttagggtctaagtctttacgccagccatgacggtcgtcggttataggaagtacaaacggctccatcaagatgatgttgcagatttccgctgtttgaagttcatttagtaattttcgataaacggattcaaattgctgcgcagatttctcagttccgaatatagcctgatcgctagtattatgccaggtatcattgattccgatcaaaatcgatacatagtcaggttgtaaagctaaacaatcttcttgccagcgtacttgcagatctgcaattttgtctcctcctatcccacggttcatgcattcaaatttcatcgttggatattgggagattagttttccggcaatcaaaagtggataacctttacctagatcagttgcttctgctcggtctcttcctgcgtctgtaatgctgtcaccgataaataatatacgttttttcatttgtcaaaaactcctttttgaataaaacgatgattttcttccttatattatcccataagccctatcaagacgaaagagaaaatatatgtataaaaaatgacaccagcctagtcccttcaatcaattgaatgaacgctcatcaagtgtctagttttttatactttttttcttaacgtgccggattccccttgattccttcgttgtttggtccagagaaatcgatcacacctaagcttccgtcaatcagaccactgatgacgccatcagaacatatatttataggctcatctaagacttccagtaaatgttcttttactaatatctcttctagattgcttgggatagattggtcataactttatctggtccgatgatttcaaggatgaattaaacttacatatggatcattgcatgctgaaaatacggacctactccatcttcgaatgttactattagtttgttttcaggtactagatgctgctttatttcaacagcagaagcatcatcaaatcagatttccatttgaataaccttctttgtatatgtttgattgattgcgatttcgttatagaaccttgtgaatcaaatagcaatttcttttgctttcttctcttgtctgctggaaacttcctttatcccgtattttaaaaaaagaactgcgagagttcgcagttcttttttttaaataaacgttgctctccggccaactcctcggtcacaagtcacaatagtcatcaaacatgaaaaactgttttttgaaattactccttgtgactcggagctgaacggcaggcgcacaacctcttgatataaacggtgttcaatcagctgaccctcgatattagctaaaaaaacggtaaaatatgagaagctatttttccgttttgtttctctaatactcaggtcaaggcactgatttcacaacctcttccttaaacggtgttcaaaagccagtttctcggtattaagccaaatttatgcaaaaatgtggaaagccatttccacaaaatttttcttaatactcgaaactaaacagctttttcacaacctctccactaaacggtattcaaaagcttacatctgcggtaataagtcccgccaattcaaaaacatgaacagctgtttttgcttggctgttctaattacttgatgcagaacagctttttcatcacctcttatggataaattcggttcaacaaacgtgggaatggaatagcttcacgtacatggtcgataccagcaatccaagtgactgttcgttcaaggcctagaccaaaaccagagtgcggaacagaaccgtatttacgtagatcaagataccatgaatattctttttcatccaaaccgtgattacggatttgttctagcaagaaatcatagtctgttgcccgttcgcttccgccaataatttcaccgtaaccttctggtgcgatcatatctgcacaaattaccacgtcttctcttgttggatgtggtttcatgtagaatggcttgatggcttttggatagtttaggataaagacaggctgttcgaatgaattcgcaatgaacgtttcatgaggtgaaccaaagtcttcgccccattcgatgtcatcaaatccatttttcttcagtaattcgattgcatcatcgtaagtaatacgagggaatggcaattttgtataagtttttaagacttctttgtctcgtcctagtacatctaatgcatattcgcaatgatctaaaacattttgtactaagaatgctacatattgttcctgtacttctaaactttcttcttgatgagtgaaagccatttctggttcgatcatccagaattcgatcaaatgacgtcgtgtttttgatttttcagcacggaaagtcggaccgaatgaaaagacttttccgaaagccatagcagcagcttccatgtataattggccactttgagataaataagctttttgatcaaagtaatttgtttcgaatagatccgtagtgccttctggtgcagaaccagtcaagatcggcggatcgattttgacaaaatgatgttgattaaagaattcatacgttgcacgaatgatttcatttctgatctgcataatcgcatgttgtcttgaagaacgcagccataaatgacgatgatccatcaagaaatctgttccgtgttcttttggtgtgatcggataatcgtggctctcgcttaccacttccacatttgtaattccgatttcataaccaaattttgaacgactgtcttcacggatttctccagttactaacacggatgtttcttggtgtagatttttagctgtttggaaaacttcttccgacacttcgctttttacaactacaccttggaaaaaggctgttccgtctcttaattgtaaaaatgcgatttttccgcttgatcgcttatttgcgacccaagcgccgattgttactgtttctcccacatggtttttcgaatcgatgatttgaatttgttccacgtatgactctccttttatattccttgaatttcttcaggattaattttgacttttactctcaataaattgcttgattctgcgtaccgcttcttctaacgtagcgcgatcagtggcataactcatgcggacattttctggtgccccaaagccttcgccagtcacaagcgctacccctgtttcttctaaaagatcttctacccattgtgtgacattttcatacttacacatgcgtagcgtttcttttacattaggaaaaagatagaaagctccttgcggcttttcaagagaaacacccggcagttctgccacaagcggatataacgtattcaggcgttcttcaaaggcgttccgcatttcttctactgtatcttgctcacctttcaatgcttcaacagctgcatattgactgactgctgtcggattgctagttgattgggaagcaacagcgatcattccattgatgatcacaggatttcccaccgcataaccaatgcgccagcctgtcatcgcatatgttttagacacgccgttgatgatgatggtctgatttttgattgcttctgaaatcgttgcaattggagtaaactcattgccattataaactaaacggccataaatatcatcagcaactatcaaaatatcattttttactgcccattcaccgattgcctgcagttcattcttgctataaatcattccagtcggattcgatggagaattgatgattacggcttttgttttttctgaacgtgcttgttctagctgttcaacagtaactttccagctattggattcttcccctttcacaaagacaggaagtccttctgccagttttacttgctcaccgtaactgacccagtaaggcacaggaatgatgacttcatcttgcgggtcaaggatcgtttggaaaagggtatacaaagcaaatttcgctccgtctgttacgactgtttgtgaaggttcatagacaagtccatagtttttcttcagataatcaacgattgcctgtcgaagctctgggattcctgctgttggtgtataatagctagctttcccattgcggattgcttcgattgctgcttcttggatgttttctggtgtcgcaaaatccggttctcccacagtcaaactcagcacatctctgccttttgcttttaatgccttggcctttgccgcagctgccaaagtgacagacggttctaatcgttttgttctttttgataactccatcccattcattcctttaccttttaaattcccttgattgtcttgacttcatctccagattcaaagccaatcaggtaataattcagtttcccatttgtttcttttcctactacttcccacacaggctgatcatcatacatccctaaagcagctttttcgatttggatttcaggatgggccgcagcaattgtctgttttgcttcgttttcagtcagtccctttgtttgatccaatacttttactttttcaccagatttaggaatgataacggcgatttcttttcctttatcatttgtacctgtcagtgaaaagtatgtcttctttcgagtaaaccaataaaaatgatcggtttcctcaagatttgcatatttctttgcgatttctactgcttctttcttcgcctgcaccgccggacgactggaacgcaagtaaaaaatcgagctgatcacgatgaccgctaataaaaatacgatcaagccaagtaacacgcgattaatcgttttttcctttgtctgttttttcttcaagggtcgtcgctcctttatcttcattccttttcattatagcagattttaattatgaaaaaagacagctcctctaacttccttcttcatttttctttaagaattcatggatatcctgatagatttcctccatagctagctctttgatcggtacttttttcggtaatgcatggatgatccgtgcgccatattttgcagtgactagtcttcgatccaaaataagcaatacgccacgatctgtctccgtccttatcaagcgacctaatgcttggcgtaacttcaaagctgctttaggtacggattcctggtaaaaaggattgatcccctctgattctaaataagcgttcctagctttgaccatcgggcgaagcggattatcgaagggtaaacgtgtgactacaacgatctgcaaagcatctccaggcaaatctacaccttcccaaaagctgtcagcgccaaacaatacgcttttttctgacaaaatgaagcgtttcaaaagcttctcccggcttccaccaaacccttgagctagtatttctcgtcctttttctagcatagacagatgcattttctgatagaccttctgcaaaacatcatgagaagtgaataacacaagtattggccgatcttcttgttcgatcagacctgtaagtgctgtctctaaataatcgatatatgcttgattgctgacttgatggacggcaggtgcctcttttggcacatagatccttgcctgtttctcataatcataaggagaggcaatcactttaagaggtgctgcttcaatgccaagcctcttagagagatagtgtcgattagggccgatcttcagcgttcctccaatataaagaatacgatcatatcgaggataccaaacagtcgacggcaacatagccgcttgaaaatcatggagatgaaaaatcatctgctgcgctgtgttcccaggaacgaaccaatggatcaaatgatctcgccagtcttccagccattgatccatcagcaagtattgcttgtctaattgatcaaataggctatataaacttgctaaatcgatccgcatctggtttgtccagctttcttggataatctcaaaagtcagacgcatttgtgactgtagctgctggatctcctgataaaaaagctgcaggtgatcaatggctgtcccagattccagtggcagctgatccaacatctcttttgtcatcatgacttcttctggatactgtccgttaggttgcttgccgctcactaaactcattaatccttctgccatacaaatctgtgcttcgcatagcgcagaaagttcttctcgataaatcgataaccagcgtaaggcttcatgttctttcggtaaatagctttgtattcggtcaaacagctgatttggttcttctaattgctggatttgtttatggaaatagttaatacttaatcgtttgtcatttactttttcagcgatttccggcaaatgatgtacttcatcgatcaacaaaaatggactagctggaagcaatggttcttttcgctgtgtttcttgtactaaaaacgcatgattgacaatcaaaaaattactttgcctgattttcttttgcaagaaacgaacaaagtcttgttcgtaaaatgactgatttcttgctaaaaatccaatacctctgtgcgcgatatctgcaaagaatgaatggttcaaatttgttaaatgtaattcatccaaatcaccagtcttcgtttgcgtcagccaaactaagaccgccatttgatacaaagcatattgtttttgttctggcggttccacaagtgtgcctttaaaacgctgcaaatcaatatagtggcgatagcttttgataattacaggttgtatgggctgatctagcaattgattcagcaatggaatgtctttttctatgatctgctgctgcaaaactagcgaaacggtactgatgacagcgggtttttcaggtgtagccaaataactcaatggcagcagataaccgattgttttacccattcctgtagctgcttcgatcatcaaatcttttgattcatcttttgtgaaatggtcgtagaccgcattcatcagtctgttctgttcttttcgatacatcagtgttttaccaaacattttttcttttgcttgtttttttcttggatatgtccgctcgccataatggacggatgtgaatagttccacttcttttttctgcaaagctagcccatcgacgatttctaatgagggatcaagtggctctggtttttctttcatttcttcaatcacatgataaatgaaacgactcgtatccatacctgtgtgtctacttaatcgcgcaatctgctctaacgtgatgattggcaattttctcatccgttcttcgatcagcaaaagaagttgacccgtcacttcggcatcactatctgcctgatgaggattctcatgaataaatccaaggctttctgacaaatcagctaagcgaaagcttggttccgtcggcaagaaaatttgtgcaagttctactgtatcgatgcctggtatcttcaaactaggaagtccgcatcgcatgagttcatggttcaaaaaattataatcaaaataaatattatgcgcgacaaatatggtgtctgccaaaagattgtaaatcgtttgggcgacatcttcgaaataaggcgctttttggacgcgttgattcgtgatccctgttaaatgctggatttgttttgaaatcttccgccctggatgaatatcgatcgaaaaacgtgaagtgatccgacctgattcaatcatgacgcagccaaattggatgatccgatcttcttttggattcgtcccagtcgtttcgatatcaacgactgcataagttcttggtttcaaaatatcttcctcttctcctgcctctaatgttcttttgaaattatactacaaagtgcagaaaaatactctcatcgctttttaaagaaaatagacaaaaacgcccagacacgcaaatgtctgggcgtttattttttagtataggttaattaagctttagtaacgtttgttgcttgaggtccgcgttggccttcttcaacatcgaaagttactgcttggccttcttctaaagttttgaatccgtcgccttggatagctgagaaatgaacgaatacatcgtttccgttttctgcagtgatgaatccaaatcctttttctgagttaaaccattttactgtacctgtttccataataaaaatcctccttgtgtatcaacacatattttgcaattacttgaatggtgtatatctggaagatgtttatttgaaacaagctaccacagattaccgaacaaaaactactcctatagtatatcataccgtttacaaaaaagctagagtttttcgactttttttattaaaaaaagttttctcagcgattacataaagtgaaaaaccgaactttttttaaaataaacgacatattgttcagttggtgtttttttgctctgatgttcttctttaaactaaaaaaattattctttctgactacttatcggttctgtttcaacggtcgaggctggggaagattctttagtaggtctgatgttctcatggtatttctgatagcctatgacagttaccagaagaacaaggcaaaccaatacgatcaacgagattagtttttcttttttgctcatatctatacctcataaataacaggatgatgtccatcatatttctgagtatgagtaaaagcaaaagctgcagctgtagaatgtaagaaatgccagcaactttcataatcacaggtcggacagtaccaaaagtaaccaaatcttggctgcaaagaccgttcttctgtttcaggaatcgcagaatcaagatctgttgtctgtacataaacatttttgtacagacgtgtgcctgtaataggagaccgctgtgtttcttcagcaaaaactggctgacttgttaaacttagggatagaaacagcaaacaccataacagtctttttttcataaagacctccttatcgataagtttttcccaattaaaatcatatctcaagaacgcccgttattcacattttgttcataaatgatgttttttgtatcataatcgtcaaaaagaggtcgtgaccacgtcacaacctcttttttaaacggtgttccagaagtagcttcttcggaaataagccgaaatttcacaaaaatttgagaaataatttttgtcaatctcttcttatttcttgaagctgaccacttctgtcacaacctcttccttaaacggtgttcaaaagcttgcatctgcggtaataagcccaccaaacaaaaaatatgaagagctatttttgcttgctgttcttattacttgatgcagaacagctttttcacaacctctcatacacggtgtttaatcagctgaccttcggtattagctcaaaaaacggaaaaatatgtgaaactatttttccgtttgtttctctaatactcaggtcaaaacactgatttcacaacctcttttaataacgaagaatcgctgtcagactcttttcatctggcgcatctttttgatccaaaataaacactttcccgccattaatgatcacatcatctgctaatgcattcaacacttgacgccgatcatattctgtttcaggatcttcaccgaaaccatcagctaagtttgacgtagcgataaataaatgtgacacttttccttctttcgcagctggaacgatatcaactaactgatcgatgaatttcttatctaagagtttattgtattcttttgattcttgagctgcgagttcacttgacagcttcttcgccccttcttcgatatctctaaaggatagctgcgcaggagaagcagaaatcgcaacgtctgcacaataatagggatttttagcaatttttttgaacatcgtctgattttctggtaatgcaaataaataaatcggccattgttcaggattttcgaaagaatccttcaagtacgtatcaacagcttggtaatagttgacccaatcgatctctacttcttcatcttttggatttacgccatggaaagttactccatctcgggctccgcctcctccattagaagagaagttcaaaccgccacctgtcagttcagatcccaatgcagtaacgacatcaaccggtgccccttctggtagagatacttcttttacttgtttgttgctgacctcatacaatttcatggagtcgcggttcaatcccaataaataataagaatagttgaactgcccatttttgataatagccagtaaataaggaagatcacttacatagtattgatcgtctaccgggatactcaaacgatggatataggtctggtcagcagttataatgaccgctacactcgtagttgcactacgccaaaacgaaggatctcctaacaaattttcaattttttcttggaacggggaccagtcatgttcggaatattttttctcaaaacgtttctttgcttctttcgcaaaatttttgaatttgatctgatctttttccacatcttgatgggcgacatgcgtattcagcatgatcgtgacgaatggtcctttagcgccttctgaagtcaattgtgtcaataattctttatccttttttgccataaacgtacccctcctaaaaaaatcattcctttgtttctatctaaagtctaccacaacactatttttccatacaataaaacgtatctaaaaaaataaaacggtttctacggttttaaatttagctatttttttaagttatcttcataatttcctcaattatttagccccagtcttcaactattcttcatgaaatgctgataaactaagaaaaagaataaaagaggtggatcttatgcatttgattatgattttcagtttattaagtattatcagtttatttgctttcagcgcttcccgcttattagatgcggaaacacagcctattcctgtaaaagtacgtaaaaacgaccgctaaacttccataacgcgcgttcttatcctaaagttttttcagaaacattgaaactctctcccctctctgataaaattttaatttgtagcgaaacaaattaattacaaggagatcggatatgtccataaaaaaaacacgtctagtcctattattggctagtctcattctttgccttgcttcttttctaccagctgttgctgtgcaagctgaagatacgtttaaagtaaatgcaaaagcagcttttgctgtagatgcgcaaagcggtaagattctttatgatcaagatggagaaaaaaccatggggatcgcttcaatcacaaaaatcatcggtctttacatcgtccttgatcaagtaaaagaaggaaaactgtcatgggatgataaagtttcgatttcagattatgcagaaaatttgagtatcaccccagatttatcgaatgttcctttgcataaagaaaacacctacactgtcaaagaattattcgactctgcaatcatccagtcagccaatgcttcaatggtggccttggcagaaaaaatctctggcagcgaagctaaattcactgaacgaatgaaagaacaattgaaagattggggaatcaaagatgcaacaatcgttaatgcatcaggattgaacaactcttatcttggcgaaaaccgaccagaaggcactggagaaaacgacgaaaatcaaatgtctgctcaagatgtggccatcgttgcccgccatttgatcttggatttcccagaaatactggatgtatcaagtactacgacccaaatgtttggcgaaaatacgcaatcaccagtggaaatggtcaactggaactggatgctcccaggattcgttaattacaaggaaggcgtggacggattaaaaactggtacgactgagcttgcaggtgcttgtttcgttggtacgatcactaaaaacgatcaacggatcatcactgtcgtattgaatgcggacggccatgcggaaaacccgagtgcccgcttcaatgaaacagaccgtttgatggactactgctatgacaattggtcagaaaaagagctcggaaaagctaacgcaagtattcctagtctaaaaaccattgatgtaaaagacggaaaagaatcaacagttcctgttgtgcttaaaagccctgtaaaagtatgggtacgaaacgatatggatactggcaaattaacgatcacgccaacacttgacaagaagcaagtcactgacaatgagatccaagcacctatggataaaggtacaaaaatcggtaccgctacgatcaccttggcagacgataaattaggctatttagaagacaacaatgcaccatcaacagagatcattacggataaaacagtggaaaaagcgaatatattcgtgattggctggcgacgcgtcgcagaatttttcggcaacttgttttaattgaacaataaaaaaaacatctttccatcggaaagatgtttttttgctttttctagtttaaataacagcttttttcatctattttcgttatactgtataagaaaaaggagttgaatttatgaatctaaccagagatcttatctttttagttctctatcttattggggtattctctatcgtttattggcgaaaacagaagaaggatccttccttgttcttttacggcagtacgtggacatttacggtaatcttaacttattttgtcgtgttggaaattttttattcgaccttttattttttgattccattgttgttctttagtatctttgctttttcttatttcacagaaaaacgaaggctgctgaatggtcttttattcaatgttttcctcatcagtttcggcatctacttgtttgtcttgctgtatgaaacgcaaaatatttttcttggcggactgatcgccttgatcacgattccattgctacttgtccttttatttggtatttatggattgattgtttttcttttttggaacggggtcacagttttacgtagagaatcgcattcattagctaatcttttaacgttgatactagccatttttcttacactgtttcttgtttttgactttttcttgttaaaatatttgccgcaatggataaatgctttgtttttctgcgttcccctgatcttgatctatctatttatcgtattctacaactttttgactgtctcattcttgtatcagttcaaccggcctcgatacaatcaagacttcatcgttgtgttaggcgctggattgatcaatggagaaacagtttctcctcttctagccaagcgaatcaataaggcaattgctttttatcgggctcaaagccgtgctacattaaatccgcccatcttattgatgtctggcgggcaaggagcagacgaaaaagtaccagaggccattgcgatgaaacaatatgccatggaacaaggaatccctgaaagagacattcttgtcgaaaccaattcgacaaccactttggagaacatgctctattcaaaggaaatcatggatcagcaaatgaaagggccataccgcgcgatctttagttccaacaattaccacatttttagagccggtctttatgcgcggcaagccaaattgaaagcaaatggtattggtgcaaaaacagctttctactacttgcctaatgcgtttttaagagaatacctcgccatcttgatgatgaacaaaaaaagacatatgatcatttgcggattgcttttcgcaggctccgcattcttatcgctgattactttacttttctaaaaaaacaaggtgtgacaaaacatatgtcacaccttgtttttttctttcattctcttaactattggcaaaaagagtatcccttttttgaccgctacttgctgagcagaataaataccgctgttgcctgaacacataaagctgatcaagcagatcataaagaagtatactgccgcttgtgaaccgaacaattcgatccccatcacaaagcaggcaatcggtgtatttgtcgcaccagaaaatactccgataaagcccaatcctgcaagaaaaggaacagaaacatggagcaaaggcgctagtgctgcaccaagcgttgcaccaatttcaaacaatggtgtcacttctcccccttgatatcccgcgcctaaagacaaaactgtgaagaataacttcccaataaaatcatagacatgtgcctgtccattaaatgattcttgaagtaacggaagactcaatccgagataacgttgtgtttgcaaaatcaatgctgctgccacaactacagctccacctatcgtatttcgacaaacaggatgaggaatccattgtgcatatcgcgcttttaaaaagacgatcgaacggctgaatacccaaccaatcaaaccaaaagcaatcccagcaacaaaaactttgaagaacagcaacatactccattcaggaatcacacccatttggtaatgtagatgagaaacaccatagctttctgtcatgaaatttgcaaacagtgcagcaaagaagctagggaagatcgcttctgttcggactttcccgattgccaacacttctaatccaaataatgttccagctaaaggtgtgccaaatacagaactaaaacccgcactgattccactgataatcaagatttcccgttctgatttatccaatcggaacaaacgtgccgtattatctgctaacgctccccccatttggactgctgttccttcacggccaacagatcccccaaataaatgggtagttatggttccaaacagtgtaagtggaataagccgcaacgggattttttcttctccaccatttccttgatcgatcactaagttgtttccacgactagaaagtccgccgtgatacgcatagagataagcaaaaagcgcaccactaactggtagtagacaaaggagccaaggatgtgatagtcggatatctgtcacaactgtcaggctatttaagaaaaaagcagacaagctccccatgaatataccgagaatcgctgtgatcaccagccacttcagcatatacactaaaatgcgtactggactcggtaattgtttttccataaaaaattcctcctcaataaaaaaacgcctactaaagaaaggggctgtccccagactttagtaggcgtcattagctatctttcgttagcatttaaaggcgaacaccatcacctattcacttccattaaaagatagcatatttttctgtaaaaaacaataaaattatcgttctttctttacacgttcagcaaattcatagaaaggagccaatttcgttaactgttgattacattggtcactatcatgacaaatataattcccctttttcgtatacgtgccatcagaacctgctttcgttgtagaaagaaaaagcgaaacattcgatgttttctgacagattgcacagattcccttatttatcgttggtgataaagtaccgctaatcccttttaatttttcatcttcgtaatagaccatgaattttttctgcgtacctggatcattccagccgatgtacgtatgttcttgcaagtcgatttcattccaagctggttgtttgagttttttcacttttcggaataatttctcgatttgtggtttgctaggctgcataaacggctgaacgatttgcttcagctcctccaatgctctttctgcttgcgcttttgtcagttttacgtctaaaactgtcgttaaaaatgtatcgatttctggcagttcgtgatctaatatgtctcgaatcttttcagctgctagtgcctgaactgtttgtaccgtttttggatcattgacagatgagtacgcatttaataactgttctacttctcttattataaaaaaatattggtatggttttattgtttgttccatgattttaaagtcctttcttctaaccaaagtgcatactttgtagaaaaaagtgatcttctgcaaagtatgtgttacctgaagatcctggactcttttaaataagatacgttttgcatcttatcatcaccccctttaatgcttattattctatgtacatgattcattcgataaataaaagtaaaccgtatcttgaacagatagtcaactgcaaacagaaaaaaggactgtgacaaaagtcgtgtcaaagtcccttgtttcgaatgaatggtgttcaaaagcttgcatctgcagtaataagccgaaacttcacaaaaatttgagaagtaattttcgtaaattccttcttatttcttgaagctgaccacttctgtcacaacctcaatatggtctattattggttttacctgttaaatcgaggattctttcccaaagtaacgttgccatctcttacgcatacttgcagacatgggctgagccgcttctttgactgcgcagtatttgtccacgaatgtcacaatatatccttctttatacttaggcggtgcgatcgttgcaccccacatgtgcttcaaaatgatatctcgctcaagatccgacaaatcggtgattttttctgcattctttacagcaattcttggatggatatacgcatgtgtcccctcgtcaaatttcgtcgtacgccaatcatagtagaacagatcatgcaaaagtccagcacgcgctgttgctttagcattgccaccccatttttttgcgagcagataactatagtaagaaacactgatggaatgctccaaacgagtggaatgaacatgctgtgtgtaattcgctaattttttcactgcttctgtttctaaaagatcttgtacataagacatatattcttcgtcttcacgccatttttctgtcataattatcgatctgccacctttttgaatttcattttcttctgaaattgatctaagtataccaccagtgttcggattattctagtcgctctagataaaatagctaaagcttaatagttccttaatcataaagaaaaatgataaagaacgatccctgctgcgactccgacattcaatgattccgcatttcctttcattgggatatatacgttctgatcagtcaaagacaagatttcctgactgactccctgaccttcgtttcccatgattatagcgaaatcctctgttttttctactttgtctaatgcatgtgcttcttcatttaattctgtaccgtacaccgtaaaccctttgcctttcattatcagggattacatctgccaaatctttttgtaacacaggcaaatgataattgcttccctgcatgcttcgcagcacctttgtactataaatatctgccgttcctttacctaataaaacaccagccataccaaacgcatctgccgtacggatcatcgttcccacatttccaggatcctgtacattatctagtaaaagccagcctcctgaaaaatctggcgtatcttcagatgttaacgtcatcactgctaagatcccttgcggtgtaggtagatctgacatagcggtcatgacctcatctgaaactagaaaagtagaaatctctttgtttacagccagccagtctccccattctttcatacctctctgtgtcacaaaaagttcttttatttctgcatcagacgacgcagcttcttcgatcagatggaacccttccaaaagatattctgccttttcttctctgtatttctttttatgtagtttttttaattctttgattcttggattttttgctgattggatctctttcacattccttcacctcacctgattatatcatggaataggtgcttgagcttgtttcatcctaaaaaaatcggtatcattgatttataaaacaggaaagaaaggtgacgaacatgcgcaaagttaaaatgaatgtccaaggacgtgtccagggcgtgggatttcgctatatgaccaagatggttgctgatcagttaggcgtgaccggaacggtaaaaaacgaagacgacggctcagtcacaatcgaagcaatcggaaatgacgacatcatccaaaaatttatcgaagaagtcaagaagtctccgagcccaagtggacgagtgcagtatgtggatgtccaagaagatccgatgattgaggaacgaaagaaatttgatgtggtgggataaggttgtgaaaaggtcgcttagttttgagtattaaggaaaattttgtgaaaatggctttccacatttttgcataaatttgacttaataccgagaaactgacttttgaacaccgtcgataaggttgtttttgaagcgctttgcctcgagtattaaggagaaacattttcaaaatagcttctcatattttgaaatgtaatgacttaataccgagaggcagctgataaaacaccgtcaataaggttgtgaaaaagctggtctgcatcaagcattaaggactggttgtgaaaaagtcgcttagttttgagtattaaggaaaattttgtgaaaatggctttccacatttttgcataaatttgtcttaataccaagaaactgacttttgaacaccgtcgataaggttgtttttgaggcgctttgccccaagtattaaagacaggtagtaaaaaagctgatctatcacttgcagtgagttcatttgactcctctatttcgggcagaataaaaaaagtttttagttttttaaataagaaagaaacacttggaatcactcttttctttccaagtatttctttcttgattttttgtcttttttcaaaatttttcgctacgaaaaagaaagaatatttatatgaaatttctatgaagttgattgaattccatgcgcttttttagtatagttaagtttgtgtaaaaattatagaagaggaagtattctatgaataaatggaaaaactggttattgggatccggacttgtcagtatcctgctctttttatctggctgtgtgcggatggattcaaacggaaaccctgacacttcaggaatcgtttatcgagtactcgtccatcctatgggccaagcgattacatatctagttgagaatttcaattggtcttacggctgggcagttattgcaatgactgtgatcgtccgtatcatcatcttgccactaggtatcagtcaatcaaaaaaaacaatgatccaatctgaaaaaatgcaagcgttaaaaccacaagttgaagcagcacaacaaaaactaaaagctgcaacaacacgtgaagaacaaatggcagcacaagcagaaatgcaacaagtatatcgcgaaaacggattgagtatgaccggcggaatcggctgtctgcctctattgatccaaatgccgatcttctctgccttgtattttacggctcgctacacagaaggtatccgtgaatcatctttttacggcatcgatctaggctcaccaagtatggtgcttgttgccattgcaggggtcgcttatctgcttcaaggatatatttcaacaatcggtattcctgaagaacagaaaaagacgatgcgtacgatgctgatcgtctctcctgctatgatcgttttcatgtcgatcagtgcgccagccggtgttacactttactgggtagtgggtggtgtgttcagttgtctgcaaacattcatcacaaacgttatgatgaaaccacgtttgaaagcacaagtggcagaagagttgaaacaaaatccgccaaaacaagtcgtcactccaagaaaagacgtgacagaatcggcaaagccagctgacaataaacaaccaaaaaacagtacaaacaacaaaggccgcaacgcaggaaagcagcaaaagcggaaataaaaatatatgacaaaaaactgtagacaaataaaaaaatttctttgttctacagtttttttgttacaatcaaagaaaacgtcgcttttcgaggaggaatgtataatgatgtccaaataatcaatggatagtcgaatggaagaagccaaaatttcgctagatgcacttgttcctaaaaatcatttggtccataaaattgacaaaatattgttatttgattttatttatccaattgttgaatcaacttactcgaccattggtcgtcctagcgttgatcctgtcatcttagtaaaattagtattcattcaatatttatttaggattcgttcgatgcgtcagtccattaaagaagctgaaacaaacctagcttatcgttggtttcttgggcttagtttaatcgataaaattcctcatttttcaacgtttggtaaaaactatgtacggcatttcagagaaaccgattgtttgaacagatatttatcattatccttgaacaagcagttgaagctagatttattcatgaagaaattttgtatatggattcaacctatattaaagcgaatgcgaaaaaacatatttttacaagagaaatggtacataaataagccattttataccaaaaacaattgaaagaaaaaattaatgaagcaagaattgcagaaggcaaacgtccttttggttcaatcattcatcaggaggtggtagaagggaaaattagtgtcgcagatccagaaagtggttattatgtaaaaacagaacaagaaaaacagtttgcttattctgctcataccgtttgtgatgaaaatggttttgtattagatgtcatgattacgcctggaaatctacatgacagccgaatgctcgtgccacaaatcgaacgtgttaaatcatgttgtggtgtagctgctgatgctgcgtacaaaacaccttggaacgccaagtatttaatcgatcgaaaactacgacccatttttccttatactcgacccaaaagaagcaaagaacgttttaaaaagaaaaatttttattatgatccctattataactggtacctatgcccaaatgatcaaacacttcagtttcgcacaactactcgagatggttataaaaaatatgtatctaaatcttttatttgtgaaagttgtctattattgaaaaattatacagaaagccagaaacaccagaaagaaatacatcgacatatttaggaagactacttagatgaagcagaacatttacgccatacggtgtacaatcgcgaaaaatataaaaaaaagaaaagaaacgattgaacgcgtttttacagacgcaaaggaaaagcatggaatgcgctacaccaaatatcgaggcttggaaaaaaccaggtgcatacgatgcttgtttttgccgcaatgaatctgcaaaaattagccatttggcagtgggggcatatgtctttatacccgtggtgctagttaattttttcctagaggaaaatgtctaaacatgttggtaaatcaacaaaaaaacgcatatagtagtctcaaaactcccaagaaatgaggactacatatgcgttcatcaaaatatactgaacattatacagatacttttataacattcaaggaaattatgagaactgtttctaacatataccacaattgtgtaccagataagattaaaaaccgaagaaatactgataaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtgatttatagtatactatgtcaaaaggaggagttagatgaacaatcaaatcacactagcgtatttagattatgatgatctagatgctttacaagttgtaagtgttgtcagtttttatgaatcgtttatcgatggcgcagatccacttgatatgcaaggatatttacagacacaattgacaactgaaatattggcagtagaattggcacagtcaaccagtaaatttattggtattaaggatcatcaaatactcattggttatatgaaagtcaatgatgaaaaagatgctatagagattcaacggctctatctgctcaaagattatcaaaacaaagggttagggcaacggttactcgatgaagcgaatcgttatgctaaaacgaaacaaaaacgttatttacgtttgactgtttatgaaaaaaatcatgcaggtattcgtttttatgaacgtcatggatttaaaaaaatcgggatcaaacattttcctttaggaaaacaagatcgtatttgtccgattttagaaaaagaaatctaaaaaaacgtcctcacttttgatgctgaggacgtttttttggactggtaatggaaccataattcgctttcctttttgataaatcgctaattccgtcacaccttttgcttttaacagagcaaaaagatcatcgaaatggaaacggaaatgttcaaggtaatgcccatctgatccaacactaaacaaggtaccaccacgtgaaagatataaatcgatgacatattcatataacgctaaattgtcatacaagtaagcgctcttagcatttaattcgaatgccaatttatttttaattacttgatctagaatcggtaaaaactgcgcttcatattgtttaaattcagcaacggatagaccaaatacccgaaaaccatagtcaaaatgagcaaagacatctgcttctataacaactagtgcttctgaaagttgtgcaaaatactgaggaatcacaatagcaggatccatatctttgacttcgtcatctaaataatcaaattgaccattatgatgcacactgagtaattttaaatcgtaatctttatcggctaaatagtcgatgatccgatccttttcagaagcgatgtaaccgatttcgatgccttttaaaacacgattgccaaaacgcttatttaagctatcgattgtttgactgtacatttcataatcggggatatcatcgactttagtaacaggattggctaagtcaaaatgttcagttgtcacgacgtaaccatcgtagtttgttaaatagtcctcatttcttgggagttttgagactactatatgcgtttttttgttgatttaccaacatgtttagacattttcctctaggaaaaaattaactagcaccacgggtgtctttatatcttttattatacaaaaatagacaaaagtatcagtctacactcttagtaaagaggaaaatgatgattttgtttacagtctgagagagttggacaatagtcctttctccaaaagaaaacaagtccgactctgatagttaatttcaaaatcggacttgttttttcttctttgcgtcttttcctctccatgtatttccctaattttcttaaatttaacgccatgagtgccaagccaatgtcaatcttggctccttgtttcccatataagtagaaatccgtttccgatagatcaaaccttctttttcctctaaaagctttttttacattctgctttgaaataagccatgtatttattcactaaaatttgtcggtttcgctcactttttgctttcgtacattgactacgaacagggcagcaccgataattttcacattcgtaaattttgaagtcacgtataaattcacttttatcttttcttcgattaaagcgttgaccgcaaaagcgacatctggttcagaaatatattgttccatatctaatggtaaagttgcttggttgggggtataatttttaaacataaagcacccgcttcctttctgattgggtttagtcactttaatcttacagggatgaatgctttttgtgtaccttaaaatcaaaaaaagtgggacaataatcagatttttttctgactattgtcccactctcttttattacttttcatcttctactattccattaattaattgacagataaaatgctttcacatcctgcacgaacaaactcgggctctgaatcaatcacttgcgagttgataaattcaatgaccattggaagattcatccgacataaagtttaatctgttgtccttctattatcagtttagaaatgatattagtaggtataccgcctaaaagatcgcatagtgccacaaaatcatttaacgaatctgtgacagtaagaacttttgtctgtatgtttcagtgccatcttctggtaataaaggtaacgtgtagatattctcttgaggtcccataatcatttttgtacttttttcaattcctcacaaaatttcccatgactaatcaatatcaattttctactcatttttgccttccccttatttcgaaatcacacacaatgtagatgaagccacacacaagtaatacgataaaaatcgctcgagtaggagtcatatttttctttcctaacaaccaataaacacctcgacgatcccagcgagtaagattttaagtaatatcatatcgatatagttttgcatattcaatgtcacatcgccaatcgttagtaccataaaaaattaacatcaatcattgctgcaactaatgctcctacctgaacactcttaataaagtcgctgcgtccgttaatacagttaagcgagtggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagaaacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccagagattacactaaaggaagtgattatagcttactcaaatttaccatagattccttataaactaatgttcgataatttgtagacttcttctctgataatacatacccttctgcttacgttttatagacttcatcaataagccactttgtgtcaaatagcgatagaatggaatatcatctttcaaaaaacaaactcttagaaacttgtcatagtttatctcagggtgttccataccatgatgcttttagccacttctcaccgtattataagatactcaattattttctcgtcttagctcttattttttccaaaatgagttcagataaatcatttttggtaactactaaactcactgtatacatacttaaacctaggagcatctctaatatcagaagcattagatggttttcaaatttcgtaatttgttctagtcccaaaatggatccacccatcaatacaccagagatcataactgtgtaaacatcttttgctctgatcacaatttttgtcaatctactacaatataatgtcattaacatggttaccaacgtttccgtgattacagatgctattgcagcaccattttggttaaataccggaattaaaatagcattcaaaataatattacaaatacttcctgttacaacacatcgtaaaaatttttttcactatcagttgttaaaagaagctgaccagatacaccacctgaaagaggcatcataacaaccaataaagccaacacttgtaaaattcatacagcggatatgaaactttctcccaataaaattaaaattaagacaatatgctccgcaactaacacaataccaatacagttggtaacaactatcacaaccattattttattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaagtccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatcttttttcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgtttttaaaaaattatgtatagtttcttccattttaaaggaattcttctcagcgtaataaaggctaagtcttggtaagagaactgcccccattgctataaaagtattagctatcaactttacaattttcacagcatttgaaaaatatcctacatgagcagatgatgtcatatgagtaagcattgttacatctattaaactgtacaattcgatagctataactgatacaaaaagaatcattattggcttaagatgttgttttaatttaatatttcttattgtaaaattcacatatttattcagacggagcatattcataatatagtttcctgatataccaaaacacactactcctgcataaatcacaatatccgtcttttttttaacaaaaagaagcataaaaatcaacgatacaagcttgataataaaacttctaactgttatatatttatattcttcgaatccttggtaaacccattcaatattaaaataatttagaacaattaaagagcaaaaaatcaaagaaagttgattatatcccgaaataaatacaacagtcaaatatatgagtaaacttatagtagttgcaaatgcattaattataaataattcagagaaaattatatctgtaaatattccatcgctctggtcccttttttgcaatagctttcacattatacgttggaatatccaaggaagcagccattgtaaaaataggtcacaaaattatgcactgacgtaacttcaccaattccttcagctcctaaaatatgtgaaacatacgatactgttataagaggaaaaacgactgtcaaagctttatatagtatgttaaaaacagcattttttgcaagtgtaattttcatctttgacctccttattcttgtagtgtttcactttgaactgatatgccccaaataatagcacaaaatagaataaaataaatgtcaatagtaatttcaaccgatgaaatcaccgacatcatcatgattaatgccattatttgaacagaacgatttatattttttcctttacatagcatcatatgtaatgtaatcagtaataccactgtgccagcaattccaaattgaattaaacagtttaaaataccattctgtgcattaggagctcttactagcgaatatagaatatatgataattatttgctccataacccaaatacgttctgtagaaaataacggaattatcgtatcatgcatttgcaaacgaccatgcagatcaagagttccacctaaaatcttcgtgataaaatactgaaccgcaggttgagataatattacagcatcaaagaacaacagaactgtatctgccagcgtattccatactctggaccatgtgcggaggcacacggaagatttggcaattctcatccacaccaaattgacaagtagaaagaaactgattgtcttcgggaggaagagagatcgccttgtaactcattccctcttcgaggattgctacccgttgggcattggcagcaccaccataagccgcctgccagttacctctcactcttgccgggtctttcagaacacccggatactctaacacatcactcggctaggctccgttcttgaagaaggaagcaccatatcgttccacggcatcagaggcaggagcatccttcatgtgctgtgccaggaagtcatccagctgggttcatagcagaatcgacacccttgttcatggcctcgctgatttccatcagcttctggttcacctcttcctcagacaggccggtgcgctcacagatggaatgtagcagatgatcgtgcatctctgccatcttctggtccatgttgaatttttcgtggcaacaatctctgccgccatgccttcggaaatacggcttccaaacacccacccctcatcagactgttccaaccagtccatagcgaaagtcggtctacttccagctcatcgtggaggaactgcgtaaaatacaggcgcggtgccagaggaaggtatccgattatcatcaggatacggcaggctttccttgtcgactgtgtgtttgcttccagctctgtcttccgggattcttcgctctcggaaatcggtctgtacagtgaacacacataaatcttcttcctatgactggtatcactcatggctcgtctccgttctttgttttgtcgagtcctacctctaaggagatctggccagcatataggtgttcatctaactgcccctttcaaattagtgtcctcacctatgattttgggcgttttataacccctccggacaaaattttttgaaaaaatttgtcgaggccttaatacacctctttcataactgcaatcgcacgcttcaatgtcttgatgattgctgcctgcgacacgcgcagattcttcgcaatctgctgctagttcttgttcaggaagtaataatgctcgatgatctgtctctgcttaaaggtcagcttctggatcgcttcttgcagacgcttacgctccaatcttcttaaaatcagtcggagcaatgtcaggcgtataagacatcacgcagacctgtgtgtagctgtcctcgatgatctgctctgtgcctctgaggtatcttgcatagttggattccagacggttctctgcaatcaaggtcatgtatatggtccactgatagtccatatactcctcaaccgggatgaagctgttcttatcggtgaaccgatacaacattcccttcatgcggtcagctgcgaagatggagtacatatcattgcggatatagaggacaaagccgttgcgatatacggtcaacagggcatcgtccatctggaactgagccacaattggcaccatggtatcgctcagctgacggaagccgggctgctttacgcctttggtgctgtccttgatgtcctccatatatactgcttgccgagattgatgattcttctgacatcgtcatagcgctcgatgtagatcgcactcttgggcatctccttcttctttggtgcctgctgctctgcacctccgatgcaagcctcaatagtgatgttgtctgcggtaatggtaatctgattcatgatgtagtcctttccgccgggcgaaggcagaggacaccatctgatcagatgtggtaccggccgtagataaactctccggcaacgaaaaaaggtcgcaaaaaagcagagttcatctccacacaattccccacagattccagctactttgtatctgtaagacctgtatggtactctatcctctgcctgttcgcgaccaggcatttgatattatgtttccgaggtgttccctcgttgtgatgctataatagcaaaaggaaaagaatcaaaacaggggaccataaccaccagaatgatttgctattttacccgctaaaaacaccgatatttcgatattttcccgaactattctccgtttttttgctttccaactaactgagtttgctcagattatgggagatttttcccctataatggtggtctacgcctcccatataatcaaaaaagtttttttcatttttttctattggtcatggatatcgactcaaattattttttctcccgatccgaatacctgcacacatatggcggtaagcgccccatagaacagtacctgtacgtcaaataacccgacctatagaatagaatcgggaatgtttggcgtttttagttacgagaaaaatgttgttgtacatccttgttccaaggcaacagttgatctaaagtttctgctgaaagtacgggaagatttggtatcttatcaaatagaaactctagatactttacaggattcaatccgttaagttctgctgttttatatacactcagaatgattcctgaagttcgtgctccttcaagacttgtggaatgcaaccaatttttccgtcctatcaccagctctttgatatttcgctccgcacgattatttgtgagttctaaacgaccatcttcaaaaataggttcaaaaccacttcgtagtttacacgcatattgaacggctgcatccaacttggattttgcaacaggatctatcgttgccatccactcataaaaagcaataaataatggacgcagttcttgttgccgacagcttaatcgcttctcaggagaaaagtctttccatttcttttctaggacaaaccatttatccaattgtttgactgcttgagctgcgggaatatccgtgtttttctttccttttggaattgcttcgaaaaatttccgccgaacatgcgcgaaacaatagacaagtcgtacactttccacggcattatacccgctatagccgtcacagtgtaaataccctgtaaactccttgagaaaagttttcggaacatctccagcacgactttcgtcgtggtgataataaacgatgggatgctgactgtcttttcctgtacaaaactgccagtaataggtatctgttttggcactttcaatcacacgataacttgtttcatccccgtgtagaatctcttcttgattaagatagactcttaatcgttctcctaaagggtctaacgcgttttgcactgctttaatatgccaattggtgatattatctctcgaaatatccaacccatgtgtttgtttccaatagttctcttgccgataggcaggaactttctgaccaaatttcatccggatcgtttccgccactaaactattggaacctaagctattagaaatcaaaggtttaggaacgatcgcttttttaaaagaagaaagtccttctttttcgcagcttttacaacaataggtatgttgataatgggtgagacaatccaacatagcctgatggaaacgaatttcttctcgtacttttgtccgtccgatatctttcatctgtgaaccgcaatgttcacaaaattgttcttccaaaggaaggagatgttctttctctgttataggtaagtgtttgattttgtctgctttcgttcctacaactcgttgatgtccttttactggaataatggtggcagctgcttctggaacacttacagaaatttcttcatcactaaaaagattcaattgcccattcgtttcctcaaagagagtctctttagagcgtccaaataatttgttggttaaataattgaccttttcattcaatagttggatttcagttgtaagattctgaatggtttgttgttgtgcttgattggttttatgggcttcttgaagcaactgaagcaacgtatctgtagtttccaaaatttttcaccaccttgaatcgaactgattttgttacagaataccacaagaaacgcacaagaaataggggttcaacacattttttgtgttaaccccccagcttaaaaaactcctttttttcctggcaaaatagctcgaggttgatcgatacttaatccttctaacaaccatcgaacctgttggttcgttaaggttcgaacttcgtctttcgtccgaggccattttaacttgccgttttctatccgcttataacagagaagaaaaccatcaccgtcccaatagagaagtttgaaacggtcttgacggttcccgcaaaataaaaaaacggcatcttcgtaaagctcgagttgatactcttgttgaataagactggcaagaccatcaattccttttcgcaaatctgtttttccgcacacaatataaatatgtttggtttgaagtaaatcataaagcattggacaacagttctttcaaaatagcttgaagaatataattgttaataccgttatagatcaaaacttcagaaccattctctcttttgatgcgcatcgctaacttggcagccgcgggtttacctttttctggtgcactcttttcgtttcctaattggacaggaacaatctcatttaatttatacatagaaaacctccagacttcttgatagctcaagtatatcttgaggtgcatttgttagtaaggtactgttctatggggcgcttacttctatggggcgcttacgattcgtcatggcaaaacatttttaaccaaataaacagaacagaaagaggttttcttctttctgttctgtccaaattattctaagatttctctttaccaacatcatttgacaaagagccaaaaatccggtctcaaaatagcgttcccgcttaactattcagttttcagaggaaaagcggaggaagcccgctctgcttcagcatctcctcgcagcgttctatggtcacagggtattggcaactctcaggaatcctctgtatacaatatggtgccgcatacggccattcagactaagtcccgccttggacaccatcatctcggagatatcatagggtagtttcagtgcaatacagatgcccacaacatgagccagcgtgaactgcttgtctgggtccaaatactctctaagtgtacttctatccacaccaaggtcaaaggccagctgttcctgtgtaatgcctttacgcttcataatgtccttgacgctttctccaaaattcagcatcacggtcgacttcatagagtcatcccacatgaagatgtcccccataaagagttcattctccttcagataagaatctgtccccgtctcttcgctgaatgtatagccgctcagatatttgtctgttatgggagcatatgcttttgttttattcaaaatatcaacatccaaccatcggcagtgggaaccccactcttatcgctcaccacgtagaggttgttggaaacggagcaactaccgcccggtgtgggcggcacatatagtttatttctctctcactgctttgattggagcttcatcaggcttacttattttaacgtttacctcttctccttttcggtcaacgcatgcggggccttcattctttggctcaacaactttgccataaagcgcattgttcttgttaaaaacagaggtagttacttcagacatatagataatctccttccaaatatattattaccacatcttgcggaactcgctaggacgaacaccttcgactttgaaaaatgttcttgaaaaatagtttgcgtccgtcatgccgattttttccgctatctcttccatgctaagatttgtaaatcgcagaagatgcttagcctgtgtaattcgtttctggtttagataattgacaatagttataccgtacgtttctcgaaaaattttatgcagatactgtttattgataaagaactctgcactaagctgatccatcgtgattttatcggtataatggtcatccagatactgctttatattctgcaattccattcttttagtagacatattcggtattttgtctggattccatgcatcttccataagcaaaatcaaaagctggcttagagctgcattgattttcatatcccgaacataatcttgcccttctgctatcctatgaagttccatcatcagcttggcatataggtcgaatttagccgaacggaataccggctgtccgcctcgttcaagatacttcttataaacctctgtcataccgataccattaaagtggcaccaacgaagtgtccacaaatcgtcttccgaggactcgtgagcatatggtttcagacagtcaataaacaccatgccccctgcttgaagcatatacttctgaccattatactctagtgtgcctgaaccagattctacaaggaagcaaagataggatgatagaccagaacgtttggatgtatgtgccttcagagcagtcaattgtccgatttcctgtaaatacagaagagaggatcttgcaaagaatgatgccgtataaagcacacgtgttgactgcaccgatttcgatgcattagaaaacagttcatccattacaagtcctctcctctctttattacataaacatttcagccaattcagcagctataacagcttccatagcttcggcggcttctttgctctctgcactaatactgatataggtcttcagcttcggctcagtgccagaaggacgaactacaacagagcagttatcttccagcataaacttcaaaacatcagacttcggcagaccgttcaagcccttgctatagtccagagtttcaacaaccttcttaccaccaattatatcaagacccttatggaattcaatcatgatttcctgcatcttggtaaatcctgctgcaccatcaaactcaaaggagtgcagagtattcaggcaatagccgtatttcgtatagatttcgttcagcttatccagcaggctgatcccctgattcttgtaataggagaacatctcgcagatcagatgagcgccattgacaccgtccttgtcacggacatagctgccagacagatatccgtaggattcctcaaagccaaaaatatagctgccagccttaccagccttttctagcataccaatctgctcaccgataaacttgaaaccagtcagcacatcaatggtgcgaactccatagttagatgcaatacgctcgcccaaatcaatggttacgatagtcttgaccatcacagggtcagcgggcatcttgccgtgcttagttctctgagaacagatgtaatctaaaagcagaagaccagtctcattaccggacagcaggacataatccccttctgcattcttcacagcgatgcctacacggtcacagtcagggtcggtggccaacagcagatcagcattgtacttcttggcatactctatgcccagagacatagcttccttaatttctggattcggataagggcaggtcgggaaattaccatcgggcaaacgctgctcctccacgacagtgacattgctgtagcccatctctgccagagtacgagtcacaggaaccagaccggtgccatttaacggagaatacacaatggcaacatttttgtccatttcctcgccaaacagaaccgactgtcccttgacctcctcgatgaaagcagtcagaacctccggctggatggtttcgattttagcagcatcgccaccagtcttcacatccgcaaagacgtccagcttttcgatttctgccaaagtcgcagcagcagcctctgtagtaatctggcaaccatctgtaccatagaccttgtaaccgttgtacttggaagggttatgagatgcggtaatcataacacctgcatctgccttcaaataacgagttgcaaaggaaacagtagaaaccggcagcagctggggccacaggtgaacctgaataccgttagcagcgaagatgtctgcagcagtctttgcaaacacatcggacttgaggcgagaatcatagcccacgactacagaaggtgcttcacatgtcttgttcagatagtctgccagaccctggcttgccttacctacggtgtgcacgttcatacgattagtgcctgccccaatagtaccacgcaggccaccggtaccaaaggacagatttttatagaaggagtcctcaatgtccttctcggaataggaacgcagttcctctacaatatccgcattggcatttgcaagccaacgttcatattctgctttatagctcatattatttacccacctttcttgcagctctcaaaataccatgcgcggagctgttacattttatctcgtttctcataaccatctcaatagctttttcgaagggaacaatgaccgattccagagcctcggtggcatccagatgcagtcctgctatcttgctacggttgcgattagtcagcttagaagagctttcgatggtatctccgaagtattcccagcagtcagactcgtatcctgtttcttccaatagctctcgttttgccacggcaagaccatctgtttcattcggttcaaacattccagccggaacctcaatcagatcctctttggtagcgtgcttgtactcctttttcaggataatgtttccctctgtgtctagggcaacaattgccgccgcatccggaatggttaccgtgtaaaaatcatcaataatcagaccattcggaagattaaccttttcttttatcaccgtcaaccatctattttcaattaaacgttcagtcttttctactttccacatatcagcctcttatatccagaaaccgtatcgatccgtgaatactgatttcagtaaaatcagctggtacaaaaaggcagtcacccttataaatgtccagcgattcattatcaaatcgagcagtaccgcaaccattgacgcacaacaacacacggaagctggcaaagtccgcacggtagtgtactgactgccttctctcaatactgataatcatacggtatacctcgaaatacttgcatctgcaaagcaattccgatgctacacaagcacgatattttaacactcggagcggctgcttcggttcggatattccgttcagattgtcgacttccagagctttgtctacaagaagctctctctttttgccattcttatctacacggtcataatcgtagagacgataggttagattagaattctcttgaatttccgcaatcagtgctcctgctccaatagcatggatggtacccacttcaataaagagcacatcatcctttttgaccgtaaccttctgaaggtaacgctcaacagtttcctgtgcaatcgcttcacgaatcacagtttcttctgtcgttgtctgcaacccataaatcagactggcatacagcacataccatatttctgtctttccaagctgcccattttctttttctgttgcatattcatctgtgggatgcacctgaacagacaaatcctttttcacatcaatgaacttgatcagaattgggagttctccattggtctgcgggtgcgttcccagaaactatggggtgctcttgcaacaccttcgtcaaggtcatataccctgatactgaccagacacaacaaaactcggtccatctgggtgtgtagagcattcccaagtttccgcaaaaggagacatctcaattccttttgcaaattcatcattcaggcgattaccttcccacaggtaatccttcaataaaaacgatttctgcataacaagccctctcccgttttttaatagtctaactcaaacttctgtttatctttgacattgatatccttgccaagctgtacttcaatcagcttcagctcggtatctgccagaacagtatgacggcagccggcactcatggtgatgacatcgccagccttaacagcctgctcatagccatccacgatggtcttaccagtaccagccagaacgacccatacttcatcacgattcttgtggctgtgataattcattgagtgaccggcgttcagggtgaccttgatagtcatactctcagtttctacatccatgaccttatagctgccccaagacttctctgcaaacatgatttgctgctcgaattggtcaacaaaaggcttgatatagctggactgctctttatcggacaccagaataccctccggagaggcagagatgacaacatcatgcaggcccatagccagcacaggaacagccagttcgttcaggatatgtacgccatcacaattctcgttcataacacccttaccgacaatggactcctccattgcttcggtcaaagtattccaagtaccgaggtccttccacatacctgcaaagcgttgtacctggatcttgtcctcatgctcaacaacggcatagtcgaaagaaatcttggtcagggtctcgtacttgttgaacagatcctgataatcaacgaagtcaataagctgatgtgcgcgttccatgacatatttgagcttgtatgcaaacacaccgccattccagagtgccccctgtgtaatgtattccttagccacagcctcagtgggcttctctttaaaagtgttgacaaaagcagtctgcttagcgctttctgggataatatagccatacttctcagacggataggtaggctcaatgcccatgagtaccagattagcttcacccttatctgcctgatcagaaagagacttcagtgcttcaaaataatcatcctccacataagggtcaacagggcaaacaaccacggactcttccggattaacgcccatcacatccaccagataagcggtagccagtgcgattgccgggaaagtatcccggcggcaaggctctacagatacacatacatcctcgccgagatggttgtggatagcggaaacctgtgtcttggaagtggcgatggtaacagtagcatccttgtccaccttcttaatctggcggtaaacacgctgcaccatggattcatagccatcttcggtcttgaaaatcttaatgaactgcttggatcggatgtcattagacagcggccaaaggcgcttaccagaaccgccagacagtaaaacaatattcataatgtatttctccttttataagaaagaggttgctgtaatcctctaaaaatcacaacaacctcgaataattagcgctcagcacgcatcgggttattcaggaagtcctcgtaggacaggcggatgccatcttccaactcggtcttgtatgtccagcccagcttggttgccttggaaacatccagcagcttacgaggtgtaccgttcggcttgctggtatcccacagaatctcgccttcatagccgatgatctttgcgacaatctcagtcagttccttaatggacagctcctttccagtacctgcattgacggtctcgtcaccgctgtagttgttcatcaggaacacacacaggtttgcgaagtcatccacatacaagaactcacgcagaggagaaccatcaccccagcaagtaacagtaggaagacctgcttcctttgcttcatggaagcggcggatcagagcaggaagcacatgactgtgggtaggatgatagttgtcattaggaccataaaggttagtaggcataacggagatatagtcagtgccatactgcttgttcaggaactcacagtacttcagaccggaaatctttgccagtgcataagcttcgttggttttttccagctcgctggtcagcaggcagctttccggcataggctgaggagccatacggggatagatgcaggaagaacctaggaactgcagcttcttgcatccatttttccatgcagaatgaatgacattcatttccagaatcatgttgtcatacatgaagtctgccagcgcactctgattagccacgataccgccgaccttggcagcagcaaggaaaacataatcaggcttttcttctgcaaaaaattcctcgacttgatcctgccggcacaaatccagctccttatgggtgcgtgtgataatattattgtagccctgacgattcagctcacggacgattgcagaaccaaccatgccgcggtgaccagctacatagatttttgcgtcttttttcatcataatgattacctttttcctattctattcaattaagtctgaggccttcttcagagcagcttcacgctttgccagctcacggtcatgcttcgccatgatgctaaccaattcttcgtaagaggtcttctgaggattccagcccagaacagtcttagctttagtaggatcgccccacaggttgtcaacgtcggttggacggaaccactgaggattcacgcaaaccagcatcttgccagtttcaacatcgtagcccttttcgtcgatgccggtgccttcccaacggatggtgatgccgttggcggcaaatgccttctcggtgaagtcacgaacagtgtgctgctcaccggtggcgataacaaagtcctcaggagtctcgtgctggaggatcatccacatgcactcaacgtagtccttggcatagccccagtcacggagggagtccatattgcccagttccagatgatcctgcagaccttctgcaatacggccggctgccagcgtgatcttacgggtaacgaagttttcgccacggcgttcggactcatggttgaacaaaataccgttgactgcgaacataccgtaagcctcacgatactccttggtgatccaaaaaccatactgctttgcaacagcataaggactgtaaggatggaagggcgtggtttcacgttgaggaacttcctcaaccttgccatacagctcagaggtggatgcttgatagaccttggtcttcttggtcagacccagaatgcggcaggcttccagaatacgcaaaacgcccagagcatccacatcgccggagtactcaggaacatcgaaggaaacctgaacatggctctgtgctgccaggttatagatttcatcaggctgaacaatgctgatgatacgaatcaaagaagaagagtcggacaggtcgccgtcatgcagcgtaattttgcccatcaggtggtcgatatgagcagtgttggagatagaagcacgacgagtgatgccgtgaacttcgtatcccttctctagcaggaactctgccagataggaaccgtcctgaccagtaataccagtaatcagtgcttttttcataataaattatcctttcctatgtaagtgataaggccaattataatggctcgtgatttctacttttcaagaatacacgataatttgcgatatatcaaagaacaatctacgcacagattagcacaatagtagtttctctaataatcaactatcaccaattttattcacttccacttccaaattgaatggctcaatttaggaagcaactgttttctacatagcaaatccaatctctttacaaattatgccttttttatgttacccgttaaatattcaaatgaatctccaactcctatcattaaggattggagcgaattctcatgatgccatccaacattcttgttctggtgacggtaaatttacccaaacaatatctgcgccggaaccaataatactttccataactaattgatcctcattcatatttaaatccattggcggagcatatttacctgcaatttgtatatggggatattcttttcgcaactggttttctaattcatctaaaattttccaacacgaaccatagaaaaagtgacgacaatttctccttcatttgatgacaagcaacatttcataagttcaacaccagagaattgttctgccttgatattcccttgctctctattatgcatttttcaatgcgttacctgatggtatcgtcatgattacctgattttttaaaatctgaaatgaactatttttgaaaccttgagctaccgcttccatatctgcaatacagatatagtgacccttccaggcattcaaattttcaaatatcctacctattgcttcattaacatctgttacagcaacttcaagacccataacattacaagtattgaacatttgaagttcaatcagttgtagtcctgccacaccttccagcttaatatgagtagaaatcaagtcagtgtaaacaggtcctacacacactttgatgtgataattagagacaactgctagaattttttgcatattttctatattttgggtatcttcagtcactataatcttttcgacattgtatgccgtaataacttgcggtaagtttgataaagtcccacgatactcctgaatgtgctggctactttcttccgcaatatagcctacatacctcagaaagaccgtatattttgaaataaccgtatggtaaaaccgtatcgccaactgatcatttccaatcagtagtatatttgaggccttgttattttttaattcgtgttgggtcacaacataatcaaatatacatagttcagctacaataaacaccgtggaaataatatagaaatacaataaaagcaaacgtgaaaattgagaccaatgaaagataaagagaactgaggcgaccattaaaaagcctaaaatattcgttactgaaacttttacaaactccctcttaaaacttcgaatatgcaaaatttagtagctgccttccagagcataacaaattgttattgcaattgcatacagaattcctaacgaccgatatgtgtttacatctacatataagaaatactctcccaatatgggtaatgttctaatccaaccagttatgtaaaatgccatagtaaccaatataagttctccaattaagaacaaacatttttgtcatttttcagacagtttttcataaagcacccctgttgaatgatatttaagaattctttataaatatcataccaataatagagattattcaaggattagtaggatgttgccttactgcacattgtttttatatactactggccttcatctgctcaaatcctctgtatgtagattctttttaagcagcgcatgaatcaagctgtttcgatgctctttccaatcgtgtataccttagatcaattcaacagtgaaataattgcgtgccagaccttttttcttcggtcgccttcttcacaaatgtgatttttctccttattggcacaaagttcccaggttctggcgctttccacataccatcatggtgcaacacagattcaaatctatcttcaaggattgcgtattcgataaagattgcctccaactaaaactcattagccattgcctttttcaggcgattatgctattcctataagtgaaatacttctgctcgtttgtagcaatcgttacttctcccactacgcaatccacctctgtatcctctttatcaaccaacagtcgctggatcttgcttccagcactcgtcatccgccatgtgaagcttgttgattagagatgacaaccgccctatgtgggaggcgcattgttcaaaagataagcatatctccattcttatctttttcacttatgataaacttttgctgatctaccggccattcaatatctatactttcatagcttacacacttggcagactcggcattaaaatcattgtctacgcaccactggacgaacgtattatcctccatcgtaaggtagccatgagcaaatccacgcgggatatatgcgcatttcccgtttctctcgttcaatatactaacatacacacccccataatttaaagattccggtcgaatatcaagtgcaatattcataatttcgccacgcagacacatcacgatttttccttgtgcgtgctctccactctgataatgtagcccccgcattgtatatttattatggctaaagccttgatttatttgcttaatgtgaaactcaataccaaaaaaggaaagaatctcattatccaatgcaacagcagtatatcctctaaaatcagcaaacttcattatatcaaacacctgtaccatacttacctccaccacaccacatatttttaccacttcggacagaatcgcttggatgataccttcaaactttttaagcatacacgaaaaaaatttgcgtcaatttccttgcaaatgataatctagcaaatgatgaaaaacaaaatcagaaacaaacgcgcacagtaaaaaccaaaaagtatagccactataaatgtctactagcaatgaggtaatatattctttgggtataaaagttgcagttttaatttacacgcaaaaagtaattagataatcaatcagaaccaaaaaaacaaggaataataatttgcttaaatcgaagtccgaagtattctgcccccaataaatcgagctattttagtcgtgagtgcatctctaatctcctctcatgaataatttatttaaatatgtatatcgaatggcggtgcatgccaaaatcccctcgacacgtgaaccgcctatactatatataattttaatttaggtaatataagcgataagaatactcaaagtagaaaattaatatgattttatataatacattgtagattcattctttcacaatcaatcacttcgatttcaattcttttgccgttttttcaaatgcttaacaactaaattaacaacttcaataaatgctttttccttgcaatagagtgtggcaaatataatagccgaaagggatgcacatagaactgctttcaatataaaataccacaacgtattgtgaggtaaaaattttaaaacagtataaacaattaacagtccagcaacatattgaatcacacatttaagagtctgccagtagtactgttttgaagccttattcaaataatccttgataaatacctttatatcccacggaaatcctacaagcagcatagcgataattgttgataacactacggcattaattcccatcgtcctaattaaaacaatatttaacacaagcttaaccaaagcctcaacaatcggtcgatatcgatcaatctcccacaagcctgctgcatctttgaaagtatgaattattcgtcttaaatgccaaactatgaataaagtgactaataggtaaaccgtcatattatcaagcataatagatttaccttgccataacaaaataaacggttgatagagaacaagcaagcaactagcacaaattccaattaaatatttgttaagtatatcaaatttaagaaatctatgataattactttctttgctctcagttatcatagcgttaccaatacctggaatgatcgagtcatacacaattgaaaaaatactggcaacagagttgaatatatagtagtagttattatacatgccaagcgttaccagaccaagggtagcagatataataatattatcaaaagaaaaaattatagtatttcccaatttatgccatacaagagctacgacttgtttcctgattagggcaatctgttcagcgggaacagtcccagaaggctttagtaaaggatagaatttacgtgttacaacggcagtgcataaattaatcactattgttgcaattggaagccatataatataggcataataattaccccatatcaacaaagaaacaatttgaattgcattttgcaagaaattacaaattaatataattttatttttgatgtcgtttctttgatgcgcaactagtaaagaggacttatatgcaaataacaaataacttgatacagtattgaggagatatattaaataaagaacatatatattaatatcattaggataggtaccatttattaatttagaaataaacggtagtaatataatccccaacacaactattgcgcaaccaataacacggtatacttttttatagaaattaagcaatgcgcataataagggtgtgttgttttccgcaactggtccatacatacttacaaccagagctgatccaaatcctaattccgcaagactaaaaacttgaagaactgttgcgaacagagtatttagtccaacatactgaatacccattttataaattagtacagttctgactataaatggcaacaatattgatgccattgtactcaaaattccccatattgagtttcttatatagttttttgatctattcgacaaaacgcaatatcctccatacatgtattttagttattgaagtaactaatcgcttgatctcgtccgtcgcaaccaagaacaaaaatacatcaaccgctgctattatcatccaaccccatctgcatataacgaacagtgaataaaatatagaataacaggaaaagaaatggacttgatttgatattgctctctacgagttgcgttaatgccatggctgaaaaaaaagcaattatagttccatagactgttttcggtacagttgaaattgaatatgttcttattccggtatatgcaaagagagaaaatgctaaaaaccctaaaaggcctccttgtatgaataagtctaaaataagattatgtgcataccaataatatccagtatgcggaattatagaatcatatccgtaacctattagagctcctttattgattaattcgattgcctcgtgccaaataacgtctctaccagtcaaaactgaagactttccaaatagagacgatatccacgataataacattccgtgtaggttaagcacaactaccataagaaaaacaataaagtatatacctacaattgtggaaatattaatctttagcagtttagtatctctaaaattagttgaaaataaaaattttaccacaagaagcaatagcatacttagcaatgatgttgcacttccagtaagaacaattaatattacagataaaataattaatataaaatcatatagcttactatgttttgttcctagatcacgattaagcataacaaaaaacacaaacggaattaggttataaccataatagtttttattgccccaaaaataaaccacatttttactttgataatcgccgataatattagtgtagtacgaaaatgctactccttcaggatgctgaatctgggtgactatagcgcacacaataaaaacggtcattatcccaatgtaactattcaggaataacttcatctgaccgttatagcatgcataaagatagcaattgactaaacaataaatagtacaaaatgttttaatataatcaatatacatatgacgctcattaatagctgtggaaagcaagaaaacgataaataatagcatcagaaaaatattcattttattaaatataatacactttgagcatttgcatactattaatgtcaatattatagagatgataacaccagacgttgtaataaaatcaccgaatacaggaaatactgttttagtaagaccaattggccaaagtacaggaagcaaagccagtatataataaaaatagtacttattaatcttcaacattatttacctattcactttcattgtaatccaattcggcatatacaagtctgcaataccgtcatggtttagtctattccaaatttcaggagcaattacaattccagaattattggataaatactgtgcccaccaactaaatgtgctatttgaaataataaagtgtttacaggagtacatcaatctcagttcttcataatcaggattatcatttttaacataaacgatttttccaggtaatgaataattttccttaatccaatctaagtcgtcagatgtgttggaaaagatgaaaaatgttggattgtttaattttgaaataatataattcattgactcaaaataatattgataatcacatacattcaaatgcttatatttaggcgataagtaatccccacgacgaatatgcacacagacagactctgattgtgatataaggtttaacaaacgaagattttcacccataggctcatatttgactctaagttcttgcttaatctctgggcaagtctccaaatatttccaagattgaaatccaccttcaattatttttattggaaaacctgtttttaaactctcgtaaaacttgtaaacacttggatgataatatattccaaatttatttaaggattgaaagatagcagactcattgaatcccgcaactccaaaaagcctgaccattatttttctaactaatctttctgtttcatttaggggcttgctgataattctaggtaaaacctttatattaacagtatttaaattaccaagagaattaaatctatccgcctcctttataacctcactatcgttaatgtaaataaatttttcacggtggattttctgaatatatctggcatacccatattggaacatttgatttcctaagccgccgcctaatgtcaaaactatcatactaatccctcctcaatattaaatctaaatcaaaaccctatcaatatcctatctctttcaatagagaacaaatcagataacaaattctaattaagcattatcttatattcatactgatttcctgttttgattgcaatctatttctttaatctttttattaatttgattatgctcccactgatacaaaccggaaagtgtgatcttataattgccagacatttcacttttgcattcactttacccgatctatgttgaacaaatatttgaggatacttatcatcaggataggtacaaatgttaaaacaagaacgaggaatcagatagctgaaatacaattctggatgtaatccatactcagtcggatcgcggtgggcaactatgcctagtttttttgaaattaaactcaaaacagactgattatgtctattttgaataaatccaggataattatctaaaccagacgtattttcttcatctgtaaataattctgggaattcaagtgcagcctctttgtacatttcaatgaattcatctgaatcttttccttttttcaaaacaaacacggtggataatctttgatttgactccgtatatttcgcttgatctacattaagcctcacaaaaacatcccgctttgtccagcatttttcaataaaaggtaactcaaatacaagaatattctctttattttcctccatcatttcaatcagaggctttactgaattaacaaaataggttccagcatcggaataaattaagtaatctccttcagccattttttcataagcatcacatacaattaatggtctccacaatccatatttcccaatttgcgaatcgccttcaacaaaccattttgaatttctgattttaaatgactcatcaatcatatgtggtccgtattctataacacgatctacctcaccaattttttttgcagtaaaggagttgtatttctgagcgtttaagaactttttatcagcataatttatggctagaatcattttaccctccttaccctggtttttaattcctcaatgagtattcttacatccgtagcaaacgcctttaaaggagaagcacccttaatgtcatatgatactttaccatataatgatgttatgcttcttggaaagtaaattacatcatcgacatttgacaaggtaaatgtttcaccaggtacatccaaaaaaatatttgattcttgcggaacagtcttacacccccacattcttattggttttctagatttcttatcagtaataacatactttgtagaaatattttcccttcgcttattcccgtatagatcaacagaaaaatcaaaatcatttaattctgtaaaatgcctctttacacattctggtgtcatttccatatatgcatcgtataagctcttagattcttccaatgagggcaatctatatttttctacatttcctatcattaacggtacttgaagattatcatcatctttcgcgtaatgctgtccagcctctgcaaagtttgttgtgaacgaaatctggggatatacaaagtatttattatgcgtaatcgtatactttatatgatactttttgaacgatgtcattttccactggcgtacattatcaggtaaacagctaatatcgtccattggttttggttccaaatcataccaatctctaaaagccttccactgttttggaaaatagactggtgcccacgacatcaactgtgcaaaataaacatccgtaccatcattcaaaggcgtaaacggtctatgagcagtttcactatatcttaagctatacaaggaagcaccagcaattctctcgtcattctcgtatttctcaacacaagcttttgcaaacctatagtattcgggcaaagcatagacgtcatcttccaaaaatattatgctgccatatttctgtgttaaatcaccacagaataagaagtgttctctcaaccccaatcttttgggatgaagaattacctctttataaccatgcttccactcaaatgcctctgctaaagctctcatttcctcacaattatcagctcgatccaaactgataattaaccgaacatcattatcgccacagtaatctgcttgatttaagcagtctaataatctttgtaatggcttttttcttttatatccaacagcaacaatagctaacatacttcctccatttttattctatatcaactaagtacatccctctaaagccttcatgaactgaatcaataatgacttgtttcatatttggatgccatctaggatgaaaatcacatcttaatggtccatgcagcaaaattggagcgtataatcgagatatatcacggcttacatcattaatacaatcgtatactattaggtgtctatactctcctttatctggatacgtatcagtaatcataatggttcgatctttattgtaagatggatgcccatcttcttttggtgtattcattcccaaaactgtatattctgcagatatagtgtcggctattatataataattattctttccgtttagtctacaccatagagttatatgactatcgtctagccaagtacagtgcgataccatctcatcatcggcaagcagatggatattatcgccatttaaatctgcggtaaacaacctagaaactcttttttgatccaatacgtatcggaaaatgaaattaaatctttctcccgccggattaaactccaaatgattaaaataactgaaagtggcttccttcggtataggatatttttcaattaattgttctgtggttagtattatcttttcttggccactttcaatatctacaattgatatgtatgtatccttagcataatcttttataccattttgaatataaccatatccctcagcatccacatttaagcgctcaaaatccaaagatattccatattttccattatctgaaacatcatacattggagcacttagtactcttttttccttggactttaaattatacagaatacttatatatgattttgtctcacaatcataatcattccacgcaaccacatcttctgaaataaatcgcagcattgcaccttgctgaaaattccacgctaatgttactccaattacttcgtagttactctctgacgatgcataacacacttttgctgcttctcctaatttaggcctaccttttccattaaccatcagataaaggtaatggcttccattcggcgaaaatggggtcttatcataatatccaaaataacaattcatacccgctggagtaattctattaccttttgttaagaaacctgttttatatcctgttgctcttcttattgcaccaaatataattttacgaacaaaatgatatgtgtagacgagagcattgcgaaacgctggtgccttcatcagtattttatttatggaatgagctgatttctttatgttcgcttttacttctctcttaaaatcatatattcttttaacattattggttccaattgaagcctttacaagttggaaacaaatttctttcaagaaaaatttgcaacaagaaacaaaagcttctactggagaaatgtattttcttctcaatctaaatctttcagttgttcgactccaaatatgtttccatgacaaacaatcagacgcacctccgtctctcataaaggaaacaaccgaatctacaaaaagaaactttacatttccatcagcataacatctccatataaaatcataatctgcaatatgcggatatgaaatatcaaatgttcccattctatcatacacagctttagttacaaaaactgcaggatgctgtaatggcatacccttctttaaaccgcccaaagaaatctctctgtgcatttgattatatatgacagtattgccacgaactctattcaagcctccagtaattattttttcatttccgtcaactgataaatatgaattaaccacctgctcaagtgcatccgaagaataccagtcgtcggaattaattatacctatgatttcaccacgggcaaacccaatacccttattcattgcatcgtaaattcccttatcgggaccttgatgcagttttaaccgacctaaatattgatattcatatttttttattatccctattgtgtcgtccttcgatccaccatctacaataatatgctcccagtttctgtatgtctgatttaaaacagcttttatggtatcttcaattgttaatgaactattatagcatactgtaatgatacttactaaaggattctccttcattttgaccacctcaaatctttttcgatttatataacaatcactcaactaataagctacaatacattctgtggaaaatagcaactaatctttttatttatcttttttgacaaccatttcgatgtcaatgccacaagaattgtaactacataaaaatcgttagactcacaaacaatgaatagttcataagtatttcgtagtgaaccattacatttagcacaatccaatgatataaaaacatttcatacgtaatatcaatttttatcctaatcggctttatatagtatcctgctccaattgtaagcacaggttcccatctataatcgatgcgtaatatccaggagcttgaaaattcgttattttcagaacaatttgtaacacaaacaacataggtgtcaatttgcgcaaaaacaaaatcagtatatccctatataaatatatgagcattccgatgtaaaaccaaagaaaatacggaataaatgatctatctactattttcaacaatttccaatcatattgttgttccgcaagaaaacctatgatcacattcaaaaatgcggccactaatgcacccacacagtgaattgtcttcgaccctttctttatccacctataaactaatactgcaatcaaatacaactgtatttcgacaaatattgtccaaagtgcgccattaatgctccctgtagcaaatgttttaaggcatttaggcgtgttcgcaacaccaaaaaattgtgttaatatccaaattataaatgatgtatcgattaaatgtggtaccaatactaatattacaacaatatttataattgtagatagccataactctggatatattctcattattcgtttcacaataaatgttttagtgctacttgtcctctcaattgaatacgagattagatacccacttaacgccaatgatataacaacaccgggcataaagtctgtaatcttccacagtatttctttaatatcccccccccccgaatttgaaaaccttaaaaagtgccccaacataaccattactgcagcccaatagcgtaataaatccagcgaatttttctctatatttagtgtattcctcataattcagcctctgttaatctctttgaaaaatatctctggtatataccttctccttgatatcatcaaggcaagtatcatatctattggcaatgatagaatcacacatcgccttgaactgatccaaatcgttaacaactttgctaccaaagaaaatttcaccgtcttttagagaaggctcataaatcacaacagtagtacccttagctttaacgcgcttcataactccttgaatagaactctgacggaagttgtcggaattggatttcatagtcaaacgatacacaccgatgacaactttcttctctttacttgcgtcccagtggctatttgcttcatatgctccagccagttccaagacacgatctgcaataaaattttttcttgttctgttgctctcaactatagcttcaattagattttcgggcacatcttcataatttgccagcagctgcttagtatccttcggcagacagtagccaccgtaaccaaaggaagggttgttataatgagtaccaatacgaggatcgcggcaaacaccattgataatttgctgggtattcagccccttcatctctgcgtaagtatccaactcgttgaagtagctaacacgcagtgccagataggtgttagcaaaaagtttgactgcttctgcctcagtaaaccccataaacagcgtatccacattttccttaatcgcaccttcctgcaacaattttgcaaaggtctgtgcagcctctaccaaacgttcatcttccatatctgtaccaacaatgatacgagaaggatacagattatcatacagagccttgctctcacgcaggaattctggactgaaaataatattcttgctaccagttttttctcgaatagacgcagtatagcctacgggaatagtagacttgataaccataatggcctcagggttaacttccatgaccaacttgataacagcttcaactgcagaagtatcgaaaaaattcttcttagaatcataattggtaggtgcagcgattaccacaaagtcagcatccttatatgcagaaacaccatcaacagtagccatcaaatccagttctttttttgccagatacatttcaatatagtcgtcctgaatcggagacttcttgttgttaatcagctccaccttttcagggataatatcaacagcggtaacagtgtgactctgagccaacagagtcgcaatgctcaatccaacatagcctgtaccagcaacagcaatttttaaacctttatactctctcataactcttcctccaaaactgtcacacagtctcactcatataaaactctttgtaccattctgcaaatttacgaagaccagtacgcaggggagttgcaggcttaaatccataatctctttccaaggcttctgtatcagcataggtaaccggcacatcaccaggttgcataggaacaagttccttgtgtgcctcgaaatcataatcctcagggagaacaccagcgcgaatcaactcttccagtaggatctgaacaaaatccaacagattttcaggattatgattgccgatgttatacacagcataaggcggtactggaagaccatcttcaccggtctgcttttctggagcaccttgcatgatacgaataaccccctcaacaatatcgtcgatataggtaaagtcacgcttgcagttgccatagttgaaaatctggatcgtctcacccttcaacagcttatttgtaaaaccgaagtatgccatgtcagggcgacccgcaggaccatagacagtgaagaagcgaagacctgtagacggaatgttgtacagcttagagtaagcatgcgtcatcaactcattgctcttcttggtagcagcatacagagaaacaggattatcgaccttatcatctgtgctgtaagggatctttttgttagatccataaacagaagaacttgatgcataaaccaaatgctccacagggtaatgacggcaggcttccagaatgttatagaagccgatcatattcccctcaatataagcatccggatttatgatggaataacgaacaccggcctgtgcacccaaattcacaacaatattaggatgatgttcttcaaagattgccgtgattacagccttatcagcaagattacctttgacaaatacaaagttttcaaatttaaaaagctcttctagacgggcttctttcagacggacatcgtaataatcattcatattatcgatgccgacaacttttacaccttcaatatctgcaaataatctcttagtcagattagagccaataaatccagctacacctgttacaaaaactattttatttttcaattcaatatgtcgcataatatcctcttttctaattagaatataaaaactttactttcttctaatcacagcattcaaaataaactttgtattagtgtgccaatacctataaaacagtcttttcggatcttgaatcaatctatacatccattcaagattccatttctgcatccattgcggggctctctggatatttccagcatagtagtcgaagcctgcaccaacacctatcatcaagccgtcgatttttccctgatgctctgccatccatttttcctgttttggagcacctaagccaatccatacaaagtccggcttcacagcattgatcattttaataacagccttatcctcctcttcagttaacggtctgaacggaggactatacataccagcgatctgtattcctggataatacactttcaacttctcttcaagcaggtctaaagtttcctgcttgcttccataaaagaagtgtctataacctttttcatttgttaccttaaaaatctttcccataaggcttggtccagtagttctttccatatttttataaccacgttttctaccgaccgtagacaaagggcctccatctggaattgccataatgccaccattttgaactgcgcaataatccggctcctcaaatgaggtaacggtggtatgtacattgctgacacatatatagtctccatgcaggagatcaatattcttttccaaatattccagtagccactccatattgatggccgcaatgtttacacccatgatattacaggttgggatttgactcttatcaaccttacggacatattcatctgcattctttatatcggaagtaatcatcttgctcctcccttgtaacctcttaataacttactcaccgtgtccaaataacacagcccggaaggtcaagaatataatcttccagtccgtgataaaacttctttcatttatatacttcacatcaagttatatccactcttcaaaagacaactcatttcgatgtggagcaatctgccaataacaactaagaccaagctgaacacacaaccgctttttttcgtaatcgccatattgctaaacttctcttggaagtacaggtcttggacctacgatgctcatgtcacccttaagaatgttccagagctgcggcaactcatcgatacttgtctttcagataaacttgccaactcttgtgattctcggatcgttcttaatcttaaagacaggaccatccatctcattctgtgacaatagtgcgtctaacttcgcttcagcatctacacacatagaacagaacttgtagaatttgaacagccttccatttctgctaactttattctgcgcaaatattggactgccacccagatcatcaatcacaatcgcaagtgctgttatcagcattactgggctcaggataatcaaagccaaagcggaacagaaaacatcctgcgctctacgaccaatccaatacagtctgtgtgacttaagatttgcttttctatcaattgttacttctttctgaatacctttcttttcttctgtaccatcatctttttccaaccgtccctctatatttacaagtatcatcacttgcaaacggctaaaaaagccgtggagctaattctccactctatctatctgaaacagccccaagattgtgttcattcatacgtaaaagagccagctcctacgccggcaaattcagtttttatcattcatctcaccaaaatgtgagaatcacctcgtttagggtgaaaatgcaagtttaagtcattttttattgacctcgtttggggttatattagaatttcgtattgaaatgtacttgcattctcaactccatcattttcagtaaagtattatgtaagtacatattgacccctaatctcactccaaagatgagtttatcgaacaatttattaggctattactacccaaactgtctatttacagcaagtttttgaatttttacattgcacattctcaatcttcaaaaactaaactaattttctgcgaggtagatattggtaaatacttgaacaatttcacggctttcatcatcatatcctacgataataattctaattggataaagattatcatcaataatttactttcacgtaaaaattctgaactaaataaaatctattgataatatttttttcttccattttttgtataccctacaggtatagtgaatttaattatccccaatgcctctgaagtaacagacatcactagttcaataacacattcactaccatagtttgtaggagcaaaaatgacaacaaaatctgcctccttatgtgctgtttttccatatatccaaattttattaccaatgaaatctagtttaaaattcatcttagcaactagttaactctatatttttattctgtttcattagttcttttttttgtcttctatcaccatatacatatatatcttaattatctatccatttcatcctacgcattcttgcgtaaatacaatttgctctgttgagttgatataaatcattggtgctacaaagataaaatgacaactgtttttataccttattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaattccatttcttttggtagtccatcttttcggaggagtccgtttgaatgttcatttaatccccgttgggaaggcgttcctgggtctgcgaaataaatatcaatatcattcgtattactaatacttttccaattagagaattcttttccacaatcaaaggtaattgatttgaaaagatttttgggtatggattgaagccattcattaatcgaattttcaatatcaactgccttacggccttctggtttcaaggcgataatagcttttgaaagtcgctcaacgagcgtgatgacggcacttttatggtggatgccgacaatcgtatcaccctctaaatgtccaaattcttcttcgaaaacgacataatcttttttacgctcagaaatatttcttttgaatgcctgttttccacgtttttccttataaccatttggttttcgttttccttgcatcggtaaatgtaaaacattgaattctcccgtcttaaaccggcgatagagggtacttactgaacaagagaaggttcgctctgcacggccaataatgacgtctggggtccaaccttcagttgatctttttgcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgatgaaaatatgcttctatcattacaagctcgtttggtgtaagatgggtataagtcatttatgttcactctccttgtatgctttagcgggtattacaattggagtgtaacataaatggcttttttatttgtctcgcttaattatacaaacggcgccttcaaaaattccagtaaatatatctataatatctatagatagtttcatgatatttaagatagtggtacatactttataacaacgtactttttcaaagattattttccattatgaacatccaatatattacaaagtttagatgaactataatcttcatttctgcacagtggataataaattcttatagataaaaaacagccttctctaaattcacaaataccttactcccacattttaagtaaacactctgcagcattctctttgttataaatgacagatattcctcaatttcatctcttattatgttattatcagttgataccattccattaatgtttcagaatacttacaatattttgggaccggataactcccttttgctcgtaaccactcatatccgttaggattcgctaaaagtttaccatttattttttcgattctttttttgaaccatcccatgaacataccgattcaacaagctaaattataaaaattggtgtgctatcattattttttggaaaatttattaatggctataaatatacttttgtatcatactaaatagctcgtcagttcttatatcgggaataccattattaaagcatttagaacattatatttaagagtggtatcatcccaaaattttgaatattttcttttatataagaataatgatactaaattgctccattcaccattctttttttagattttctacatgtgattcaaaacctccataattacagttattatttttaaaacgataatatgaacatgtgtaatcttttttatcagcaatctatcattctatccctaactaatatgctgcattcggcttgataataacatgaaacgtttttaaaatcaacttcaagtcgtacattaaacttcgatgaccgatatactctaaatccaactcaaccattttatggaaactaacatcatttctatcactaacttgccacaaacctgaacaaccaggttttacatacaggcgttgaagatcatatctcgtgtactcagctacttccctctccaaaggtggccgtggaccaattagactcatatcgccttttaaaacattccatagctgtggcaattcatcaatgcttttggcacggataattttacctattttagtgacacggggatcttctttcatcttgaacattgcaccttctatttcattttgatcaagtaattcttccaatttttcttcagcatctaaacacatagaacggaatttatacattttgaatgtttctccatttttaccaacacgtgtatggcaaaaaaatatcggacttcctggctcttcttttctgattcgataagctacatagaacatcaaaggagaagctaaaatcaaaccaatagtgcttccaacaatatcaatcattcttttaaaaaataaatagatgtatcttttttcaactttttctttatccaaccaaacttgattgggatgtacttcactaatacgagataataaatcttcactttccatactttccttctctccttatttcctttttatttacgaataaagaactaaaataaaccaaacttcttcttttttacctcttcatagattggataactgatttcatccccgttgatcagatcctttgcaacttgtttcatctgtactactttttccttaccaaagtccttggcaatctgctcatagcactcttttaagtaaaaggtacgcttagagaccccatgggcatcagaagcagccatctgcacgagattatgtttgaccatcgttttggctgttttctggatgtctttgccaaatacaccaacataactcggcgcagtaagttgggccaaacatcccatatctaggaacggaagcaaatgattcgggtctttacgaaaatgcgcattgcgttctggatggacgatcactggtgtctttcctagttctaataactcaaaaaaaagccgttctgtatataacggcacttccagtgtcggaaattcgatcagaagatatgtatcatctaaatctgtaaataaaattttatctcgatgggtgtcttcgatgagcgttccggtaatacgtacttcttgtccttccaataacgtcaaaggcaattgtcttttctctaattctgcttgtaacgaagcgactagagaaatgacttgtgatttttcattgctgtattttccattattgtggtgtggcgtgcataaaatatgcgtgatgccttgctgaatcgctttttcagccattgcgatacttgcctctaggttttccgccccgtcatcgattcctggtaggatatgacaatgtagatcgatcatttctcttgtctcctctcttcttatttcttaatttccgtagtaataaccaacatctttgctgtgctctgctccattgtatacgacacctaggactcgtgcttgtaccatatccaacaacccttttgctttattcaatgattctttacgtgacgtattttcacgtacgaccaataaagtgccatccgtttttgaagacatgatctgtgcatctgttactgctactactggtggcatatcaaaaattaccacatcaaatagctgtcttgcttcggctaggatctgatccattcttggcgaacttaataattctgatgggttgggtggcttaggtccactaggcaaaatcgacaagttctcgactggcgttcgttggatcacatctactacacttcctaatgagctaagtgctgtacttaatccactggcattgttcagctggaatgtcttatagacaacaggtttacgtaaatctgcatcgactagtagaactcgttgaccggatttagcaaaaacgactgcaatgtttgccgcagtggtagatttcccttctccaggacctgatgaagtcacgacaatcgttttgatttgctgaccagctgcggaggcaaactggatattcgtccggatcgtacgatattgttcggagattggtgaagatgggtttgttaatgtgatcaaactaactgcatgagtttgtattactttttgtttctgtgttcgtgccatttttcttcctcctagactcttgaacggcttctacgtgatgggaatgttttatcgtttgtagcttttggtcgtgtaggagctggtccttgtttacggataccagcgttcaattctttcgctgacatttctggaactgttcctaagattgggaatcctaatgtatccgtcacatatttttcatctttcactgtcctatcgagtaattcaaataaggatgccagacctacacctaccatcattcctaacattaagccaatcactagattcaatttattatttggcgaaacaggtgtcgtattggcaactgcacctgaaataatcgagattttatcgacattcatcacgtcttttgcgttctcttggaaaacttgtgaagttgtgttagcgatttgttgagcagtcactgcatttgtgcttattgcttgaatcgagaacatttgtgaattttctgactgattgactgatatggcatccttgatttgtccagcagtcattttcacattgtcttctgtttctaatcgatttttgacttcgtttagtactagatcactgacgatcatatctttatacgtattgatcatttgcaggttcgtattgacctcgttgacatttgcggtgtctgattgtggcagtgtcacgatcaattgtgcttgtgaactgtatttaggtgtcaagatgaaaaacgttacgattcctgagatggctaagccagcaaacattgagatgatgattgttaacaagtgttttcgtaatgtttcaaaaatttctttaaagttgattgtctcttccattttttctccactttcctatttattctctagattcatttgatcttttaattcttttttcacacggtccagttcttgatcactaactttttgatatgagatattatcttgcatgaagccttctccttgcagctgatcttgcttgatcgtaccaaatgcctcccgataatctaaagcgatctttttcatttcatcaaagctcatgtctgttttcatattcgactctagagcattcaaaatggattgatagttgcttacaccgttcagactcaatacttttttcgctataccttctacgatttttctttggcgcccttgtctaccgtaatcaccgtttggatcttcataacgcatacgagaataagataatgcttgatctccattcaatgtaattttaccgattggaaagtcatagccatcttgggagaaagtgaaatcattattgacttcgataccaccaacagcatcaacgagttcttttagccctttcatattgatagagacatagtgatcgattgggatgtctacatacttttgtacggtatccatcgccatagcagctccgccgaatgcgtaagaatgattgatcttgtcttttgtgtcatgacctacaatgtcgacatacgtatctcgaggaatgctgacgatcgttgtctgtttgtcttcaggactgactgtggcaaccatcatcgtatctgatcttccttgatcgacccgacccaaatctccagtatcaatccccatcaatagaacagagaaagattcttgtttgtccagatcaactggtttcgttcgttctccttgggttcgttccactgattcgtaagttttctcaatagaatgtgagagatccagatataattttgctcctactcctacaattgctaatactaatacgataagaactgctaaaataatcagaaatatttttttccctcttgattttcttcttcgtcttgccatagtttcctccgtttgctaaccttgcttgaatcaacgttttaactgtcaatagcttatattgctatagcccatttgctgagcaacagtttgtacttttgttgcgtatgctgcgcttattttttcattccggatctgctctatttgactgagcaccgtcaaatattgatcgtaagtagcggtggcagtcacttgaccatcctttaacatcgtatcgaataactgatctagttgcgtgacttgcgcgatctgagtatcagcgaatcctagatattgcataacaaccgttttccaagggctatctttaaaaaagctcatattttcacgtacacgagcgacatctgcacttgtcaccttttctttgatgatgacatcgtctacagcttgctgccagtttgatacatttttagtaaataaatcgttgacagctgtctggatcttcagttttgattctgcactatctaactgtgtcacgattgctttcttctcatcttggattgcaacagcttctttaggcaattctgattctttgatgtcgtaatcatctgctgaaagtttgacagaggatagcttatttgacaaacttgtgattgtttcttctgttatttcagggtttagaaaaattttttcttttgtactatacagcttgtctacttcttttgataaagaagtcaaggtgtctttttgattggtaatggcagattctgcataattgatccgttgctgatgttgtcgctgattattgatatggtatccaaacaaacagatcgcaatagcacctgcacctaccgccacagcagtcaatgacttgacgaatggcttttccatagattcactcctaagtattgatgatagataaattaagatataattcacttacataaaaatgacagctttttattaaaaaaaataattaaaataatatattcacagaaatatttgtaaacaagttttccctatataatcataccacaaactgttttcttgactagggtaatttacgatttaaaagtaaataaaacattaacaatataatggttaatcgttttcattttttaaaaactcattttttataatcgttttaaaaaagttataaaaaaataaaataacaatttttttagtgttaaatttattacaactatttaacattgtataaaaaccagagaaacagcctattttgtgcctgttctctggtttatttacatattagaaattattttgtgatgatttgatccaaacttgctagtgacaaagccatggcagcaatttgatttaattgcgttaatcggttctcacgtactgctggttcttctgccatgaccatcgtctgatcaaaataattttcgatcagtgggcgaaggcttacaagctgatcataattttcgttgatcgtttggtcagcaaagcttgttttcattgcctctactgctttgtgcagttctttctccgcttcgttttcgaacagttcagggtctacttctgattgtttttcaagctccgcttttttcgctaagttcacgacacgtgtcaaagcttccatcgatggtttgaagtcttcatctgcaagatgctgcttgaacaattgtgctgctgcaaatacttttgtcagatctttttgttctgcattcaaaacagcttcgatgacatcatgacgaatattcttcgttgtcaataattggcgcagacggcctttgataaagtcgatcacctgttgttgtcccgctgacaagccaatgccaaaacgatccgcatctttactgataacttcactaatcgtttcttgcagaacagacaaaggaaaggcccattttttcgattcgatgattcgaacgacaccatatgcttgacggcgcaaagcatatggatcgtttgagccacttgggatcatcccaactgcaaagaaagaaaagatactatctaatttatcagcaatcgctaaaatagaacctactgtagtctcaggtagatctccttcactggatataggcatgtaatgttcacggattgctgttgctacggctggtttctcgcctttaagcagagcatatttttctcccatgatcccttgtagttcagggaattctcctaccatgttggttactagatcaaatttatagatttcagcagcgcgttgcagatccatcaattcttcctcagatagtcctacttgttcgcctataatgcgggcgataacttgtacccgttgcattttctcgtagatgctaccgattttttcatggaaagtaacagtttttaatttttcaacgtattggtcgattgaagctttcttgtcttcattataaaagaattccgcatcttctaaacgagcagtcaatactttttgattgcctcgtaccacattttccaattttacccgatcgccattacgagcagaaataaaataaggaagcaacataccttgatcgttccgtacttcgaaataacgttgatgttctttcatagaagtgactagtacttcttcaggaacagatagatatttttcttcgaagtcgccagaaaagacagttggatattcgactagattgttgacttcttctagtaaatcttcgtctagatcaatgatccagtgatttttttctgctaattcgtttgcttgtgtgatgatcatttcttttcttttttgtggtgaagcaataacaaattgttcatttaatttttcttcgtattctttcgcatgcgcaaatgtcacatcttcgcctaagaaacgatgacctcttgaagctctgtctgttttgatatccaagatctcaaacgggattacttcgtcatctaacaatgccacgatccagtgaatagggcggatatattcaaaatcgtattctgcccaatgcatcgttactgggaaagtgaggcttttaatgacatctgctaaacctgtcaatacttcttttgcttctttgccgtgagtgtatttcgttacatagacatattccacgccttttaattctctaaaagtgatagcatctgtcgtcagaccttgtccgcggacaaatccttccgctgctttcgtccagtttccatctgcgtccaaagcaatttttttggctggtcctttgacttcttcttcactgtctgcttgacgttctggaatgtttgttactttgattgctaaacggcgcggtgtagaaaatgtttcaatcgtatcataagtcaattggttttcatctaaaaattttgctgttttttcttctaattgtttcatgcttggtgtgacaacatgagcaggcatttcttccagcccgatttcaagtaataagtcttttgccatcttattcagcctccttcacgttttctggatttgctgtgtttttattcaataaagggaatcctaatttttcgcgttctgccacaaagattttggctacagaacgagccatgttgcggatacgggaaagataacctgctcgttctgttacagatactgcaccgcgggcatctaataagttgaatgtatggctgcatttcaaaatataatcatacgctggatgaacaagattttcatcgatacagcgtttagcttctttttcaaaacgatcaaaattgcttagtagcaagtcttggtcgcttacttcaaaagaatatttggaatgttcatattctggttgtttgaagatctcgccatatttcacgccatcagcccattccaagtcatagacactttcaacttcttgaatatatgaagcaagacgttctagtccataagtaatctcagaagtaactggtttacaaggtagtcctccgacttgctggaagtacgtgaattgtgtaatctccatcccatcaagccatacttcccaacccacaccggcacaacccatcgatgggttctcccagttgtcttcaacaaaacgaatatcgtgttctaatggatcaattcctaaaagacgcaagctttctaaataaagctcttggatattttcaggtgaaggtttcattacgacttgaaattgatgatgctgatacaaacggtttgggttttctccataacgcccgtcagctggtcggcgggatggctctacataagcagcattccatggttccggtccgattgcccgtaagaatgtatatgggctcatcgtacctgctcctttttctgtatcataagcttgcatcagcatgcagccgtttgatgaccaaaatttttgtaatgttaaaatcatatcttggacggtcaattttttactcatctgttttgcccctttcaatttttaagcgttgctgtcaataagaatacaggaaagaaaacgacaaaaagtccctatgtctgattacagacatagggacgaataatttcgcggttccaccctacttccgaataaagattcggcagcttcatttatcgtactcgcaagtgcctcttcaaaaatcgtttgggtccggcttccactctcccgaactcgctaaaccacgtgttttttactgatcttggtcaatgtacgtattcattttgcagttttcttgtttatataatagatcctctcagtgaacgatctatttaatctacggttaataatagacggaagtccctgtatttgtcaaatagttttgatttttttgttgtatctttcatttattcttctttttcaggtatctctttttcaggcatatttttctctggcatctttaatacgtgtgcccaagacttcatttgatcaatgaactttttgctttttagatgaataccgacatattcatcatacaactggtcaatgaggtcacggattgcctgcttcgtttcttctttcaagtggattccactgatcttatcataagaaatagccgaaaacattcgaacgaaataaacagcgcgaggatatgcatgataacggtgttcgtccattggccagtgtttctcgcatatcacgccgccatatttggaagaatagtcaaattttccttttgtttccccgcatacgacacagtgcgtccaaattggcgcgattccgaagcgttgcagtatttgaacttcaaagatattcgtgatgatttctgcatcatctccttggtccatccgctgcagagcttgttgcgtaaattggaataagtgcgggtcatattgatgatcttcgattgctgcatctactagatttagcaaatacgtaccataaccgctcaaaaagatatcttcttggatgttccgaaacgcatggacgtctttgacactgcttaaaaacgacaaaccttcacttagaaaattaccgatatagactgcttcggtaaaggggagcaaagccggagctaatggctgattttgccgatggattcctttgatataaaacatcattttgccagaagattccgtaaagattttgactaatttatctttttctttgtaattacggctagataaaatcaagcctttcgattctgcaagctggctcatattctccctcctaaaaaataaatctggaaaagcagattctgccgatccagattatttatgttacgatctttcgctgtttttctcaacgtacggatttttatccagtttatttctatacctaacctataagaagtccagaatatcagtactcgtcttttcggtagccgaagtcttgcagatagacttttttgtctcgccagtctttttggactttgacccaaagttctagaaatactttgtctcctaaaagattttcgatatcctttcttgctttcgttcctacttgcttcagcatttttccacctttgccgataatgattcctttttggctatctctttcaacgatgatcgtggcctggatatggattttatcattctcgtttcgcttcatcgaatcaacaacgactgcgacagaatgaggcacttcgtctcgtgttaaaaacaagactttctcacggatcaattcagaaacgatgaagtattcaggatgatcagtcacttgatcatctggaaaatattgtgggccctctggcatttcactgactaatacatccattaagcgttcgacattgtttccttctgtagcagagatcggaatcacttgtgcaaaaggcatctgcgtcgaataatcttcgatgattcccagcaactcgtctggatggatcttatcgattttattgataatcagataaactggagaatgcacgttttttagacgttcaataataaaatcgtctccccggccgcgtttttgatcagcactgatcataaataagactgcatccacttctttcaacgcactgtaagctgcttctaccataaaatctcctagacgatgctttggtttatggattcctggtgtatcgataaaaatcagctgagcttctggtgtagtatatactccttggattttatttctagttgtctgtgccttgtcactcataatggcaattttttgacccacgattcggttcaataatgtggattttcctacattcgggcggccgacgattgcgacaaaccctgatttatgttctggcatatacgttctcctttttaattaaacaacaaatgatatattttagggacaaataaaatcaacccaatgatgacagcaaaacaagcggtcactaaaactgctccagctgccatatctttgatttttttcccaatcggatgaaaatgaaaatccgtaaacatgtccactacattttcaaaaacagtattgatgatctctactatccaaacgagaaaaacagctaaaagcagccataaccactctatccgatcaatctggaaaatcacgcccataaataaagcaaggataccgaacgcaacatgtttcctcatattgcgttcttcctcaaaaacggttttgactccttggacagcaaattccacggacatcaggaaatgtttgtttttctctacgtttttatcttttgagtccataggcatccaagatctctttctgtaaaccaaacatttctttctcatcttctggtgtcatatggtcatacccgttgatatgcaagaatccatgtaccgctaaaaagccaagttcccgatcatatgaatggccgtaagcttctgcttgttcagcagcacgttcaatagagatcatgatgtctcctagtacacgaggcaatggattctctccatcttcaaaaatcactgggatttcgtcttcgccttcttcttccagagcaaaactgatgacgtctgtcggtgcatcttttccacggtaatcacgattgattacttggattgccgcattgtccatgaaagtaacagacatttctgtttcctctggcagctttaaataagatgctgcaaattgcagcaagtcatcgatttctttcattttctcttctgagacttggtttgtttcatccataaaggtaatatccattatacatcgcttctttctattcttcttgttcttcctttatcttctcaacttctgttttcattttaggatatttgatccgagaatggaaggtgctacttaaaccgctgatcaatgatttttccacttttcggatttctttcaaggtcaatccactatcgtctaattgaccatcggaaatacgctcttcgataagattatggacaaaactttcgattttttcgctcgtcggatgttccattgcccgtactgcagcctcacaactgtcagcaatattgacgatccctgcttcacgactttgcggttttggtccaggataacggaattgctcttctgttacttccggattgcgttctttcgctttgatgtagaaataacgcattagcgtggttccatgatgctgtttgcaaatatcgatcaccatttgcggcatattataatcttccaatattttggctccatctgtcacatgtccaaagataatatgtttactgtcttctggcaataagaaattgtgcgggttttccgctcctgaaggcaagttctcaacgaaaaagctagcatgtttgatcttgccgatatcatgataatagcaagctactcgagttagcaaagaacgtccgccgatttctgctacagcgttagcacttagattagctaccatcatactatgatgataagtacctggcgcttcttctagcaactgtttcaataaaggatgatttggattgctgagttcatttaatacaattacactgtcatcattgaccatcaattcaatatatgggtgtagaccgatcgtcagcaagaatgagaagagtgcaccagtgaacccgcagacgagcattaaccaagtcgttgcatcaccaaagctcattccttgatagacgatcaaaatgacatccatcatcactggaaaaataatgacccacatggcagcagatgatccttgttctgagatccgtttacgtctgacaatcgttgccatgagcccagagaaaacataagacatcaagataatcgttagaaagttcgtgccaatcgaatcataaaaaatgaaaagtgcggatactgcttggaaaataccagccatgatccctgctcttcgattcaagaaaaagcttaaaacaagtggtgcaaaagcagcgggataaaacagcgggatataagtagcttgttccgtttggaataattggaaaaatttcatcagcactatgctgactgacatagctgtcacatagaaaagcacgtattttgttctttctcctgcattttggaattgaagtgaattataaatcagtacgccgatttgaagcaaaacagctaaaaccatggcaattagcggaaaaatcgaagttgtttgattagtcagtcctagtaattccaattttttcatagctgaagcatcgatttgattaccttcacgaacaatgatttctccttggaagatcatcactggttgtacagcttctcgtgcggattgtttcaattcttctgtctttttctcattcaatacgtcattcactacgataccttgatccactaagtagcgaatcatttgttgttgtgctggtgtgacattcaaatattggatttgctcttctgcttcttgtttaaaagcttccaattcactttcacgaacttgtttgctcatctgttcgtcaatgagcttcagactctcatccctcacagtatggatctcagtttcagtcatttcaaatatcgtcgaataaaaattgttcggtagtttttgataaaacgcaacattttctgcattaacattttcaaaatttttcttcagcgcggcgatccgctcttctgtagtaggctttgggatattttcatcttcctttgccttatcaatcttttcgtcataagatttgttgatggcatcattcgtcttatcgatcaattcaaatagttgcttgatccgattgttctggtcatctgcaagatctttttggtaagtgtattctggagtgactgcttctgctgccagttttcttttttgttcggtttcttccgtgttctcgatcgttttgttcgcacggatactttcttctgctacttggccttctctgaaatcattggccttttgtttgacactactaaatgtaacgccgcagataatgataaaaaacaagaacagcaggaaaggcaatgctgcctttccaagtttttcttgtagtttctgcagtgttttattcaacatgtgcttatcctcctaagcaaagcttattcttgatggagatctgccttttcataagctttgatgatttcggcaactacagggtgccgaacaacgtcacttgcttcaaaattaacaaaatcgattttcttgatttgttttaatgttcgttctgcatgaacaagaccacttgttgtccctcgaggcagatcaatctgactcgtatctccattgacaatcatttttgattgataaccaagacgtgtcaggaacattttcatctgagcaactgtcgtgttctgtgcttcatccaaaataacgaatgcatcatccaatgtccgcccccgcatgtaagctaaaggagcaatttcgatcacgcctcgttccatcaatcggttcgtatgatctaatccaaaaatttggtataaagcatcataaacaggacgcagataaggatctactttttcttttagatccccgggaagaaagcctagattttcccctgcttccacagcaggccgcgtcaaaatgattttttgcacttcacctcttttcaaggcagcgattgctaatactactgcaagaaaagtttttcctgtcccggctggtcctacgccaaatacgatatcatgtttggctaccgattcgacatatttcttttggccgctgttttttacccgtataggttttccattacggtctttgacgatctcttcctcatacatctcaacaaaataatctaatgtgcctttttgccccattttcagtgccgtcacgacatctggtgtacttacatggattcctcgtttgatcaattcctgcaatgtccgaatgactgaggcagccaaggaaatctgggattgttcaccaatgatctgaatgatttctccacgtgtatggatggttgtttctgttgtttcttcaatcagttttatatgcttgtcgtgtgcacctaaaagcatgctgacatcatcagcagccgtcaatctaatctctaaagaactagactcttccgtcaaaaatagacatcccctttttttcgattcattctttcctattttaccatactcagaagaaactatatagcaaataagaaaaggttctaaaagagttgcttaaccataagtaccaagaaacgttaaaaaatagctgcttccattctctaaaggtctcgtttgaataaaaaaagctgatcatgtaagctatgcataagatagaggacaagtattctctgggtatttttcttgtttcaaaaaaagaaaacaaaatatttgaaatattcttgcatttcaaaaaaaacaggtgtattataacgtcaacaaataaatatacagcaaagcgtcgaggaaaacagtaggctattcagcgatttattcccagtgagtcatgtaagtgagaaatgacaataaatcgaatagacgaacatcatttccgagtcaatgtcgaaaacgtagatcattgtggctgcctccattatcaggctagcggataactttatcgaaaagcgtccgtgaatgaagaagcttttttaagcgaaaaaaggtggtaccgttctagaatctagagcccttttcccaagtggaaaagggctttttttatattttaaggtggtggttttcatggaatctgatattagtggtatttctagtttctgcaacgtttattttgttactcaaaatgataattattggaggaaaaatttatggaagaaacaaaaacttattcatggaagcaattattgatggtcagttcacttatcttcgggatgttcttcgggtcaggtaatctgatctttcctgtccacttaggtcaaatggctggatcaaactggatcagcgctggtgtaggatttgccatctcaggcgctcttttcccattattagctatcttagctgtagtagtgacaaaaagtgatggtctgtatgacttagctaaacctgtcggaaaatggtatgctgccttgttcttgatccttgttcatttaacaatcggaccattctttggtacaccgcggacagcagcaactgcttttgaaatggctgctaaaccctttttgcctgaaaaatatgattcattaggtatgtttttattctctgctcttttctttttacttgcttatttccttactgtacatccaacacgtttggtcaaatatgtcggaaagtatttaaactccttgtttcttgcattattagctatcatttttgtcgtttctttattccaacccatggggaatctaaaccaatctgctgcagattcttatcagacgaacgctttgacaaatggcgttttagaaggatacaacacggttgatgcagtagctttacttgctttaagtgtcacttttgtccatgcagttcgtgatcttggttttaaagataaaaaagtcacagaattaacagcaaaagctggtagcctgagcgttgcgttagaagtcatgatttattttggtctggtccttctcggtgcgatgagtttgaataagatgtctttgtcagaaaatggcggaactgcactttctcagatcactaatttttatttaggtaacttcggtgctagcttcttaggggtaatggtcacattaggtgtcttcactaccgctatgggactcgttgtttcttttgcacaagatttccataaactgttccctaaagtcagttatatgacatggctgcggttaacgacttttgtctcttttgtcgttgcgaatgccggattggataatatcatccaatggtctttaccagtattgatgcttttgtatccattgtcacttgcgttaatcttgctttccttaacagcaaaattcttccaaaagagtccatttgtctatcaagtaacgatgttcttttctgccgttccagccgtattggatatgttggcaaattcgcctgcattagtgagtcagcaaactgtcgtagcaagcttactaggattttatcatcattatgttccttttgctgcattaggacttggctgggtcgtcccaacgttgcttggttacgctggcagcttgctcttttattatgtatatcgcgtatcaggatataaacaagaagcaagtgagttaccagaagaataaccaaatcaaacacaatttaacataagagatattaaacaggaaaaaacagctagaagaaagaatcttattctttcttctagctgttttttagttctttttttggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcgctaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgatccagaatgaggttcattctgacccagatttgattttgtacaacccatcagtccttattgacaaagagccctttttttacgaacacaaaaaactgcggacaatcactgtccgcagcttaaatgataaaattaagattgtaatagttctttcacaatcgcatttacttggtttccatctgcttttcctttgactttaggcataattgcacccataactttgccaaattctttcattgatgaagcaccagtttgagtgattgcttcttgaacaagttgtcgaatttcttcgtcggaaagttgttccggcatatatttttcgactattacaatttcactttttactttttcagctaaatcgtcacgtcctgcttcttcaaactcatgcaaagaatcacgtcgctgtttcatttcgcgagacaacaccgttagttcttcttcttctgtcaagtcgtgaccttctttaatctgctcgttttgtatagatgacttgatcattcggatgacttgtaaagattccttatctttcgctttcatcgctgctttcatgtcatcgtttaatctacttagtagtgacacactaccaactccaattcatcacagaactagaattttttgcgttttctagctgcttcagattttttcttgcgtcttacacttggtttttcgtagaattcacgtttacgagattcttgtaaagtacccgcttttgacacggaacgtttgaagcgacgaagagcatcgtcaagtgattcgtttttgcgaacgactgtttttgacatgttaattccctccctccgagcttaaaaagtaaccgtaattgttattgaaatatatctcaaaaaacaagactgtcctgtaaatattatatctaatgctgttttgaccgtcaaggaaatcttgcttttttttaaaattatcaaatgttattttatttaaatccttattgacaattttcacatcttccgaaaatctcgaatctatgcccttcgatcgtgcatccacctagctgttcttcgaaataattcatcggacacatatggatttctttcgttgttccgcacactgtacagataaaatgatggtggtggccgatttccccctgacagcaatgaaaacgaaacttcatttctccatttaaatcggtttcttccagtaaatcgatctctgcaaaatcatggagattccgataaatcgtatcataacttacccctttgaattcctgattcatatagtcaaaaacttctttagcagatacgtagcggttacgcttcactaaataagttaacaatgcttctctttttttagtatatttaaaaccgttatttttcaatgtttctaatgattgttcgatcaatgtctgttttttcatgacttattcctccaaatcaaaatgattacgaagtacgcattctagagtatggtataataaacataaaaaaaatgcaagtgaggttttatccatgtcttccgattctacagaaatcgttactttttttgtcatctccgactctgctggagaaactgcgacaaaactagcgcaagctactatggctcagtatcctaccgttgagttcaacctattccgcagaacgttcgtgacagatgaaaaaacattaaggcaggcattgcaagatgcattagaagaaaaagcacttgtcctgcatacattaatcaatcaagaactgatcgagataacacgttctttttgtgaagaacatcaattatttagttttgatgtgatgacgccaccaatatcagaaattgaacgtttaactggtatcaagccaattcggcaacctggtgccctccatttattgaatgagaactatttcaaacggatcaaagcaatggaatttgctgtaaaatacgatgatgggaaagaccctcgtggttttttagaagcagatgtcgttttgctaggcgtatcccgaacttccaaaacgcctttgagcttgtttttagctaacaaaaatttaaaagttgccaatttacctttgatcccacaagcacatattcccaaacagctttgggagatcgatcctaaaaaaatcgtgggactaacgaataacccagatattttaaataatatccgtaaagaacggatgcgctcttacggattaaaccctgatactgcttattccgatatcgaaaaaattagagctgaactcgattttgcgaatgatctttatgaaaaactaggatgtgtagtgatcaatgtggcatctttatctattgaagaaacggcttcgcttattttgaatgctttagacctagaagatcatagttattatggaactgaaacaacagaaaatagcgattaatcatttttgtctttttcttaaaaaacactggagtgtgacaacgaaatttcttcgttgtcacactccagtgtttatctatttgcacctatcgttattgatgttccacatgtttgagtgtctggttcaaaatatccagtacatgagaatcatcaagactatacaaaatcgcttttccctcgcgatgagacttgacgacatgattttctcttaataaacgtagttgatgcgatacagcagactgctccatttccactgcttgggtgattgctgtcacattttgttccccgtctttcagatatagcagaattttaagacgagtgggatcactcaacattttgaataattgactgactttctctacttttgatttttgcgtgtctggcaatccattcacctccaacttgaaaaaagactgacttctaaagtttaccactttttccatcagtctcaagttttttattcttctgtcatctttttgataatcgcttcataagaggctactttttcggctgcgtcttctgtagagcttccttttacaccaatataaaacttgattttcggctcagttcctgaagggcggatagcgatccagccattttcttccaatgtatatttcaatacgtcggatggcggtgttgttagtttttctacgtttccttcacggtctgttcgcgtcaattctttaaagtcttctgtttgaataacttttgctccggcaaattctgtcggtgcttctttacggaatttttccatcaaagcagagattttcgcagaaccttcttgtccgctcattgtcacagaaatcgttttttctgcgaaatagccataggtttcaaaaatcgtttgcaagccgtcatacaacgttttgccttgttttttatagtaagctgctacttctgctaataaaagcaatgcttggatcgcgtctttatcgcgaacaaaaggtttaactaaataaccataactttcttcgaatccaaacataaaagtatgtgaatggtcttcttcaaattgttggattttttcagcaatgaatttaaaccctgtcaacacattgaacatggtagcaccgtagtgttccgcaattgctgtaggcaattcgctggaaacgattgatttcaataccgctgcgttttctggtaaagtgcctcttgattgatgtgcttccaaaatatattgagcaaacaatgctccgatttggttcccagtcaatacttcataagaaccatctggcaaacgaaccgctgcgcctaaacggtctgcatcaggatctgttgcaatcagcaagtcagctccttctttttctccaagtcgtatagcatattcaaaagctgaatgttcttctggatttggcgatttgaccgtagtgaaatctggatctgccacagcttgttcgggaactagtacgaattgttcaaatccagcttgtttcaacgcacgttcgcccaacattttccctgttccatgaagtggtgtgtacacaagtttcaaatctttccccattgtttccaccaattcatgatcaatcgttactgctttgatttcttctagataagcagcgtccacttcttctccgatgatcgtgatcaacccgctatgtttagcttcttcgtcagataatacttcgacttttagcggattgctgacttcacgaacatatttcgtcaatgcatctgcgtctgcaggaggcatttgtccgccatcttctccgtaaactttatatccattgtaagccgctgggttgtgagatgcggttaccatgattcccgcaaacgtcttcaaatgacgaactgcaaaagaaagctctggtgttggacgcagactttcgaatacataagacgggatattgtgatgtgccagtgttttggctgcttccattgcaaattctggtgactgatggcgtgagtcataagcgatagcgacacctcggcgttttgtttcttcaccttgtgtatccatgaaacgtgctagtccttctgttgcttgtcttaccgtatagatgttcattcgattgatcccaggtcctaagattccccgcatgcctgcagtaccgaattccaacggtgcataaaaagcatcttcaagtttttcaggatcttcacccagatcatttaattgtttttttaagttttcttctaaattttcttcatgtacccattgttcatacacttgttcccaagacatgaaaataacacctctttctgaaatatggttcttaataagtatagcattcacttattagatatgaaagtatgaggaccaaaaaacgcttaaatcaagaaagaattcttttatcaaaaggtgttggacgtgttcgcataaatcagattcagtaaatttcacgcgaaaaaaaagagtaaaagaacaattgaaaccgttctttcactctttttaaacttatgctgttgtttcttctaaagactccaagtatttatacacttgttgtccagcaataccgccgtcaccaacagctgtagtgatttgtcgcaaatctttttcacgaacatctccgatggcaaaaacgcctggcatattcgttttcatttcgttgtctgttggaatccagccagcctcgttcgtcaaacctgcttctctaaaaggtgcagttaatggatccagtccaacatagatgaatactccgtctgctgctaaatcaaattcattgccggttttgacattacgtgctttcacacctgtcactaccatttcgtttccaacgatttcgtcaacgactgtatcccacataaaggaaattttttcatttgcaaatgcacggtcttggatgatcttttgtgcacgtaattcatctctacggtggacgatcactacttcagaagcaaattgtgtcaaatagatggcttcttctactgctgagtccccacccccgatgactactagacgtttgttacggaaaaacgcaccatcacagactgcacagtaagaaacgcctcgtccagcaaattcttcctcgccaggtacgcctaatttacggtggatacagcctgttgcgataatgactgtttttccttcgtaacttttatcttcacagatgacttctttatggctgccgtgatccttgatatcttgaacgattccataagcattttctgtcccaaatcttgagacactttcatacatcttataagctagatcgggacccatgatcgaatcgaatccaggataattttcgatttctgccgtattgttcatttggccgccaggggcaccttgttcgatcatcaatacggataagtttgaacgtgaagcatataaagcagcagtcatcccagaaggacctgcgccaataacgattacatcatacatatgtagattctcctttacttaatcaagtaagcatactttacagccaatgcgaaaaaaagtctattgttctgcttgcgtttctcgaatagctttattatactcgaaaaatccgctgaaaaacaatagacttttataaatcattgatcaatcgttcgaaagattttctccatttgaatcaattacttttttataccagttgaatgattttttctttgaacgggctaatgtgccatttccttggttatcacgatcgacataaatgaatccgtaccttttcttcatctcaccggtaccagctgatactaaatcaatacatccccaagtcgtatagcctaatagatcgactccgtctagttctactgcatccttcatcgcctggatatgcgctgccaggtaatcgattcggtaatcatcttccacataaccattttcatctggcgtatcgactgcacctaagccgttttctacaataaataatggtttttgataacgatcataaatatcattcatcgttattctcaagcctaatggatcaatttgccacccccattcacttgcttgcagatatggatttttgacagaagcaaagatatttcctgcagtctgttccaagagttcgttgtcggtagtcgaaactcgggaagaataataagaaaaagagataaaatcaacagtatgttctttcagcaatgcggcatcccctggttccatttcgatctgaatgccatttcgctccatttctttcaatgcataagcgggatattctcctcgtgactggacatcaatgaagaaataattttctcgatctgattttctagaagcccaaacatcttcaggattgcaagtgtatggataatatgctcctgctgccagcatacagcctactttgttctccggatctacttcatgagcaatcttcgttgcgatggcacttgcaaccaactcatgatgtgccgcttgatatttgatttgttcttcattttctccttcttcaaaatacagccctgcgcccatgaatggtgcatgaaggatcatattgatctcattgaatgtcagccaatatttgacaagtcctttatagcgattgaagatgactcggcacagattttcataaaaaccaacgagttctctggaacgccacgcaccatattctttgatcaaatgcattggacagtcaaaatgcgtaatcgtcacaagtggctcaattccgtgcttttggcattctttaaagacatcctcataaaatttcaagccagcttcattcggctctttctcatcccccattggaaaaatacgactccaggcgatggacattcgataagtcttgaaccccatttctgcaaacaaagcaatatcttccttataacgatgatacatatcgattgcaatttttgctggataaaaatgatcctcatcaaattcaaacatttttttctttccggtgataacaggaaaacggtcttttccgattggcacaacatctacgtttgctagtccgcgtccaccttcatcataaccgccctcacattgattggctgctgtagcaccgccccataaaaaatcttttctgaatcccattatacttcctccattatatgtgtattacctgataattctcttgccagttcatcttgaacttcgattccttcttcttttaatcggctgattgtttccttgaattgcggtaaatactgctggtgtgcaataaacaactcatccatgatccgttttgctgtctttcctgatcgtataagtggattgatcgtaaacgcctgtaaagctgtcccataatcaccagtcacagctgcttcgatcgtcagcaattccatattcttcattacttgcaaccagcctctttcagcagcaggaagagaaccaaacgctacatttctcgctccttgtgcgccaacataggcagtgacttctactacacaatctgccggcaggtcaggaacagctccatcattctttgtagataccacgatctgtgtttctttatttccatagattgaagcaatcgtttcacaggcagcgtctgaataataagcgccacctcgtttttgcaattgttcaggtttatggtctaattctggatctttgtataattcaaatagctctgcttctgtttctttcacttgctgcgctcttgtaccaatcgtttgatattcttctaaagcatgttccagcatttcttcttcacggtagtaatagcggtggtagccacaagggatcatgttcatttgttttaattgttctttgaaaaacgggatatcaaagatatttttcggtaatccattatcttcatcgtataaacgatcaatcaattctgccgtgcggtcatttcctttattatctgctactttgtgccaatggaaatgatttagaccggcaaacttgtagatcagctcttcttttttcttgccaagcattgctggttctgtcatcatcgccatcactggcacattgcataatccaatcactttatcccatttgccatatctgataactgcttctgtcaccatcccacttgggttcgcgaaattgatcagccaagcatttggacataaacgcttcatgtcctcaacgattgccaaaacgactggaacggtacgaaaagctttgaatatcccgccagcaccatttgtttcttgtccgatcatcccgtaataactagggatccgctcgtctttgattcgtgcatctaattgaccgacacgaaactgagtcgtaacaaaatccgcatctttcaatgcttcttcccgatccagagttgcatagatcttgacttcatacggagaagcatcccacatacgctgagacatctgactaacgatctcaagcttttcttttccttcttctacatctacgagccagatttctcgtatcggtaattcctcatatcttttgataaatccttccatcaactcgggggtgtaactgctgcctccaccaatcgtagcgattttgattccttttgccatgttctcactcctttacttttttacactttcattatcttttttgtaaacaaaacaaacaatagaaatctgtttctttccaataacatttacaaaatttactgttttctagtggatttttgtaaatatcttgtcaaaaaatgtctattttaagttatatagtataaatccgtttacaaatcattttcaaaaaagttataatttacgtaaaaaaataagaagaaggtatctacatgttattacgtgaaaaaatcaaagaaatctccttttctccttcagaaaatgaagtgatccagtttctcttaagcgattctccagcacttggcgaaatgaccatccaagagatcgctgagcgatgttatgtccacccgtctacactcatccgtgtagcaaaaaaaatgggttttgatggctgggtcagttttcgtaatgcttttttagctgaaacagcctatcttgaagggaattttcaagacgtagatgcgaatcttcctttttccaccacagacggtattatgacgatcgcaaataaaatggcttctttagaacagatgacgattcaagatacactttctctcattcatcatgaccaactgcaaaaagccaagtatttactgctccaggcaaaaaaaatcgtgatcttcgccagtaactcgaatactttgatttctcaagatttcatgctgaaaatgaagcgcatcaaaatggatgtcacaattgtcaccacttttggtgaatcattctatgaagcgtacaattgcacgagcgatatgtgcgggatcctgatttcttatacgggtgaaaataaagtgattcttcgtaccgcagaaatattgaaacaaaatcatgttccaattttagctttgaccagtatcggtgattcaacgctatctgcaatgagtacagccgctttgcgacttacgacacgcgagcgactgtattcaaaaattggtaattttacgatcaatacatcaatttgttatcttctagacgtgttatatagttgtgtttttgcagaaaattatcaacagaatttagtccatctaatttctgtcggtcaaaaattcgataaacgccctatcagctcagccatcatgaaagagcctttcaattttgaaaataaagaagtggaataaaaagaatagttaagcctattccattcttcacctaaccgttcaggtcagtgcggtgataagtgcatcgtctggcccgaccgtctccccttggttttccaaaatatccaaataatccgtgtaattggtgacgatcacaggtgtttctaaactgtatccttccttttcgattttctttttgtcgaagcgtagcaacagatcgccttgtttcactctttctccttgctgcactaagctttcaaaatatttcccttccaactgcacagtatccaatccgacatgaatcagcaattccagccctgtttcagaaaccattccaattgcatgtttcgtcgggaacagggtcatgactgttccgtcaaaaggggcacgtacttctcctttttcagggtagatcaagattcctcgacctagtgttccttgtgcaaaagctgcatccttcgctgcatttagtggagcgatttgtccttgtatcggtgtttttacaatttctttacctgattttttctgtatagcatctgtttcacctgcttcatccttccaaaagaaaaaagtcagcgaaaacccgattaccgaagcaatagcaatgccgataaacgcttgaaacataccactggcgtctgtttccgtgatgtagtttaccaccccaaaaatccctaatccgcccattgtgtagctgattgttccagatgccatcaaatagattcctgaaatggcaccaccaatcatcgagtaaataaatggcttcttcttcggtaaggtgattccataaatagccggttctgttacgccgaagattcctgaaatcacagctggcatgcaaagcgccttcattttttgatccttgaacttgaaatacatcgccaataccactgctgtctgtgcaaaactcgcgccataaacgcctactaacatctgactccacccattttgcgctagctgcataatcgcaagagggataatactccaatgaagtccgaaaatcaccagtacttgccaaagaaaccctagaactgcaccatacacagctggagaaaagtccatcaatgcttggaatcccgtgcttaatagatctgtcagtatactgacaatcggaccgataatcaaaaagccagcaggaagtgcgattaataacacagaaaaaggaaccaaaaaggtctggacgactgcaggaatccatttcttggcaattttttggacttgtccggcaaatgcgataatgaagataacaggtacgacgctactggtataactgctgcccacccatgggatacccaaaaatgtttcataagccggaagacccagcaagctataaggcgcaggactgccatcagggaaaccactttgtagtgctgctccttgtacagtcggataacaaagtgctgcaccaatcacgagccccaccatcggattcagatgaaattttttcgctgctgtgtaccctaagatcactggcatgaaataaaaaattgcatcccctatcccattcagcatgatgtacgtacccgatccttcagtataaaatttgagaaacaagaacaaagcatttaatcctttgaccattcccgctgcagctaaagcacctaaaaaaggctggaaacagccacttaatatgtcgattaatcgattgaacagattactacttgaagaaacctcttcttctacttcatcggaaatcccggctactgtcagtacttctgcatagacatctggcacatgattcccgattacaacttgatattgcccgccgcttttcatgatggtgactatcccttccatctttttcaaaacatcatcctttgctttattttcctcctttagtttgaaacgaagtcgcgtcacacagtgtgtcaagctacggatattttcttttcctccgatattctttacgatgttttctgctaattcctggtattttcccatttctattccctccaattaattagtggaaggtttagccaactgaatgtcactacccttattttcatacgttcttgttaatttgtcctccttttttatttatttacaacgattctcatgcactaaacgcgcagtatggatcgttaaatacattttttcatccgtggacatctggtagtcgaaagccccggttaaaaagtctgctattttctcaacgcaaccaaacgtatccttatattttttttgaacaacttggaacaattcctcagaaacttctccatcttctgatttcgctccatctagaacacgtgtcagaaaaaaacgcaggtgtgtgacgaatcgaaaaaagtggactgaatcttcatcaaatgtaatcttatagtaatagcggacgatatttaaaatatcctgtattgttgtggtaaacaggtaggtattgtcttgctggctttgaatgccttgtgcattgactaaatgcaatgcgataaatccggcttcgtcttctgataacttgatgtggtatttatccgagattttcttcactgtttttttcccaatggcatactctttaggaaacagttgtttgatatcatacagcaatacatttggcacaaagatccccattttttgacgttcgatagctgtatacaagtgatccgtcaatgaaatatacacagaatcatttaaatggacttgcagagcctcttttgtatattcaatgatttcacaagaaatttctaagtactcaagaggaatcgcttgtgccaattcttggaactgttgtgaaagtccgtcattggtcaactgaaattttttgtcgatgcatgaatcaagaatcgggtcacccaccttctttttgaatgccaatccttttcccatcacaatcatttcccgatctctttcatcccttgttattacgacgttgttattcagtactttctcaatcagcatgttttgctcctttccatgatatatagggctgtatccaaaacaaaaagaaaaacccaaaaagccgtccatgaaaccatgggagactcattaggtttagcttgcatcaggcaatcactatccaagttgtatcgttttctttatattatcgaaagcaaacgattttgtcaacgctttcttaggggctattaggcacttctgactagctgacgtcgtcttttttaaatctggtaactacgacactaactctcacagatgaaaaatatgggaagctatgttttattttcactctagtgcttaggtcaaaatgctactgtcacaacatcttttatataccactgctttgcagtttgtacatatctgcatacaaaccattttgcgctagaagtgtttcatgattcccgcgttctactatatgacctttgtctaaaactaaaatcaattctgcatctcgaatcgttgacagccgatgggcaatcgcaatcgttgtccgtccttgtcgcattttcgccaatccttcttggatcaatccttctgtttcagtatcgatatttgctgttgcttcatccaatactagaattttaggatcagtcacgattgttcgcgcaaaagtgatcagctgtcgttgtccactagaatagctggcaccatgttcgatcacttttgagtgatatccttttggtaattcatcgatgaatttgtttgcttgaacaaactcagccgcatggcgtatctgttcgtctgtgatagctggattcatcatccgaatatttcctgcgatatccccataaaacaagaaagcatcttgcaagaccagccccattttcttacgtaactcttccattggatattctcgaatgtcatgatcatcaatcaatatctgaccttcataaaattcgtaaaaccgcatcaacacattgatgatcgagcttttcccacttccggtgtgtcccactaatgcaacggtctctcccggattagcaacaaaagagatattgtttaatacattgtgctctccatcataagaaaagcttacattgcgaaactcaatcttacctgaagtaatcatttgatctgctccagggttttgttgtggtgcatattcttctgtatccataatcttcaagatacgactaccagcaaccatcccatctgtgaagatgctcaaaaagtccatcatttgagacattggattaaaaaatccctggacataggtcgtaaatgcatagatcagtccaacttctacgggagaatgcaacgcatcgatcccaaacaaagtcaacaccaacgcaatcgccaatgcatatagaaaattgatgatcggacttaacagaatcgaatttgttttgatcatcgcataacgcgtgtctaaatactcattgttcacttgttcaaattctttagctaaacgagcttcttggcgaaactgctggataatacgcatgccggaaatcgattcattcaatttcgtattcagctgacttaatttttcccgcatattccggtaaatacgagaactaaatttctggtaataccagatgactattcctaaaattggcaagaacaccaaagtccacaaggcaatttctccattgatttgaaacatggcaatgaatgaagaaacgactgcaaagatcccagtcaataccatcaaaaagacgtaccaaaattcaaatagcgtttctgtgtcattcgtcactcgagaaacggttgatcctgccggtgtctgatcaaaataacgcatacctagtgtatgcagcttttcaaataattttaccctaatatactgataggtcttcaatgaagccatggaatacaaataccattggaaaaaccaaatgatactttttactatgactccaaataagtacataccagcaaaaaacaaaataacttgtgtcgtagccgactgtttagccagatgatcatccataaaagtttggatgatccttggcaataggacattgatcacagacagagcaaacgcaaataagatagcaacgatgaacgttcttctaaaaggtttggcgaacttcatcagtcgtttgatgatctttttctgttctttaagtggaatcgattttgtccattccgattgataattttcatccatcaggcctcgcctccttctatcttcgcttctaattgctgtttctcccacatttgttcataccagccgcctagtgcaagcagctcatgatgggttcctcgttcaatgattttcccttgatcgacaacaatgatttgttttgcatgcatcacgctacttaaacggtgagctgaaatgatagttgttttctcttttcttatttcttttaaattatgcaagatagcttcttctgttttggcatctactgcagaaagtgcatcatctaatattaataattcaggatttttgatcaatgctcgagcaatcgaaatcctttgtttctgtccgccagataaagagactccacgttctccaactaaggtatcataaccttttggtaattccttgatttcattgttgataaatgctaaagaagccgcatgctctacttcttcttctgaaagttttggattagaaaaacggatattatctcgaatggtcatcgaaaacaagaagtgatcctgaggcacatagccgattgatcctaataaagcattcaatgaatattctttgatcgaacgtccgccaaattggattttcccttgataatcatcgtattcacgcatcagtaatttgatgatcgtcgtttttcccgcaccagttttcccaacaatacctaatgtttctccttcttggattgcaaacttgatttgttctaatgctggtgattcttctttcggataattaaaagaggaaatagctacattcagctcgccttttgccggggtctgcactgcacccagttgttccacgatatgcgttttttcatgcaaaagttcattgacgcgatcataagaagcatttcctctttccaatacgttgaacaatcgaccaatcgcaaacatcggccaaacaagcataccgatataactaataaatgagaccatctgcccgatcgagatcgtgccttccaagacatactttccacctaaaataattgttgcaacataagacagaccgataatcaaggtaatgaatggatcaaataaggagtctaaaaaattgactcgtttgtttttaataattgcatcttcaatcttttcttcaaaatccgctagatcttctttttcttgtccaaatgttttaatgactttgatcccagtgatactttcttgtgtcttatcattgatactagaaaaagcttcttgcgaatcacgaaaagcatcatggagtttcgaccccagcactcgtgaagtgacggccagcaaaggcagaggaatcagcgcaatcagtgttaagcgccaatcaataaacaaaatcatcgcaatgatcgttgttccgcccgtaatcactgaatctgcaaaggtcaagataccagctcctgctacattctggatcgcattcaaatcattcgttgcatgagccatcaaatccccagtccgatatttttggtaaaagagattgtccatttctgtaaaatgtttgaataactgctgccgaagttctttctccaaccgagctgcacttccccaaatattcgtccgccagatataacgaaaaagatattgtaaaaaagcagcgataatcaataggaagatccacccgaaaatgatctttactgataaatttttatcggcaatctcatcaatgatgatcccaatcacttttggaggaactaactgtaccaaggccactgcgaatagcgagaaaaccccaattaaataatgtttcttttcctgacgaaaaaaccagcctaactttctaaaaatcgacattttactcctcctttgtctttatcaagagcctaggattgtctgtgcttgtctttttgctgaataatctgaatagtctaacaaattacgaaataaaaaacggactgaaaaaatcagcccgtaaaaagtcgttgggtcagaacctattttttcccttggttcttcatttgctgcatcatctggcgaattttcttctcagatggtttttgccccattgacatcatcattgatcgcaacatgtcctcattaacgggaggatttttttctaaatagtctttcatatatttacgcgctaggaaaaagccacctactgcgccgattagcaaagcaataatagcaataagtacgacaatacctgttgataacatataaatctctcctttctatttccgaattgctctcaatgacttattttactaaagtttattgaaaaaagaaaggcgtattctttagtttcatgcaaaaaatagtggtttttttagaggagaacaaaatttctttcgtcatctagcaagacacgccacgaaaaaaaattaggcataccgaatctttttctttaattttttctttttgaggtgtagaatgtaatcgtagataaataggaaaggtggttttttcttgaataatcaatccaacaaacaatttcataagcatcgacttattgaacatacaaatggtttatctttagctgaagtaaatggaacagtggatgtaccaaaggggaaaagtttttttaaaacacttcttgcttactctggacctggtgcgttagtagcagttgggtatatggacccgggtaactggtctacttcgatcaccggaggacaaaatttccaatatttattgatgtcagttattttgatgtctagtctgattgctatgcttttacagtatatggcagcaaaattaggaatcgtgacccaaatggatttggcccaagcaatccgagcacgcacaagtaagacattgggtgtcattttatggatcttgactgaattagccattatggcaacagatattgcagaagtcattggtgcagcaatcgccctctacttactttttgatattccattggtgattgccgtctttattactgtattagatgttttcgttctcttactactgacaaaagtcgggtttcgtaagatcgaagcactggttgtctgcttgattttcgtcattttattcgtttttgtctatcaagttggcttgtctaacccagattggcacagtttatttgctggctttatccctaacagccatacattctccgactcacctgtcattggtggcgaaactccgctaactggagcattagggattattggcgcaacagtcatgccacataacttatatctacattcagcagtttcacaaactcggaagatcgatcaccaagacgaagaagatgtagcacaagctgtacgtttttctacttgggactctaatatccaattgtcgatggcttttctagtcaatgcgctgctattgattatgggtgtcgctgtcttcaaaaccggttctgttcaagatccttccttttttggtctgtatgaagctttatctgatccatcagctatgagcaatggtatcttgattgctgtagcaaaatctggtatcttgtccactttatttgctgtagcacttcttgcttctggccagaactctactattactggtacgttgaccggtcaagtcatcatggaaggattcatccatatgcgtatcccgatttggctaagaagactggtcacacgattgctttctgtgattcctgtattgatttgtgttttgtttacaagtacaaaaggaacgatcgaagaacataccgctttgaataacttaatgaatgaatcccaggtgttcttggcttttgcgttgccgttttcgatgatccctttactgatgatgaccaacagccaagcggagatgggtagccgatttaaaaattcattcatcgtaaaacttcttggctggttctctgtgattagtctaacttacttgaacttacgaggattaccaggacagatcgaaagtttcttcggcgagcaagccacttccgctcaactagcattggctgatcacatcgcttatgtaatcattgttcttgtcctcctcctgttggcatggacgattggtgatttatataaaggaaacaaaaaatatgaacagcgtttgcaggaaatggtagaagaaatcgaataaaaactgatttttccacacaaagacccttgatagttaggttaaaaatctagctaccaagggtctttttatttagaagataaagcttttttcagatttaatttactgaaaactagcatgcttgttactacgatgaattgcgttaacggcacgcctgcgccagtgtagacacttaaaaaataatcctttttttctggcgcataagaacaaaaccacgagacaccgaaaagaaaaaccaattgtgtcagtattaatccggtgaccacaatcaaagaggaactataataggcacgatcagcttttgcaaatacggttcctagtatcataagtaatatccctgctattgaagcaatcagcacgggaatagccagaacttggtaaatttttatgatgacattcgcgacttttgctgattttgttaattggaaattaggtgttctcggttcattactatcgatccaattctccattagcggaaggtttaataattcttgagcctgtttgacttgttcttgcgttccgaaactataatttcctccttgatggaaatctttatatcgccatgcataagcgtatcctgattgaaggaaatcgaatacgattggtagatcactcatcgtctttccatctcctgatcccatcagatagaactcttttttctttttgatggttcccttgtgataggcttcttctaattcttggttgacttttttccaaaaatcattggtttcttttgcattgttttggtaataaccagattcgcttaccacatctcgcaatgcccaaaagatgatatctccgggtaattcttttacttttccaccttgagtccacgcgtgagtcgtatataattcgtcaatacgggtagaaacagtatggaatgtaggagatgcggctaatgctttatttagtgcagcatgtgagacccatatctcactgttttctttattcaagttcgtttcatcatctattcggatcagttgtttcatcaaacgtccaaattctccactggaacggtcattgatggttgcaataccgtatgttgtctcatttttatattcgatccactgatagacgatggaaaagccaactataggaagtaaaaacaatgaaagtttcagccattcccgtttcgagagaagaaagagtcgtttttttaacttctttacttctttgaaagaaaagtcttgccctagcaagatctggacgaaactgatacccaaagctactacagtaaaaggaagaagccagatagaatcttcgcgaatgaaccaaaagaaaggaaaagcgacagaaagccctaaaaaccatggcagcaattttctgctagaaccgtatttgcggtaataaatagctagtaaacaagcgataatgatctcaacagccggaatcacgagggcattacgatacgttcgagtggaatattcatgtgtaaaactaatcggagaaaacaaaaaataaaaatagaaacttaaaagaagatacttgttcttcacgatcggtttaaacgcgagtgcaaccaatatactggcaaaaatactgaacatgccgaacaaaactgcataagaaagatgcagtttatgtgcaagtactaaaaataagctgtaggagattcctttggaaagtgttgtagtcgtatactcccctagccatttaccgtccaaaatattttgagcatagcgaatcagcagctggtcatcataggttgccgacatgtctgttccatagattgctttactatataaatacaaacgaataattgtaaataatagggctatgccaagaataaagtatgtatgtttcttttttagttggttgatcaagggttttaaagtgttcagcatcttttcgtccttccaatcacgttttgccacttgcttgtgaaacttttcgtttttttacttttctaccagtataccctgtttgtctaaatttaaaaagaggggggagaagatgcatgatgaaaaagactgcaaaaagcactcctttgtttcttaaacaaaaaaggacaaggcaatgtgcctggtccttttttgctgctgtcagatagaaaatcttagagtatcacttcttctgctaataactcaggaaacacttctggatcgaatatttgtgctttgaacatggcgatttcttttccatatggtgcgtaagctttctttttatctttgccgacatagggagtttccaagattttcgaaatattgtcaaacattggatcatggacgatcttattcagcgtgtcgaatccgattgttccaaaaccaatattggcgtgtcggtctttatgcgaaccttgcggatttttagaatcattgatatggagtactttaagccgatctaacccgatgatcttatcaaactcttccattacacctgaaaagtcttctttaatattataaccggcatcattcgtatgacaggtgtcaaaagtaacggataatttttcattcaattttactccatcgatgatttgcgctaattcctcaaatgttcgaccgatttccgtacctttacctgccattgtctccaaagcgatttgtgccgtctgttcttttgtcaaaacttcattcaagccttcaataattctagcaattccggcttctgttcctgcccctacatgagcacctgggtgaagtgtaatttgagtagcgcctaaagcttccgcacgaacaatctcttctctcagaaattggacggcaaaaggaaacatttctggtttgatcgtattccccaaattaatgatataaggggcatgaacgacgatatttgttagaccgttttctgccatgtacgcttttccggcatcaatattcatctcttcgatggcttttcttctagtgttttgaggggcgcctgtatagatcataaaagtcgaagatccataactggctgcttcttctgctgctcctaacagcattttctttccgctcatgctgacgtgtgagcctaataacatggatggattcctccttgaaaggcaattgttactaacaattcctatatattggtaagatgatatacaaagaaaatgattgatttttctttgccctgttctccatagtaactgaaattttctctaaagaaaagcttaagaactcttttataaaaaagatcattttctcacgttttaactcctttaaaaaagaaattcctgccaaaaacagccttgtctgtttttttgttctattatttgctataattagcgaaataaaaccattagttgaggtgacccttttgccacgcaaaaatactcgaaaaaaacagaatagaagaaaaaaagaaaaatggtttgttcctaagattatttttagagtttttcaatcattgactgtttttattactgttcttcttttgatgttcgcagctctaggtattggaataggcgctggctattttgcctatctcgtcgaagacacacaattgccgactaaaaaagcactgcagacagaactaggaaacattacagaaacgtcaaagattgtttatgcagataatacagagatatcaaaaatccagacagatctgatgcgcacgactatttcatctgataaaatttcacctttattgaaaactgcaattatcagcacagaggatgaatacttcgataaacaccaaggttacgttcctaaagctgttttacgagcgttagtatctgaagctactggtattggctcttctggtggatcaactttgacacagcaattagtcaaacagcagatccttacagatgaaacaacattcaaacgtaaagcaaacgagatcattctttctgcacaagtagaaaaatacttttcaaaagatgagatcattgctacgtatttgaatgtctcaccatttggtcgtaataataagggacaaaacattgctggagtccaggaagctgcaagaggaatctttggtgtagatgcaaaagatgtgacgctgccgcaagctgcttatatcgctggattaccccaaagcccgatcacgtatagtccatacacgaacacaggtgcgctaaaagaagatctttctgccggccttgccagaaaagattttgttttattcagtatgtatcgtgaaggccaaattacgaaagaacaatacgaagaagcaaaagcctatgaccttacaaaagactttctaccacaacaaatcgcagaacagactgacagagaattcttgtattatactgtgatgaatgaagcaacaagaatcattgcacaacaattggctgaaaaagacaacgctgatatgtctgattcatcggtcagtgacgcttattatcaaaaggcacagcaaacaatccaaaataaaggatatacaatccattcgacaatcgataaagatgtctatgctgcattgcaaaatggcgtagaaaattatggatacatgttagatgatggtgctggcagtcaagtagaaaccggaaatgtattgatggataacagaactggccgcatctacggattcgttggcggacggaattacagtcagaatcaaaataaccatgccttcgatacagaacgtcaagctggctcatcaatcaaaccagttcttgtttatggacctgcaatcgacatggggcttatcggatcagaatcccgtgtatcagattatgcaacaacttggcaagaaggagaaaatgctggcgagaaaatcgtcaatgctactaacgaaggatcgaacaccttccaaaccgtccgtgagtcactagaatggtccaacaatatcccggcttatcacttatatcaagatgtgttgaattccggtggatcgaaacaatatgcttacgagcactacttggcaaagatgaactacccggcaaatgacaattggggcgttgaatctgctcctttaggtacagtagatgtcacgacgcttcaacagaccaatggatttcaggctttagcaaacggcggcgtctatgaagaaggctatatcatcgattccatcacagataacgcaggaaatgtaatttataaacacgaaagcaactctgtccggatctattcggaagcaacggcatcgatcatgaatgacatgatgcgcagtgtgatcaatgcaaaaatcactacaccattcaaagatgccatctcaagcttaaacggaaatctaggaaaagcagattgggtcggaaaaactggttctaccaatgaataccgagattcatggctaattgtctctactccgtctattaccatcagtagctgggcagggcacgatgacaatactggaatggacagcaaagcaaggatacgttcggctaattatcttgccaatctgatcaatcaagcttaccaagcaaaacctgacatttttggcactgatgagaaattcgaattatcatctgatgtgatgaagaaaaaagtatctggatttactggtcaaacacctggaaaagttactgtcaataaaaaatccatccaaacacctggaaaaacagttgaatcgctatgggcgaaaaatggaccgaagaaaagcgcctttaaatttggcgttggcggtaccgatgaaaactatacagattactggaacaccgcttcagcttatgcaagagcgaatcaagcaaccaaagaatcagatgagaaagatgattgatttaatagaatacacagtaataagagattgtgacaatagtattgtcacagtcccttatttttttgatggtggtgaacaaaatgcagcatctatacacggattgttttatatacgataaatgtaatttcaaccactttctctcttttttaagacacaaaaaaaggattataacaaaattttgtcataaccccttttctcgaataaacggtgttctcctgccaactccgaatcacgagtcacaatattcatcaaacatgaaatgctgttttttgaaattgctccttgtaacgcagagttaaacggcaggctcacaacctctgaatggttgtccttttattattttgtagatcctttttcttcgattccataaggcaagataatcgttttttcttcgacttcttctttattcatcattttcgtcaataggcgcatagataccgcccctaaatcgtataatggttgtgtgatacttgttaaacgaggacgagctacttctgtcagtagtgaattgttacttgtgatgatttcgaatccttccggtactttcacgccacgatctaataaaccatccaaaataccgatggctaattcatcatctgaaacatagacagctgttgcaccgctattatggatccgatcggctagagatagaccatctttgaagttgtattgtgcttcaaagatcaatccttcgctatatggtaggttattttcgcttaatgcttctttatagcctttcagacgattttgtccattgataggatcgatcaacgcaccactgacaaaagcgatttttttattgccgctttttgccaatttatttactgcatcttttgttgcggatacataatcaatgtttacgctacctacttgttcatctggatcaatagagccagctaatacaacaggagtttttgaacgtgaaaattctccacggatttcgtctgtgatatggtgacccatgaagatcacgccgtccacttgcttagccagtaagttattcaatacattgacttctttttggtcgttgccatctgaatttgctaagataatattgtatttgtacattgttgccacatcatcgataccacgtgctaaagaagcaaagaacatattgctgacatcagggatgattaccccaactgttgttgttttcttacttgccaagccacgcgcaactgcgtttggacgataatccaagcgatcgatgacttccaagactttttttcttgttgctggtttaacgtttggattgccatttacgacacgtgaaacagtagccatcgaaacatttgcctctctcgctacatcatagatagtgattgtttgcttttccatttgtgttctcccattcatattttatatgttttctgaaaatacgtcttacatttctaaaatagaatatcaaataatctcaagaattgcaaccgttttatctctgttttcatgaaaatttttacttttttcagtttttagaacgttggtcttttaataaatcagtggtacaattattgaatacaaaattaatttagaaagtaggttgccaaatgaataacgtaaaaatcaatgaactacgtcaatggatggcacaacaccaagtcgaattggcttatatcagcgaccctggccacatcgcttacttttccggatacgaaagtgatcctcatgagcgtgtactagctctttttatccctcttgaacaagatcctttccttttcactcctgctttggaagttgaagatgctcaaaacagtagttgggcgtatgatgtccgcggctatttagacagcgaaaacccttgggagatcatcggaaaagaacttcgtactcgctatggtcagcctggcaatgtagggattgaaaagaacgccttgactgtcgagcgcttcgatgctatctctgatatcttgacgggaacggattcttacactgatctaacttccatcatccaacgtctacaactgatcaaaactctagaggaaaaagacaaactgatcgaagctggtaaatgggccgatgttgcatttgagattggctttaaagcagtgaaagaaggcgtgactgaacaagcgatcattgcagaaattgaataccaattgaaaaaacaaggtgtttcacaaatgtctttcgacacattagtccttgcaggagcaaatgctgcaagccctcatggtacaccaggaaatacgaagatttcaccgaatgaacttgtgttattcgatcttggcgttgtttggaatggctattgcagtgatgctactcgtacaattgcttatcaaaaaccaaccgacttccaagaaaaaatctacaacatcactcttgaagcacagcttgccgcacaagaagccgtccgtccaggtgtgacagcaggtgaacttgatcaaatcgcacgaaacgtgatcaacagctatggctacggcgaatatttcaatcaccgtttaggtcacgggatcggaacaaccgtccacgaattcccttcccttgtagaaggaaatgacttagtaatcgaagaagggatgtgcttctctcttgaaccaggaatctatattcctgaaaaagtaggggtacgtatcgaagactgtgtatatgtgacaagcgatggctgtgtgccattcacgactacaccaaaagaattacttgttttagaaaaataagagtaaaaaaggtaagcgccccatagaacagtacctgtacgtcaaataacccgacctatagaatagaatcgggaatgtttggcgtttttagttacgagaaaaatgttgttgtacatccttgttccaaggcaacagttgatctaaagtttctgctgaaagtacgggaagatttggtatcttatcaaatagaaactctagatactttacaggattcaatccgttaagttctgctgttttatatacactcagaatgattcctgaagttcgtgctccttcaagacttgtggaatgcaaccaatttttccgtcctatcaccagctctttgatatttcgctccgcacgattatttgtgagttctaaacgaccatcttcaaaaataggttcaaaaccacttcgtagtttacacgcatattgaacggctgcatccaacttggattttgcaacaggatctatcgttgccatccactcataaaaagcaataaataatggacgcagttcttgttgccgacagcttaatcgcttctcaggagaaaagtctttccatttcttttctaggacaaaccatttatccaattgtttgactgcttgagctgcgggaatatccgtgtttttcttttcttttggaattgcttcgaaaaatttccgccgaacatgcgcgaaacaatagacaagtcgtacactttccacggcattatacccgctatagccgtcacagtgtaaataccctgtaaactccttgagaaaagttttcggaacatctccagcacgactttcgtcgtggtgataataaacgatgggatgctgactgtcttttcctgtacaaaactgccagtaataggtatctgttttggcactttcaatcacacgataacttgtttcatccccgtgtagaatctcttcttgattattatttactcttaatcgttctcctaaagggtctaacgcgttttgcactgctttaatatgccaattggtgatattatctctcgaaatatccaacccatgtgtttgtttccaatagttctcttgccgataggcaggaactttctgaccaaatttcatccggatcgtttccgccactaaactattggaacctaagctattagaaatcaaaggtttaggaacgatcgcttttttaaaagaagaaagtccttctttttcgcagcttttacaacaataggtatgttgataatgggtgagacaatccaacatagcctgatggaaacgaatttcttctcgtacttttgtccgtccgatatctttcatctgtgaaccgcaatgttcacaaaattgttcttccaaaggaaggagatgttctttctctgttataggtaagtgtttgattttgtctgctttcgttcctacaactcgttgatgtccttttactggaataatggtggcagctgcttctggaacacttacagaaatttcttcatcactaaaaagattcaattgcccattcgtttcctcaaagagagtctctttagagcgtccaaataatttgttggttaaataattgaccttttcattcaatagttggatttcagttgtaagattctgaatggtttgttgttgtgcttgattggttttatgggcttcttgaagcaactgaagcaacgtatctgtagtttccaaaatttttcaccaccttgaatcgaactgattttgttacagaataccacaagaaacgcacaagaaataggggttcaacacattttttgtgttaaccccccagcttaaaaaactcctttttttcctggcaaaatagctcgaggttgatcgatacttaatccttctaacaaccatttaacgggttggttcgttaaggttcgaacttcgtctttcgtccgaggccattttaacttgccgttttctatccgcttataacagagaagaaaaccatcaccgtcccaatagagaagtttgaaacggtcttgacggttcccgcaaaataaaaaaacggcatcttcgtaaagctcgagttgatactcttgttgaataagactggcaagaccatcaattccttttcgcaaatctgtttttccgcacacaatataaatatgtttggtttgaagtaaatcataaagcattggacaacagttctttcaaaatagcttgaagaatataattgttaataccgttatagatcaaaacttcagaaccattctctcttttgatgcgcatcgctaacttggcagccgcgggtttacctttttctggtgcactcttttcgtttcctaattggacaggaacaatctcatttaatttatacatagaaaacctccagacttcttgatagctcaagtatatcttgaggtgcatttgttagtaaggtactgttctatggggcgcttactaaaaaaggtgagagctagtccgctcccacctttttattctataaatttgtgattttagtgatttgtagatgaatctgtcattgtatcttttatttcttttttagcttctttcgcatcttcttttgccattttcatcatttcttttgagtcatctgcaactggttttgcttctgacattccttcattgacagtatctcctgctttaccagcagcgtcttttacatcaattatgatatcttctgaagtatctttagcaatacttcctaattcatctgcaggttttttcatatcttctgccgtttttttgaaacgattagataagtcagctgattgttctttaagatttaacaagatatcgtcagattcacttcctgcttcatctgctgattcacttactttttgtttgacactacctgctagatcacctgcttgttgagaaagatcttgcgctttttcttttgcaatacctgttaactcagtcgatttttctttcgccatatctgtgtaatctgaagccatatccatcaaatcatccgcttgggcagctaattcatcccgaagttctttaccagattttggtgctaacaataacgcggcgattgctgcggctgtgcctccgactactgcacctaataaaaatccaccttttttagccatttttattttcctcctgtcgtttcagtatgttttttgtttttaaaaaatttcatcgctgtcccaccgacttttccggcaaccgtcgctttagctgtcgttttaccgattccgccgactttcgtcgcgatgtttttactagaatgattaagttctgatacactttcacttaaatcagcaactgctgtgaacaatggatcgatcgttgcgacttttccattgatatccaagagcagttcattacttttgaccagtaagccttctacttgtctagacaaaagatctacgtcttttgtgacgatttcgatcgtcgtatttgcttctgctacagtctgatctactttttctaaagttttagaaacttgcaacaacacacgaacgataaaaacgacaagtatcgcaaaggcgattgctgcgatcaatcctgcaatttctcctcctgacatgatcaaactcccttcttgtctctcttttctataaggatagcattttcgtgttttttaaacaaataaaaacgagcttcaactactttttattcaattagcagctgaagctcgttagaaaaaagggttattttttcttttcttctttgatttctgttattccttttggattatgatcgatcttgcttccttctgcttctaatgttttacctaaagacaggatgtactcacgtaaaggtgcacctacttctggatgtgttagaccatattcaatacttgttttcataaaaccaaatttgtcaccgacatcgtaacgtttacctgtgaatttacgggcaaatacgcgttgtgttttattcaatgtatcgattgcgtcagttagttggatttcatttccggctcctggttgttgctcggacaatacatcaaaaatttctggagtcaataagtaacgtccaataatagctaaatcacttggtgctttgcttggatctggtttttcaacaaagtttttgacattgtataacccatcttccaatacttctcctggattgataattccgtattttgaagtttcatcatgaggaacttgcataacggcgatcgtagaagcatgagtacgttcgtaatcatcgattaattgctgtgtcaatggtacttcgtcttccattatatcatcgcctagcataacgacaaatggttcatttccaataaaggctcttgcttgaagaacggcatgtcctaaaccctttggatgagattgacggatgaaatgcaagttgacatctgtcgtttcttctactaatttcaataattcggtctttcctttttcacttaggtttgtttctaattcaatatttgaatcaaagtgatcttcgattggtcgtttagcttttcctgtaacgatcaagatgtcttcgatacctgatttcaacgcttcttcaacgatgaactggattgttggtttatcaacaattggcaacatttcctttgccatagcttttgttgctggtaaaaatcttgttcctaatcctgctgctggaataactgcttttttgactttcatatacattcgctccttcaaaaaattgttaatgagaattcattttcttttttcccatcacgtaacatgatttcttttgcggctgttttgatttctttttgttcatacagcacttcatagattgtttgagtgatgggcatttcgatttccattatttgggctagttccatcgctgcttgggtagtattcacaccttcaacgaccattcccatattggctagcacctcttctaggggctgcccttgtcctaacaagttgcctgcgcgccagttcctagaatgaacacttgtgcaagtaacgactagatcgcctactccgcttaatccgataaaggtcagcgggttggcacccattgctacacctaaacggctgatctcagctaatccgcgcgtcatgattgctgcctttgcattatcgccaaaccctaagccgtgaatagcgccagcaccaatagcaataatatttttcaaagctgcccccatctctacaccgatcacatcaggattggtatagatccgaaaataattattcatgaacagctcttgtacatattttgctgcttttgcatctgtacttgcagctgtgatcgtagtgatgtcatgtttcgctacttcttctgcatggcttggtccagaaagaacaacaacagcttttcttttttctactgggatttcctctaacaagatgtcagagatccttttatgtgtcccctgttctaatcctttacttgcatggatgatcactggctttgtattcaatttaggcactagttcttttgcaacagaacgtattgctttcgttggaatgacgaatagcaccgcatctgcgtcttttactgcatcttccatattggtgaatgcttggatggaatcgggtagacaatgatctggtaaataacgttgattcgtgtgttgggtgttgatttcttctacttgtgaagcacgatgtccccaaatccgaacgtcatgtccgttttcggcgaggacttgtgccaaagcagtaccccaagagcctggtcctaaaaccgctactctataattcattttaccactcctgaaatttttttcatttttaacgctctaaaaatcagataatttgttgattttttcctaatgagcggtcataatccggtaaatttcctttttttctgcgccaaataaatagaatcaatgtaccgacaaataacacagcagataataattgagaaatacggatcacacctaaaaagtaaagactgtctgtacgtaatccttcaataaagaaacgcccgaaactataccacattagataacataaaaggacttcaccttttttcaaaaggtgtggtttctttcgtaaaaacaaaagcaaaataaatccaatcaaactccaaagtgattcataaagaaatgttggttgacgatagatcccttcgatatacatattatcaatgatgaattgcggtaaatgcagactttctaagaagcttcgcgtcgtgtctggtccatatgcttcgtggttcatgaaatttccccaacgaccgattgcttgtgctaataatacacttggtgcagcgatatctaaaaaagtccacaaagaaataaaatgatatttagtaaaaaaatacagcgtgatcgcgcctgcaatcagtccgccataaatagctaagcctcctgaacggatattgaatatttggattggatcagctatatactggggaagatcaaataaaacataatataagcgagcgccaataatggagataggcaatccccacaacataaaatctgtcacatcatctgcttttaatcctacccgaacagcctctctgctgctaagccacatggcgataatgatacctgatacgatgatcaatgcataccagtagataggaatccctacaagctcaaaagcaactcgattgatttgtgctaacatattgtcactccttgctagtcgttgcctgagttttcttcaatcaagcgacttaatctttcttcaaatgttttcgttgcgtcaaagcccattgtacgtgcacggaaattcatcgcggctacttcaatgatgattgcaacgtttcgtcctgttttgacagggatttttatttgtggaatgcctacttccgcgatttcaacggtcgtgtcttcagagcccagacggtcgtatttcttatcttttgcccatgcttccagataaacagccaactggacttgcatagagccacgtaccgcactcgcaccaaaaagattcattacatcaatgatcccgattcctcggatttcaatcagatgttccaggattttaggcggttctccgatcaccgttaattcatcttgctgataaacatctactcgatcgtctgcgatcaatcgatgaccgcgtttgatcaactccaacgctgtttcactttttcctatcccactgtcaccttgaatcagtacacctaatccgtaaacatccactaaaacaccgtggacacttgttcgaggggcaaggcgaccatctaaataactggataattctcctaataagcgagaagttgagatgggagaacgcagtacagctatcccattttcatttgctgcctggatcatttcttctggagctggtaatcctcttgaaataataaatgcgggcatatcttcactacataatcttctcatgatgatcaaacgctcttctgggatcatccgttccgcaaaactgatttctttactgccaaatagctgtaaacgattatgggaataataattaaaataaccagtcaactctagtcctgggcgtgagatgtccccagttacgatgacacggtctaagcttttctcgtcgcctgtcacgatttccaaagataattttttcactaattggctaacttttacaacttctgacattcatgctacctcatttctattagagtgttctctatcattttatcattgtctagccaaaagtactaccaattaaaaaaaacgtttttatttaattaccaatgtaatagaaaacgcattcctgattctaaataaaaaaactgcgccgatagttcggcacagctttcttttattttctactgttatgttcgctgacaattacattgacaagcgacatcaagatagctactaacaacgctgcaccgaatgaagaaaaactaaaatgttctgctcccacaaaaaaggaggtcattttaagaatcgctgcattgataacaaacgtaaacaatcccaatgtgactaatgtaaagggcagggacagtatcgtcaaaatcggtttgacaaacatattcaacacagacaatacgaagctggcaagaacggccgtccaaatactgctcacatggaccatcgcaggaaaaagaacagccaatgatatgaatgttaacgtattaactaaaatacgttgaaagtacgacattaaaagtcactccattcgtcatcatcgattttttccgcttctttgcgtttttttgtttgttcacgagtttgttcacgataattgtttttttcataatatgcattgttatgtccatagtttgttcgtgcagaacgcgcagatgggataatcaaagctaataaaatgtataaaatgattggacttccaaaagcaactaagctcaggaatacataaagcacacggataacagtcggatcaatcccgatgtattctcctattcctgctaaagtccctgtcaaaacaacatttttattggattttgtcaacttttttttcatcatgtctcacctctgttctactattttaaatgaagaaaatcgttgtgacaaccttcttcttaatcggtgtctttttgcaaaattctcggtcacaaattaccatattcataaaacgtgacgagctttttttgaaattattccttgtgactcggcgatattggcaagtcataatctctggtaaacggtgttcaagagatagcctatcggcaataaggcacaattttgtaaaataggggaagctattttacaaaatcgcttcttattgctcaaggctgaacatctctttcacaacctctttatttatctgtatcttttaaatagatacttcctgttgtcgttgaaagttgcacttgcgcgatttcaccatctgaaacacgacggaattgcaacatttggtttgtccgttcttttttctcacgaactacttcgtaattggacagacggctgttgatacttccaagacttgttttagcatgtccttccaaaccgatgccatctggtaaagcgactttgacatttccgttcactgaacttgcttctacttttttcaaattatcttctttaatcgtaagacgtacatcaccatttaccaaagacacagaaaggttttctgctgtcgcaccaaatgtcactgtaccatttactgtttcgataatagaatctaagatgttcccgtttcgaatatcgatattgccgtttacaccttctacttccagcatcgttgcagttaattggtccacgatgatgttaccattcgtagattttgtataaatatctttagcttccaatgtttcaatcatgatgttgccatttagaagtttaatagctgcgtggtcgtatactcgtttaggtaagtagaaaacaaggtctgcacgcacacgtttatttggaatttggaaggagatatgatcttcattaacctcaatctggctccgttcagagaatgcttcaaatggttcagcacccatttttccgtaaagtttgatcttagcttcaactttcacatcgttgctgtcccacgtttttaacgtcacgtttccgtttgctgccttgatatcaaggatacttgctgcaggagcttcatagtaaaattcatgctcaaatttcgttgtcgcaatcccagggacacgcaagctgacatctttccattccatgttgtcattcactgtttctgaaacagtttggaatgttttcttcaagaattttcctaactgtgatccagcttctgacattttttcgcctacttgattcagtgtatctgttgcttgatctttccaatcatctggcaattcaaacttatcagtaaacgtttcttttttctcagaccattgattcttacggatatcttttaattctgcttctaatttcaattgttcttctaacagtgtatcgccactagcttctaactctttgatttctgcttctaacgtctgacgctgtgctaattcttcttctgtcaactcgcctaattcttcttttgtattcagctgcatcaatgcttcctgtttctcattgcgtgctgccttattgtcagcgaattgagcatttacttcatctagacgcgccgaagttttattcgcttcagttgctagttcatctaagatcttttctaagttttcttgatcttgtctttctctttcctttggatcaactggctcagaaatttcttcttcgccgttttcaagtttatcgatcaattgacttgcctgatctttttctttatgactagcagttaccttgtctgcttcttttttgatttgcttttcgtctttttcagttgccatgctttctaataaatctaagccttcttcagtcgaaaggattccttttttcactaaatctaaaatacgttctctttctttcatggaaattgcctccttaagcaaaattgtttgcaagcttttccttacatccatattatgcactgattcagtaaaaatgtcataggacttaagttgtaacttttactccatcttgagttgttctttcttttttgtaaagagatatgctgtagtcacgcaggttaaaggaagaacaagtagtgcggacaatgtggtaagaatagccatcgtatattctagaacaaatgatttttcattgatcacttgctgaaaaggaatgtctaaatcaataaaccagaggatcaacgctaaagaacttcccatgaatgcaaaaagaagtgtcattactgttgacgccaatatttttttagcaatagcgaaactagaatggcgcaattggtaaaaagataattgcggatttgcctgatatacttcgaatgtcccactagaaattgctacactcgcatctaaaacagcaccactaagactaatcagaagcaacgatctcgtaagtaatctaaaatcaatcgctaaagtcttatctaagccagataattcttctagttctatcgttgtaaaaccttggattgctaaaaaatcagtgataggaagcaatagtaggaaacaaaataaaaagatcagtatactcacaaaagctgcacgcatttttagattataaccgttgataaaaaataagataaccacagcaatcaataaaaatcctatgaccgacaatgccagtatcggccacttctgatgataaccgaataacaacaagaaaaagatccctaaattgatgaataagcctaaaagaatatacataccttgcgtaccgccaataagtagcacgctgattgctaaaatcccaacaagtataataagtacattcatcgtttcagcctccttacagtcagaaaaaagaggaccgagatagggatcgataatactattcctaagctgccagcaatgacgcgtaaaaattccaatgataaatgctgttctatcgtttctttgaacgaccattgatttcctaaatataaaagaagcgatggaactgacccactgatatagacgaacaaaaggatattggtcatcgagccaatcacatctcgacccacttgccttcccgaaagccataactgtttcgctgttatttctggttgtcgcttagtcaattcttctaatgtcgcaatgactgtgataacggtatcgagtgttcctccagctgttccaatcagtacgctagaaagaaaaacagaacgatacggtcgtgtcagataattcagttcctcatagcgcagtccttggtctttccaaagattcattgtcaaaagacaaataaaaaatgctaaaaaaacactcgtaactgcagctgaaattttgattatactgcttctattccatccatctaaagccaatatgctaataatcatccctataacgacgaacaggatagatatatttaatagagaaatcccttctattttagtaaagatgagcaacaaaagtaaaagtaaaacgatattgatgatgagacttcctaaagcaaatagaccatgttttccgccaataagcaacatggcgccaatgaagatacttgtgaagaagaaaagccagccatcatttttttttgctactagctgccattcatctccatgcatttggactagatacatttgtctcgcttttatatttgctgtttctatttgatttttttgataaggaaccgataaataaatcgattctcctttttgattcgtgttcatcagtcttcctgtaatcaattgatgatcctcttttattcgtactttttcgatctcgatgacaggtacttcatataaagcagcttgatgctgaataacccatgaagtaagcacacaaataaaaaatatagtgatgatgctaatttttttttgcattctttatcctttctatgaaatgatgaaaagggtttgtgacatattttgtcacaaaccctttcccgaataaacagtgttcaaaagcttgcatctgcggtaataagtccagccaaatgaaaaatatgaggagctatttttgtttgactgttcttattacttgatgcagaacagctttttcacaaccgctgatttcacaacctcttttcctaaacaaacggcagaatcaccgctttagtttagaaaatctcattgtggttcgtatttaactcagtgattttccctgtagccaagtagacgatccattcacagatgtttgtcacatagtctccgatccgttctagataactggcaacattcaagtagtctgttccactgatgactgtctcaggattttcctgcatatttttgattgttgcattatagattcgattgaaatagtcattgactctttgatccatattggcgatcgtacgtgcgtctttttcgtctgttttgacataagcaactaggacgttgtccaccatttttttcacataatcggacatatcggagatctctttttcgatttccggtattctcgtctgcccttttacgcgaatcgtggatttagcaacagacaccgcatgatcggccatacgttctaaatccgagctagctttcatgaccgtaatgatcatacgcaaatcagttgtaactggctgttgcaatgcgatcatttcaaaacttttcttctccaagcgtgtttccatgttattgatatttatatcgttttcgataacttcttgggctaagattttatcgtgtttgatgtatgcacgaactgacttgtgcacggcgctgctcaccatcatccccatttcgtagaactgattatggagattcagcaattcttcttcaaattgtgtacgtagcattccgtttcctccttatccaaatcgacctgaaatataatcttctgtctcttgtttttctggattcatgaatatcttcttcgtatcattgtattcgatcaagtgaccatctaaaaagaatgccgtcttatctgaaatacgtgaagcttgagacatattatgggtcacgatgatcatcgtataccgctctcttaattctaacagcatactttcgattttcccagtagaaacaggatcaagcgcacttgttggttcatccaataagatgatttccggattaactgccaaaacacgtgcgatacatacacgctgctgctgcccaccggataaagataaagcacttttatgcaatttgtctttcacatcatcccaaacagacgctgccttcaggctttcttcaactacttgatcaaggacttttttatctttttccccttttaatttcaatccatagatgacattttcatagatagaaaaaggaaatgggtttggctgctggaataccatgccgatttcttttcttagttcaacaacatctgtttttggaccatagatgtctttgtctttatataaaacactcccggtgatcgttacattcggaatcaggtcattcatccggttcaaagaacgcagataagtggatttcccgcaaccagaaggaccgatcatcgcagtgatttccccttgattgaaacttagatcgatcccttttagtgcttctttctttccataatacagatgaagatctttagatgaaataatttcttttgtcatgttgaggcctccgtcttaaccaaaatgaccggacacataatcttcggttgcctgaatttttggtctggtaaatatcttgttagttttgtcatattccattacttttcctagatagaaaaaggcagtatagtcgctgatacgagccgcttgttgcatgttatgcgtcacgatgatgatcgtatagtcttctttcaagtttacaagtgtttcttcaaccgttcctgtcgaaatagggtccaaagcacttgccggctcgtctagcagcaagatatcaggtttcatcgcgatcgcacgagcaatacataaacgttgctgttgcccgccagataaagccaaggcacttttgtccaagctgtcttttacttggtcccacaaggcagcttgtttcaagcttgtttcaacgatttcatctaatttctttttgtttttttcgccgtgctgtttcaaagcaaatgtaatattgtcataaatcgacttgctgaacggattaggacgttgaaaaaccatgccaatccgtttgcgcatctcataaacatccacttgaggcgcattaatatctacgccttgatacatgattttcccagtgattttcgtattagcgatcccatcattcattcgattcaacgaacgaagatacgtagattttccgcagccggaaggaccaatcagtgcagtgatcttatttttttcaaattccagatccactcctttgattgcttcattgtcgccataccagacatgtagatcatccgtatatagtgctacttctttctcttttggcatggtgatgacatttgtttcattccagttatattttttcattttgcttcttctccttaggctgaagtcatttttcggtataatcgtttgccaatcgcacgagcgccgaagttgaacagtaaaacagcaatgatcaacacggcagaagcgccagccgaaacagaaacaccatcaggcatcgtgccttctgtattgatcttccaaatatggacagctaatgtttcagcttgacggaaaatgctgatcgggcttgaaacacttaatggattccagttcgtaaaatctaacgcaggtgcactttgtccagccgtatagatcaatgcagctgcttcaccaaaaattcttccagaacttaggatcacaccagtcaaaatccctggtgtcgcttctggaaccaccacttttatcactgtttcccagcgtgacaaacctaaagccaatcctgcttctcgttgtgtgtaatggaccgcttgtaaagactcctcaactgttctagtcaaaagaggcaagttgaatacagtcaaagccaatgcaccagaaataatcgagaaaccatactggaattgaataacgaaaaccaagaaaccgaataaaccgacaacgacagaaggcaatgagctcaagatttcaatcgacgtgcgaatcacatctgtcagccagttttttccagcatattctgaaagatagatacccgcacctaaagaaataggaaaactgatgatcatcgtgatcaaaagcaaataaatcgagttaaatagctggatcccgattccaccgccttcttggtaggctttggaaggttcggtcaagaaggaccatgaaatgtgcggtattccccgaactaagatataaagtagtaaagctgctaaaatcaatacgatgatccccgaaactacatataaaacacctgtagcaattttatctgagcgttttgcgttcattatttcagctctcctttcttcccaatcatacggatcacgatattaaagaataatgacatcaatagcaagatcagcgctaatgaccataacacattattttcaactgttcccatgattgtatttccgattcccattgttaagatggacgtcaatgtagaagcaggagtagtaagtcctgttggcatcaatgctgcattaccgatgaccatttggatagctaaggcttcaccaaacgcacgagccataccaaaaacgactgctgttaaaatcccgggcacggctgctcgtagcacgactttgtagattgtttgccatcttgtggcaccaagcgctaatgaagcttcccgatagtgccgtggtactgcctttaatgcatcaacagtcatcgttgtgacagtcggcaagatcataacgaacaacacaaatgtaccagctaagataccaaaccctgtcccgccaaaaatacttctgacaaaaggcacgataactgataaaccgataaaaccataaacgacagaaggaatacctacaagcagctcgatgaccggctgtaagatcttcgttccgtttttaggagagatctccgtcatgaatactgctgcaccaatggcaaatggtgtggcaacaatagcagataaaaaggtcacaataaacgaacctgtgatcataggcaatgcccctaccattggtttcccatttgctccgatttggcttggattccaatctgtaccaaacagaaaatcaaatacattgatcttatcagtaaaaaaggtggccaatcctttactagctacaaaataaaaaatagataatacaaccaacacgatcagcgcgatacataaaaaactgatgaattttccacgctgttccatttttgaacgttttgattttgttaataatacttttttcacatcttccacagatgactcccccttaatcaggtttaacatactcactcagtgtacaaattgaacatcaatttggttttaataacatgtaaaagtttagctaagtttgtaaattttgtgtaaagattactctttaacgatatttccttgccaatcacgttcgactttcatatgagaaacagggatataacctagttctccaacgatgttatcttgtacttcatcagataagatatagtctaaaaattcttttgtcagtttttttggatgatctcttgtgtacatatgctcatatgcccaaatcgtccatttgttcgttgtcacattttcatctgtcggttctacaccgttaacattcaacgtatctacatcatcggaaacataagaaaaagcaacatagctgattgcaccgggtgtgtcggcaacgatctggcgcaccattccgcttgaatcttgttcttgtgcctgaacagctgtttctccgtccaatacccatttttcaaacgtgctacgggttccgcttcctgaagcacggttcaatataactactggctgatcttttccaccgacttcactccagtttttgatctcgcctgtaaatagttttttcaggttttccatactgatgtcttttacgccaatatccttgttcacaataggagtgatcccaacaactgctactcgatgatcgactaatgctgaggcatcgatccccgatttttcttccgcaaacaaatcagagtttccgatgtcgactgctcctgactgtacttgagacaaaccagttccgcttccgcccccttgtacattgatgaattttccaggattttctgtctggtaagtttcagcaactgtttctactaaaggctgtaaagcagaagagccaacagccgtaatggattctcctcgatcaatccactttgaacagcctgataaaagaatagctaatcctattattggtaagaataatttaagttttttcattagaaatctcctttaatcctaaagtatgtttattttatcattttcattacttgatgaaaacgaatcaaaatcattaaataacaaaataaatcctcataattgtaaaaaaaactatctcattaaaagtttctatgctatactggctttgaaatgtgtctcttttaatagcatatattagcttatttcttgctttccccaaaaaacaagagataccccaaagttaatttcgctcatgcgagacgctttctccatttctgacgtactctcagaaatggccccgttagaaaaggacacgagatctccatctgttgatggttctcatgtcctttttgtgttttaaaggagcggcgaaatcaatcttgctaatccttctttcatcttgatgattattcctcggttttcatacatttcttttgtgagatgcgtagaaattttcgagtcttcaaaaaatgcttttcttacacgtgaagccattcgttcatcataaatcagtgtattgacctcaaagtccaagcgaaatgaacgaacatcgatatttgctgagccaactgaaacaatgccaccatcgataatcatcgtctttgcatgaataaatccattctcatatgtttcgatccttgctccatactcgatcagctctgcagcgaaagaatacgttgcccagtaaacgagaagatgatctggtttgttaggtatttggatatgaacttttacgcctgaaagaagagccaacttcagtgcttcatgaatcgatccatccggtatgtaataaggcgtttggatcaatatctcccgtttggctaacgaaatcattttcaaataagtcattttgatttgttcatgttcggtatctggtccgcttgtcacgatttgaacagctatatcaccagtagagtgaatggacggaaaaaatttgggagaatagcctacttcttttgtatgctgagaattccagtccatcaaaaaacggttttgcaagatatacaccgcttctccgtaaatacgcaaatgattgtctcgccaataaccaaatttctttaccaatcctagatattcatttccaacattgaacccacctgtatatccgattttcccatcaataactacgattttacgatgattgcgataattgatccgaggattaatatacggaacaaatagaggaaagaaaaatgcgatttctccgcctgcttttttcaaattctgaaaaaagctggaagaaacttgtgtggaaccccatgcatcaagaaggactctgacttttacccctcgtcttgccgcctctgtcaatgcatctcgaacttcttcacctaatgcatcactgcgataaatataatactggaagtggatatggtcttctgcttgcttgatatcttcaatcagcgcatcgaatttttcacgaccatctgtaaataaagtgatttcatttttagtcgtatagagcgtactttcaaataccgtgagcatatagatcaattgtttcacatctacttgtccagtaggcggatgaggataaagccctcgcatcaatgcctgtttgtcttcttcaatttccaggttcttaccgattttcccttggatcttcaaatcaaagattttctctttggaaatccctcttcctaaaaaaatatataaaataaatcctacaactggaatgaacatcaaaacgagcagccatgcccatgtttgagcagtttcctttctttctcgaaaaacgatgataaaggaaagcaaaatattcataatcaaaaggatcgtaaaaaaattgtcaacgataattttcacggcttcacctcttcctctaccaacttaagaatacccaagttgttttttaaagtaaagggaaaaaagccgcttccttctattctcctagccaataaaaaaagaaagctggaacgaaactgtccaactttctcattttatttatattgtggtattagaatttcaagaaacgtctcatagaaatgatcgagccaagtgaaccaatgatcacaccaatgccgaccattaaaagattgattttccaaacgatattttgtggatgaatcaatgaataatgggaacgtaataatgatggattgatcaattggaaaaaccatgcataaccaaatgtgatgatcaaaatcggaagaatcgcaccgatcagaccgatccagccaccttcaaggaaaaacggccagcgaatatatccattttttgcaccgactaaacgcatgatttgaatttcacgctgtctagacaaaatcgtgatccgaatcgtgttcgaaatgagaaacatcgctacgaacagcagcaatgccgctgcaactaatccccatgtccgaactgcaccagcgatttggaaaatccgatctgaggaagctccaccgtaatcagaacgagaaacattcttcaaatctgctgcttcttctgctacttgttttgtataagaaggatcagtagcacttactacatacacatcatataacgggttattgtcaccttcaaacaatttccaggaatcacccatttcgttttggatttttttcaattcctgttctttacttgaaaattcaacttttttaacatgatctaagtcattcaattctttttctagctttttcatctcttcgtcttttgtaccgatatctacgaatacagatacatcaacgtttccttctatatcctgagctaatttagttgcattcatgataactgccatgaatacaccgactaaagtcaacgtgatcgttaccgcactgactgaagcaactgtcatccagccgttacgtttcaaactcttgatactttctaataaatggcggaaaaaggttctaatcatcgtatccatattccccttccgcttgatctcgaataatgcggccgttttcgatagcaattactcggtgccgaatcgtatttacgatcgtactgttatgtgtagccatcacgacagtagttccttgggcattgatccgatctaataatttcatgatttcccatgagttttctggatccagatttcctgtcggttcatccgcgataagtactttaggcgtattcacgattgcccgagcaatagagacacgttgctgttccccaccggataattcgctaggaaagactcgaactttgtgtttcaaaccaacaaggtccagcacttccattactcgttttttgatatctcgaggttttctgccgataacttgcatagcgtacgcaacattttcatatactgtttttcttggtaataatttatagtcttggaacaccacgccgatttctctgcgtagataaggaacttcgcggtttttgattgctattagatcatgacctgcgacgttcaaagttccttttgaagctttttcttctcgatacatcaatttgatgaatgtagatttaccggctccagacggaccaaccacatagacaaactctccttgttcgatgacaatcgagagattgcggatagcggtcgtaccatttgagtacttcttcattacatccttcatttcaatcatggcgttctctccatatctttttcagtctttagctattatagcatggcaatgtttcaacatgcttgcaaaatcttacaattttatttcaatttaacaatgggttcttattgtagatgcatttttaaatagccgtcaataaataaatcaaggtcaccgtccataactgcttggacatttcctgtctctacgtttgtccgatggtcttttaccatagaatagggatggaaaacataagaacggatctgtgaaccccagccgatttctttttgttctcctcgaagtgcagctgcttcttgttctttcttttccacttctaattgataaagcttagcttttaacatccccatcgcttgctcacggtttttcaattgtgagcgttgtgcctgactagctactactgttcctgtaggcaagtgagtgatccgtacagcagattctgttttattgatgtgctgaccacctgcaccacttgctcggtacgtatcgattttcaaatcatctggattgatttctatatcgatcgtttcatcaagctctggcatcacatctaccgaacaaaaagaagtatgacgtcgtttcgctgagtcaaaaggcgaaatccgtacaaggcgatgaacacctttttctgattttagataaccaaaagcgttatgtcctttaatcagcagggtcacactcttgatccctgcttcatcacctgcttgataatctagtgtttctacttgatagccatgctgctctgcccaacgtgtatacatacgtaaaagcatgctgccccagtcttgggactccgttccgccagcccctggatgcaattcgacgatcgcattgtttcgatcataaggtccgtctaacagcatagataattcatacgtcttcattttttcatctaatgcattgatacgtgtttctgcttcttcttgcattgctgcatcaggttcttcttgcagcatctccaccatcaattcgatttcttctagttcttcggcaagagaatggaattggtcataggtttctttattagcgttattttcactgatcactttttgtgcggcttcgctgtcatcccaaaaaccaggttcagccatttttgcttctgcttccgcgatgtcttcttccagctgatctaagtcaaagagacctcctgaaacttgtgaccttttcctgcatttctgtcaggagatttcgaatttcggatatttccatgttttttccttctttcactatacttttttcattatatctagtctaacagaatcagcaaataacagaaagaaggtgagacgaattcttaaaaaaagaatttgtctcaccaatcctgctgtcagaaattagtttgcattttttccatgacagttcttatattttttcccgcttccacaaggacaaggatcatttcttccgaccttgttcacatggattggctgttttttcgcgctagtattactattttctttggcatctccgtcttctgagtgagaagctgttccttgagaaacctgttcacgctgtacgttttgacggatctcagctttcataaagattcgagtgacttcatactcgatggcgcctaccatatcttcaaacatcttatagccttctgtttgatattcgactaatggattgttctgtccataagcacgtaagccgattgactgacgtaattgatccattgcgtcaatatggtctgtccatttagagtccacaacacgcaagatcacgactttttcaaattccaacagttgctctggaccatttagttgagccgctttggtattaaatacttcttgtgctcgttcgtttagatactctttgatctcctgagctgtttttccttcgatatctgcaagagtaatactatcttcatggacaagagtactgccggcaaaatcgatgatactttccaaattccaattttctttctctaattgtgtatgcgcatctactacacgactgattgtccgtttgaccatgttcattagtggcttggataagcttttttcttccatgattacttcttgtcgctgtttatagattacttcacgttgttcacgcatcacatcatcgtattgtaagacgtttttacgtgtgtcatagttatttccttctacacgtttttgtgcagattctacttgtttcgtcagcatcttgctttggataacagcatcttcctcaccgatcttcatccgatctaagaaagctttgattcgttctgaaccgaatcgtttcatcaaatcatcttccaatgacaagtagaactgtgacataccagggtctccttgacgtcctgcacgtcctcgaagctggttatcgatacgacgagattcatgtcgttctgtcccgataactgctagaccaccaagttctcttaccccaagtcctaacttgatatctgttccccgaccagccatgttggtagcaatcgtcacagcacctttttgaccagcattcatgatgatctctgcttctttaaagtgatttttcgcattcagcacttcatgaggaatacgttcttgattcagcatatctgataataactcagatgtttcaaccgcaacagttccgactaacacaggttgacctttgcggtagcgatctttgatatcttgcacgacagcgtggaacttgctttgtaatgttgggtaaagcaaatctggacgatcatcacggataaccggacgatttgtcggaatctggtatacttggatgttataaatttctctgaattcttcttcttctgttttagctgtaccagtcattcccgcaagtttcttgtacatacggaaatagttctggaaagtgatcgtcgccatggttttcgtttcgtcttcgatctctacgccttctttagcttcgattgcttggtgaagtccatctgaataacggcgtccatccatgatccgaccagtgaactggtcaacaatcagtacttttccgtcttggacaacataatcgatatctaaaagcatgatatagttggctctcaatgcttgatccaagtgatgggtcaatgcagtattttcaatgtcgtataagttatccaaaccgaatgtttcttctgctttttcgatccctgcttcggttaaactgattgtttttgattgtacatcgattttataatcttcttcttctttcaaacgtttcacgaagttgtctgctcttgtatataaagctgtggatttttctgcttgccctgaaatgatcagcggcgttctcgcttcatcaatcaagattgagtcaacttcatcgacaatggcataattcagcggacgttgtaccatttgatggcggtaaacgaccatattgtctctcaagtagtcaaatcctaattcattattcgtactataagtgatatcacaattataagcctcgcgtttttcatccgaagattttgagttgatattcaaccccactgttaatcctaagaaattataaagttcgcccatttccgtcgagtcacgggttgctaaatattcattgacggtaactacgtgtaccccttcgccagtcagagcatttagatatactggcatcgttgcggtcaaggttttaccttcaccagtacgcatttcagggatatttccatcgtgaagcacgattccacccatcaattgtacgtggtatggatataaacctaatacacgttttgctgcttctcggacgactgcaaaagcttccggaagtaattgatctaatgtttctcctttttggtatctgcccttgaattcagcagtttttgcctgtaattgttcatcagttaatgctgccatttggtcagcgtatgcttcaactttttttgcaatgctatctaaacgttttagttctttcttatcgttttcgataagtgaacgaatcaaattggccatgcgttgtgtaatctccttttccttctgtgtattatccagactatgtagactttacttttcattttatcattagttatagataattgaaatatcttaagcgtattaaagtaagaacttcataatttattcatatttcatctaaaagaggaggaaactcaaaaaaacttgcggcagctgtcagtagctgctgcaagttttcgttgttatttaagtaaggctgatcagtctgtttcaatcagtccgtattttccatctttacggcggtaaacgatacttgtaccatttgtttctgcatcttcaaaaataaagaagttatgtcccagcatgttcatttgcaagactgcttcttcactatccattggtttcaatgaaaggcgtttcgtacgtacgatatctaattcagaatcattttcgttttcgtcctcttcattgaataaagcagcagcatttgcagtattcatgcccgtttcacgggatttacgattaatttttgttttgaatttgcggatttggcgttccaatttgtcaacaaccaaatcgatacttgcgtataaatctggagaagtttcttcggcacgtaatacaagataaggtaatgggatcgttacttccacttttgctgttttttctgtataaacttttaagttcacatgcgccgttgcatcgggtgcgtcactgaaatagcgttctagtttgcctacttttttctcaacgtagtcgcgaatcgcttcagttacttcgatattttcgccgcgtacattatatctaaacataaaaattacccctttcgtctaccacaatcaagaaggagaaggaccactctttccctcttcttaattctattatatcgaactctaggttatttgcaaattaaatcgctatcaaatttccacatctaattcatctcgccaaagaaatagttcggatgattttcggctgtgcgatctgcaaacaatctgctgcgtggaaaagagtctgtcctgttgtatagacatcatcaataatcaatatttttttattttgtatcttagaaaaggtgactgcaagttcaaaaggttgaggcatctccaatccttcctttcgcgtgttttttgcttgagccagcagatgcttctctcttttgagtagcatctgaaaaggaattcttgctgctttcaacatctcgcttacttgattgaatcctctttctgttcgccttttttcagataaaggtattggacaatagatgtatgtcgggtattctttttttatctgcgtccatttatatgcaaaggtgcctgctagtcggatatctcccataaacttgtattgattgagccaggccttcatattttcatcgtacacaaaaaaggcacggtgctgaaaatcataggtcggatatttcttcttccattcttgacagtcactgcagtaaacggggatagaatttactttctttttcgtactctctagattgaaatggattggtttttgacagccagaacagcctcttgtttccaataaatgaaattgtgcgcgacaaactgaacaagtctgaggtaatctgtatttcgaaacaccaataatctcgctgaatgttaaattttggacgatatctttactgcagcaactgcacctcacagtatcttcttcccttcttcattcatttctttgatttcctgacaagcttttcgaatagctgcagttttttcttcatagaaaaaatatacttgactgttcgtataaggccctttacgatcggctcttcctgcgatttgtaccaaagaagatttagtaaaaaccggatgatccgctcctaaaacgataacggatattctttcaaatgtgactccacgttcaaggatcatcgtggttaacagtatgtcatattttgcttctcgcattttctggactttttccgcccgctgattgtctcttgaagaaacatctgtgatctcatatctcggaagagcctcttgaagtgtggctttcaaacgatgcatcatcgtgatacttggacaaaataaaaggatatggttttctttaattaattgatgaatgatccgcaccaaagattttatcttcttcttgttcttgcatttttgtcgccaattattcatgaaaaccaagacgggttcaggaagcaaacgccgatgaaagcgtaaagcaagtttgtggatgtcaaacgtctgcttgatctcctttagtaactttttatcaggtgtggcacttaagtagatgaatcgtccgtctggtttaatcgctgtttgcacagcatgagctaatcctgcatccccgttataaggaaacgcatcgatctcatcgatcactattaaatcaaaggaccgataaaaacggtatagctgatgaatcgtacagataacaaaagaagtaaaggtataagccgttgctgtattcccatggagcaacgtgattttttcttctggaaaaacataacgatagcgtaaaaacaattcattacaaacatcgactcgcggtgtacaaatcgctactcttcctccagcttttaaagtttccactaaaataggataaagcatctctgttttccctgcacctgttacagcccaaataagatgatgtcttttttctgaatggcaaagtattctctttgagatttccgtttgtttttcagtaagctgtcctgtccaaaaaaagacgacttctcgaggttttgcttcaggctgatcaaacaaatataaatcttgttgagtgtcgcatcgccctaaatatagacaatgtgtacaaaaataaccgtaatctgcaagctgtccatcaatgacggacgttctcattccacagcgatgacaaagaatccagttgctcaaacgttccactgctgcgatcttctcataatttggtaaatttacctcctcacagtctattgctttaatatctctcgtcagaagccttctaccccaaaaatgattcatattattcgccctaaaaaaatatacgaaaaaacaagcgatctattttttggatcgcttgttcgatagttatactgttctatttattcacctatgagcgtgattgcttgatctaacactttttcgccattcatcataccataatcagccatattgatgacatctaaaggaatgccttttggttccagacgtttctcaaaatcagctttcataaagcgaacttgtgggcctaataacaacacatccacgtctttatttgcaagattgttatctgcgtcagaagcggacacagcgaaaatatcagagtcgattccttttgcttcagcagctttttgcatttttgttactagtaaacttgtgctcataccagccgaacatacaagcatgattgtttttttagccatacttttctctcctttttaaaacaaactacgcaaacgttttcttcgcgtctgttactctattatataaaaagaaagaaatttgtcaacgttttctaaacgcggtttatttaatcaaatagccaactagatttcactaatttattgaacacgacatattctttgtccaaattgatgacaactacttcatagcctgcatttatccagccataggcacctttttcagggtgtttataatcatttgcccaccaatctgtactttcccttgctgttttgggaagtccgttactgggaaacagcagttcgtcaaattgggtaaaggtcaacgttacttgagagccgccattgttcttcaaataatgcgtaattgcatcgtactttttcattcgttcctgcatccccagatccacctgcctttgtctttattatcgcatactacagcaattgcgcaaccgttacagtgttgaaacaacctagaactttatttatactgaataaagaaaatgaaaaaagaggtgacaagatgatcgagcgctatcgtacaataaaagaaaatggacaaagtgagatcgagatcaaaaaatcacgctttatctgttctcttagacgaatagaatcagaggacgaagcaaaaagtttcattcaagaaataaaaaagaacattggaaagcgaaccataactgcagcgccttcatcattggagaaaaaaatgaaatccagcgaagcagcgatgatggagaaccaagtggaacggcgggcataccgatgttggaagtcctcaaaaaaaatcaactgatcaatgtagctgcagtagtcactcgatattttggaggaacgaaactcggcacaggcggattaatacgagcatacactcatgcggtctctcaagcattgtctgacattggaatcgtagaaggtaccttgcaacaggagatctctgtgatgatcacgtatccgcaactaggaaaattacagaattatcttgaactccaacatttttttataaaagaaatccaatatactgatcaagttagcgtcatctgtgctgtagatgaaaaaagtgctgaccactttaaagaatccatcattgagctgctgaacggacaagtccaatttgaagagggtcctgtttcttatcacgagcaactggtaactgatcatatataaaaacaggtgattctgattctcttttatttctaatacggaatcagggatcacctgttttttatttttccaaataaaactcaaaacgatttcctacgtattgcgtacgcacatactcaaacggcgtaccgtcttcaaaataagaaatctggcgcaaacgaagaactgcatctcctcgttttacctctaaatagtcagcaattttctcagaagccaacacagcagtaatcgtttgattcgctggaccgatctttttcccgcctttttcttctagcgtgcgatacaacgattcagtaatctctgctttgctgtagccatcgatcagcttttgtggcacactggcaacttcaaaacaaatagggacatcatctgcgaaacgaatacgttccattcgcaagatcgtgtcatctttactcaagtttagtttttccatttcacttgagcttggcgaagtcaagaaataagagattgtccgactagacggtactcgattttgtgattccataatttctgtaaaacttgttgcaccagacattttttcttgtactttttctcgtgcaacatatgtacccgaaccgatctttctttctaagattccttcatctgccaagttttgaattgcttgtctcaacgtcatacggctgacattgaatttcactgctaattctctttctgaaggaagacggtctccgactttccatataccttgttcgatttcattttttaattggtcatgaatctgtatatatacaggtaattgattcgacataacgtacacccgtcctttcgtttcttctattataactggtatatacctgattcacaactgaaaaagataaaggtttctatccatcaacagaggatttagacacacatcgttcttcctactcctattgtcagaaacaattttttagatatgtccaacctagaaaataacaaaagaccctaaaatcgatgaaaatgccgacttatggatcttttgttattattagcggtttttagccatccatttttttgtatgattcgttgggcgttttgattttacccggaccgcttttccgccttttttcggaatattcacttcaatattgtatttttctgatttgaccaaatcatataacttttcagctgcttcgtctactttttctttccatttcatgtggatccctccaattcttgtagttaacttaactctatcttaaatcagcagaatcttcaaggaacaaggtagcaaagcaaaaaaaagagctctcgaactaacgagagcttacgattgtggtatactggggtagctggattcgaaccaacgcatgagggagtcaaagtcccttgccttaccgcttggctataccccaatgaaatggaggagagtggattcgaaccactgaaccctaaggaacggatttacagtccgtcgcgtttagccacttcgctactcctccgaaaggtttgtatcaacctgacttagttataatacctaattttccagatttttgcaaccctttattgaaagtttttttgatatttttttattcgtgcagattccagtgtcgaatcactgtttctatcgcattttcaagacttttttcttttccaaaatcttcttcaccaaagaaaatttcatattcttttggtccataggctaagatctcaccaatcatttttttccctataaataactgagtgacttcataattcttacctttgatatcttttttcacttcttctatacgcacttcaatatctttatttttttttgacatcattttcacctctcagatattttatcatactgcagcaaataaaacattccttaggtaaaaatctcctattcatttcattcacttcttttatgcaagctgcaccttctctaaagctcttaattctccccttgacgtacagcgagatagtttgctgctgcacctacaagattagcatcgtttctgtattcacataataaaatctgcggttcgaaatcatgcagatcgaattgttctgtcagcttcttcattcggcttttgatctcatcaatgagcccttcttttgcagaaaccccgccgcctaatacgatcacttctggatcaaacgaaaattgaatactgaataatccctttgtaagatacgtataaaaactctcaacttcttcttttgctattgcatctccagtttctgctaattcaaagacatcttttccggtataagcatttttatcgagacctttgcgttcacaataacgccaagccatctgtaccgctgtaccaagtttactgaatgtcttatcgccatttaagaacatcaacccaaattctccaccgtaaagatgtgcccctttattgatttgtcctttcgtgaacaacgccccgccaatcccagttcctgccacaacaaaagcaacatattgataatcgcgggcagcaccttcataaaattcagccattccggcacagttggcgtcattttcaatcgttactggaagttgaaacagagtttccaaatctcggaaaatattaaatccatgaatataaggaatcgcactgattccctcaatcacctgtttctcattattcactactccaggagagctgattccaattccttcgacttcaaaagaaacgagtatttttttataaacttgaaataattgcgctttcatttcttcccaagattcaggcgttgcaaattgtcccttacctttaatctctttgccatcccaacaaccatatttgacagccgatccaccaaaatcaaaaactaatattcccataaaaatattctcctttttgtttgctaaagctattgtaatgtatctatttagcatttgaaagcattttcttgaattgaaattttattagttaaagctatttttaggtaagtgaattgctaaaatcactttgatcccttaattgatctccattttcaaaaatgggctcagagtaatgatggataaaatagtctttgactcgaccaatctccacatagcccattttttgatagagatgtaacgccgcactgctagtactaccggttcgtatgatgatctgagtttgactggaagcgagttgtgaaagcttctgaaaagctgtctcaagtaattttccgccaatcccctttccttgatacgttggggttactgctacattgacgatttcgtattctttttcccttgccacatagatcagtacacctattgttttttctttttctttccatatccagccactccctctggaaacatatacttgaactttttctttatcaggatctgcatctaataacaaggaccatggtaaatctttcttgtttagttcttcgatcattttttgtcccccatataagtagttgcggagttgttactttgacaataaatttcctctttttctttatcgctcagtgctagccgtatttttcacaaccttttttttgacggtgttcaaaatccaacacttcggcaataactcacaattttgcaaaatataagaagctattttccaaattgtttctttatcgctcagtgctactcgtatttttcacaaccttttttttgacggtgttcaaaatccaacacttcggcaataactcacaattttgcaaaatataagaagctattttccaaattgtttctttatcgctcagtgctacccgtatttttcacaacctttttataatctggttcttttttatctttcttatttcgcgttaatcggaatgtcaatggtacataatcgataccgcctttgacaaaaggatgacagcgtaagatccgtgcagtccccattaccgtcccttttagcgcgccatgggtttgaattgcttttatcatataattggaacaggttgggtaataacggcagctaggtggaaatgcaggcgaaataaagcgctgatatcctctaactaaataaatcaatatcttcttcatcaattagattccttcttttcttttactaaaaaaagggatcgcgactaacgtcaacgttcccttctgttttcttttatcatgttctgcttcatggctcacttcatatcgactagaaccactgtgattcttatttatcaatgaaaaaagtctcgaatatgaatccacaaacttggctgaaatactttaaatggattgccgccaccgatgacaccatatccgatcatcgttccggccacaaaaagaaggataagcaataagatcaccattaaaatctttatcaaagttaataagatatatcgttggttactcattcagccacttccttaagcaatcgtttgtgctgttttttcagcagaagtttgatccatgtctacacgttcaacgtctgcacctaattgctgtagtttgatatggaaattataatatccacggtctagataattcaagttacgcacacgtgtgattccatttgctttcaagccagctaaaactaatgctgctgctgcccgcaagtctgttgcatatacttctgcaccttgcaattcatggtttccatccatgattgctacatttccgtcgattttgacatgagcgttcatacggcgcatctcttctaaatgttggaaacgattttcaaacactgtttcagtcactacacttgtaccttctgcaactaattggatagctgtcatttgagcttgcatatctgtagggaaaccaggatgaggcatcgtttttacatctgtaggtaagatatgttttggtccgatgacacggactccgccttcttcttcaatgatttctgcacccatttcgatcaatttagaaatcaatgggcggttatgttcagagatagcatctgcaatcagcacattgccttgtgtcattgcagcagcaaccataaaggtacctgcttcgatacgatcttgtacgattgagtggttgactgcatgtaaatgatccacgccttcaatacgcattgtttcagtaccagctccatagacttgagcgcccattttattcaaaatgtttgctaaatcaacgatttctggttcgcgagctacgttttcaatgatggttgttccttttgcttttacggcagccatcatgatattttgagtagcacctacactagggaaatctaaataaatcgtgttaccgatcaattcatccgcaattgcttcgatatagccgtttttttgaataatttttgctcctaaagcttgaaatccttttaaatgcaaatcgattggtcgtttaccaatcgcacatccaccaggcatagctacttttgcatgtccatttctggcaagtagcggacccatcacaacgattgaagcacgcatttgactaacatactcataaggcgcttcgatttctaattgtcttgaagcgtcgattgttacttgattcttttgttcatcaaaatctacatctacgtttaagtgacgaatcacttgattcatagtgaagacatcagaaagaatcggaacgttgtctaatgtcgtaataccttcttctgctaacaaactagcagctaaaataggcaaaacagcatttttagctccttcaattcttactgttccatttaattgattgccacctcttacgatgatctcttccatgttgttccctccaaaaaattccaatgagcatacacttactcaaaatcttttctattataacatccttgcttttaaaatagtacctttttttaaaatttacaggctaacgaaaagatttcggcataaagcgataacttctaagaaaaaattacttgcagtgtaccctaaaaaaattgaaaaaagtacgattgccattctaatttgcgtattatgcattggtctgaaaaaagtttcaatgcgtaacgaacgtaaagaccagaaggctaagtagataaacgccaaatgactcacgattcgaagcaccgcatcaattccgtatacttgcataatgacgtcctttctaacgattgttttataataactaataaaatgataataccataaaatgtataaaaggaaaaacaagtatacttaaaaatataggaatccccttacattttttaggaaataaatgctaaaaatatgcaaaaaaagggactgaaacaaaagtcttgtcgcagtcccttattccaaataaacggtgttcaatcatctgaccctcggtattagctcaaaaaacggcaaaatatgaggaactattttccatttgtttctctaatactcaggacaaaacgctgattttacaacctctgatatacggtgttccagaagtagcttcttcgaaaaataagctgagatttcacaaaaatttgagaagcaattttcgtaaattccttcttatgtcttgaagctgaccacttctgtcataacctctttttactgttcttaaacacggataaacatccgcatctcattttatgagtgcttagatactttgatacgattgattgctcggtgcaacgcaacagttgcccgtttcaattcgttcgtatcttgttttgcttttgcttcttcgatttggcgttctgcgcgttgttttgcacgttccgcacgagatacatcgatatcacgttcacgttccgcactatcagcaacgattgaaacaacattatcacgaacttccatgattccgccattaacagcgatccaatcgacgtgggtatctgaatctgttcgttttacacgaacttcatcaatcgtcaatggaacgatgattggtgcatgtttaggcaaaatcccaagctcaccagctgtcgtacgtgcaacgacgatagctgcatggtgatcatagaccaaaccggcaggagttaccacatttactgttaaatattgatccatggggcacccctttctagtagcctagtgttttcgctttttctacgacgtcttcgattcggccaacacttcggaaagcttcttcaggaagatcatcgtatttgccttccaagatttcgcggaatcctttcactgtttcttctacagggacatatgaacctggaagaccagtaaattgttcagccacgttaaagttttgtgacaagaagaattggactctgcgggcacgagaaactaacactttttcttgatcggataattcatccatacctaagatagcaatgatatcttgtaattcacgatatcgttgcaatacgtgttggacttctgttgctactttataatgttcttctcccacgatttcaggtgctaaagcacttgaagaagaagccaatggatctaccgctggataaatcccttgttctgttaatttacgttccaagttggttgtcgcatccaaatgggcgaatgctgttgccggcgccgggtcagtgtagtcatcggctggcacatagattgcttggatcgatgtgatcgaaccttttttcgtagatgtgatacgttcttgcaattgacccatttctgttgccaatgttggttgataaccaaccgcagaaggcatccgtcctaacaaggctgatacttcagatccagcttgagtgaaacggaaaatgttgtcgataaacaacagtacatcttgaccttctacatcacggaaatattccgcaatcgtcaaaccagtcaaagcaacacgcatacgtgcacctggtggttcgttcatttgtccgaacaccatggctgttttttcgataactcctgaatctttcatttcataatacaagtcattaccttcacgagtacgttcacctacaccagtaaatacagaaataccaccatgttcttgggcgatattatggatcagttcttggatcagtacggttttaccaacaccggcaccaccgaatagtccgactttcccaccttttaaatatggggcaagcaaatcgataactttgatccctgtttccaaaatttctgtacttgtacttaattcgtcaaaggctggtgcttttttatgaatttcgcttctttccgcatcttctgggaaaggtgtttctaaatcgatcgtatctcctagtacgttgaatacgcgacctaatgtttctttacctacaggaacagagattgctttgcctgtatcaatgacttccattcctctttgtaaaccatctgttgattccatcgcaatggtccggatcactccgtcccctaattctaacgctgcttcaagaacaacttttgatttattttcgtcatttttataaacaactaatgcgttgttgatatctggtaaggattggtctaaagaaaattccacgtcgacaacgggaccgattacttgaacaatcttgcctgaactcatcttttttcctccaatctcaatactattctagtgccgaagctccggcaacaatttcggtaatttcttgggtaatagccccttgtcttgcacggttataagaaaccgtcagctcatcaatgatattagcagcattatcagttgctgttttcattgctgtcataccagcagcatgttctgctgttttggcgtcaacgatcgcaccgtagatcaaactttcagcatactgaggcaataactgagacaagatttcttcttttgaaggttcaaaaatatattcttgttcgaaagtagttgcttcttctggatctaagtctgagattggcagcattttttctacacgaaactgactagttagcgaattgatatgatggttataacatacgtataattcatcgaatacttcgttttggtacatagttgttgccatatttacgattttgcggacttcatcaaagcttggctgatcagatagattgcgcagctcatatgctagattgataccgcgtgctttaaagaagtctgcaccagttccgccaattgcgatcatcacgtaatcatcgggtgattggtggtcttcttctaaaatagacatcgtttgtttcaatatcgagctgttatatccaccgactaaaccgccatctgcagtgatgacgatataaccagttttcttaacaggacggctgagcagcatgctgttgtaattgatatcccctctaggattttctgaggcaatatcatttaactgagtagcagtcaaatgcgtaacgatttctcttacttttgttgcataaacctgaaacttctgtgaagaaacttcagattttgtcaacttagaagcagacaccatctgcattgcccgcgtgatttggctcgtttttttcgttgaagcgatacgtgtcttgatttcatttaatgaagcacccattcatctcacctcactatgcattttgaatggatttcaatttatcttctgtagaggaattatttccttttgtagctaagaacatgtctttatattcctgaatcgcactgttcaacgcttcttcttctggaagatcttttgttgtacggattgtttcaaagatatctgaatgattggtatccagatattcgaataattcatgttcgaagtctaaaatactgtctacagggatactatctaagaatccatgtgtcaaagcatacaaaatcactacttgtttttcaacagctagcggtgcatgcaatttttgtttcaagatttctactgtacggcgtccacgatttagttttgcttgtgttgctgcatccaagtcagaaccgaattgtgtaaatgcttctaattcacggtaacttgctaagtctagacgtaaagtcccagcaacttttttcattgctttgatttgcgcagaaccccctacacgagatacagatagtccggcatcaaccgctggacgagtacctgcgtagaacaagtcgctttctaagaagatttgtccatcagtgatcgaaataacgtttgttgggatataagcagagatatctccagcttgtgtttcaacaaatggtaaggcagtcattgaaccgccacctaaatcatcacttaattttgctgcacgttccaataagcgtgagtgtaagtagaaaacatcccctggataagcttcacgacctggtggacggcgaagtagcaaggaaagttcacgataagcaacagcttgttttgaaagatcatcaaaaatgatcaagacatgtttaccgttgtacatgaactcttcacccattgcagtaccagcatatggtgcgatataaagcaacggcgctggttgagacgcaccggcattcacaacgattgtgtaatccattgcgccatattttttcaatgtttcaacttgtgtacgaactgtagaatctttttgtccgattgctacatagatacagatcatatcttgacctttttggttgatgatcgtatcgatcgcaatagaagttttccctgttttacggtcaccgataactaattcacgttggccacgtccgattggtacaagagcgtcgattgcttttagacctgtttgcattggttcgttaacagatttacgttgcataacgcctggtgccattgcttctactggacgagctttgtcagtaacgatttcacctagtccgtcgattggctgacctagcggattaactacccgtccgatcaaggcctctccaactggaacttccatgatctttcctgttcgttttactttatctccttcacgaatggactcgaaatcgccaaggataatgatacctacatcatttgattctaagttttgcgccattccgtatgagccatttgaaaattcaagcaactcaccactcatcgcgttttctaaaccatgtgcacgagcgatcccgtcacctacataagttacggtaccgatttcttcgactgaaagcacgttttgataattttcaatttgttctttaatcaaggcactaatttcttctgctttgatggccattcgattcacctacctctttgtactatctatttaattgattacgcatattttctaattgcgtgcgaatgcttccgtcgattactcgatggttagcttcaacaatcgcgccaccaataatagaagaatcaacgatttgttttaattcgactgattgatagttcattgtttttgcaacattcttttctaattgtattcgttgttcgtctgaaagtggaactgctgttgtgacacttcccaacagcaaaccttgatgttcatcatatcgacgttcatattcttcgatcatgaacaaaagatcatccattcggttatacgcataaacaacttctaaaaagtttttaacgattccatcatagccactaacaagcttgtccatgatttctcgtttttcatgaggttctagacgaacatcacttaacatattacctaatccaggtacttgttcatagatttgacgtaagcttacgagatcttgatagatttcttctgcttgatttgaatcgatcgccagttcaaataaagctttcccgtaacgtcttcctactgtatatttatctagtttcatttgaagaacctagaccttcgatatattgattgattaatgattcgtgcatttctggagataattctttgttcaagattttttccgcgatttgaagagatagttctgcaacatcgtcttttacagagttcagcgctgaatcacgttctacagtgatatcagcttgggctttactttttagacgagctgcttcttcttgagcatccttcaaaatattttggcggcttaattctccactttctttcgcatttttgatgatatcagctgcatcagaacgagaggctaacaattgttgttcgcgttcttgttccattttcgctgagttgatgcgagattgttctgcagaatccaaatcattggcgatcttgtcttcacgttttttcaaaatatcgctgattggtccccaagcaaaatgcttcaagagagccagtagtatcaaaaatgagccgctgacaacgatgacatttcctaacatcgcattgccaacttctgcaattgccaattgattcagcataggcgagccttcctttctttgaagtacttctagttttcatgtaaaaaagcagtaacaaaccaaattgtttctgccttaatactgattcaattaaacaccaaaaactagaatcaaggcgacaactacccctaagataggaacagcttcgactagagctaccccgataaacattgttgtacggaattgaccagacatttcaggttggcgagccattgattcgattgttttagagataacttgaccgttaccataaccggctccgattgctgctcccatgattgcgattgctgctgcgatataattcataattgttttcctcctaaattagataaatagtagtttgtttttaaaacgaatattattcttccacttcaatcttatggctcatataaaccatagataaagtaacgaagacaaatgcttggatgcttccgataaacaaggagaatgcgatccagaccatctctaatggaattgctaacggcaatgagaaccagcctaagcttattaccatttttgcaatcaaggttagcaaaacttcccccgcataaatattcccataaagacgtaaagcaagtgttaataagtttgtaaattcttcaatcagtttcatcggaaacataaaactatatggtttcaagaacgaatttacgaaatatcctttgaagcctaactttttcaccccaaataagtgagtaagtaagatcattataaatgccaaagttaaagtaacaaacgggtctgctgtcgggcttttccaaagtgttgtttcgttaggtaaaacgatttttgttactaaaccgatgttgtttgcaacaaaaacaaataaaaacaatgtaaatgccaacaaatggaaattgctcaattcttttctaggcagattatctgttacgattcctcgactaaaatcaatgacccattctatcgcattttgtttgcctgttggtttcaacttaagatttcttgtaaaaaagtaagctaagaagaaaacaatcaaacaggtcagtaacaccattatacaaactgtaccatcaaaccaaattggtccaatgtggaacgttagcgagcgttcatccaatccatttcacctcttttccccgaaattcacataaaatcaattcatgtgcgtatctggttttttccaatcggtttctaaccacacggtatcataccaccatgaaacagaaaattcaaaacattttcatgaaaattagacacttttttatttcagtcaaaaacgaagcgaatttttctttatacacggtgctcctgatctaagaaaaaacctatgataatcatgttttatcagattaaatgctaacaaattttatcattaagtaaaagcaaaagcaccgaatatgcgaaaaaggataatgaaattatctagagaaattttttaatgttcgatcaatttgtcgatcgatatcttttcgtttcaaatcttcccgtttatcataagattttttccctttcgccagaccaatcaataccttggcatagccgttacgaatatagacttttaaaggaacaacagtgattccagtatttttcaattcattttcaagccggatgatttgttttttgtgtaataataactttctcgtgcgcaacggatcatgattaaaaatatttccttgttcataaggactgatatgaacattatgcaagaaagcttctccgttgcggacgcgaataaatccatcttttagattgatccggctgtttcgtatcgacttgatctcggttccttgcaagaccatccctgcttccatcgtgtcgatgatcgaataatcatggcgagctttcttgttttgtgcaattaattttccctcgccttttggcatagctgtttcctccaactcattttattttttctttttcttctttttaacacctttgtaaaatggcttcttcccttttttcttaccgaacgtttgcttactatcgctatatcgtttgttcttcttgccatttctttctgggcgttttcctgcttgttttccttcgcgttttcctgattttccatttcgtgtttttggccgttccaacgctgtaacctcttctgcggaaacaagttcaaaatctactgctcgttcatctggatcagctttgactacttttactcgcactttctgtccgattttaaaagtcagaccagttctttcacctacaagagctaaatgattttcaacaaaatggaagtagtcctgtttcaattcattgatatggatcaatccctctactgtattcggcagttcgataaacaggccgaatttcacaacagagctgatgatcccatcgaattcttctcccactttgtccatcatgaattctgctttcttcatggaatctacttcacgttctgtttctactgcacgacgttccatcttagaactatgatctgcaatttcaggaagttccgcagcccacgaactttgattgctttcacttttatcttcactgtaagaacggatcagacgatggacgattagatcgggatagcgtcgaataggagatgtaaagtgtgtgtagtaatctgccgctaagccataatgcccaaaattgtcttctgaatagcgtgcttgttgcatgcttcttagcaacatagtattgataactgcagcttctggtttgtcttctactccttcgatcacatgctgtaaatcttttggtgtgatcgttcctttcgttcctcggaccagaatgcccaaagctgaagcaaaatcaaagaagcgctgcattttttcttcttttggctgttcatgtattcggtaaataaacggcagatttaatttattataatgttcagctaccgtttcattggccgcaagcatgaaagattcgatcaagcgttcaccaattcctctgcttcttagctggatgtcatttgggtgtccttcagcatcaacaaggattttcgcttcgcgatcctcaaaagaaatcgcgccacgtttgattcgcatcgtttcaaggattcggtgcaattcacccatttcttggaacataggtacgagctgagcatagcgttgcatcgtttcttcgtcttgatcttctaagatttgattgacagctgtgtaggtcatccgttctgttgtttggatcacacttgggaaaatatcatgagagactacttgtccatttggatcaatctccatttcgcaactcatggtcagccttggaacatggggattcagtgaacagataccattcgataaacgttgcgggatcatcggaattactcgatcagtcaaatatacacttgtccctctttcatatgcttctctgtccaattgactgccttgtgtcacatagtaagaaacatctgcaatgtgtactccaagaaaataattaccgttatctaattttttaaccgtaactgcatcatctagatcttttgcatcttctccatcaatcgtaacaatgagctgatttcttaaatctctacgtccagttatatccttttcgctgatttgatctggaacttcatctgcttcagacaatacatcatcaggaaatttcgtagggataccattagccacgacaattgagaggatatccatgccagggtcattcttatgaccaatcacttgcttgattatcccttctaaactagtcgcataccctttttcagggtaatgggtcagttcgatcagcacaatacttccgtcaactggacgaactccctctgctgctgcatatactttaaattggttgagctttctatctttcgggataacaacgccgtaaagatctgtttcttgtatttcttcttctgaataagcaacgaattcccctgctaactgagtagtcgcccggtctcgaatctcgactactttcccctctgctccgcgatccatatctgtatttgctcgcttcatgatatcgattgctacggtgtctccatccattgcaaaaccagtcgcttcttttgggatatagatgtcatcttcttcgggatcaatcgttacaaatccaaatcctcgttcatttgctcgaaatgttccttcgatcaagattggttttaaaggaagtttcacttttccttttttattgaaaactatactctgttctctttccatttgagcaatcgtttgtactagtaatttaaaatcatcgcttttttggaaccctaaaccttcagcgatttcttccatagaaaaactgcgtttgcgactgctttccatgaaaaagagaattttctcttttatcgtttcttttgtcatatttattcctcattccaaggtaatttttctaaaaattccaagacgtctttttctaattcgcgtcttgctgtaccaactgtaatcacatgaccactttcaggataccattgaagtgtcactcgctgacggctcaacttgcgtgcagtttcaaatacgccattagggtcgatcatttcatctttcccagcttgagctaaaaatatcggctgttggatatctgacaacctactttctacgattgctgcctgatcttgtatatccattaattgttgttcagctaacgagcggtaagcaactgctttttcattgatttctttctctgatttacctgctgtcttcagcacttgacgtacgtatttttcaaagttttcaggcacgtttgtttttacaggagacaaaggcgaacagaaaaaaccgccgccaatcactgattcttcttctagtgctcgtacagcaaagatgccgcccattgataatcctaatacggcaatatcagaaaactgctcagactgtaaaaaatggatggcttttttagtgtctgcccaccagctttctgctttttcttgcaagatatcatatggctccattgttccgtgtcctttaaaaagcggcgcataaactgtataatctgctttttccaaaaatcgtgcgagcattcgaacatcgtttggacttcctgagtaagcgtgaagcagcaaaaccgctcgctttccatgttttgcataaaggggttttggtaattgtctcactcgtctcacctctttcgcctcattttaccatagtttctttcataacttcttcttaagcgttctctttgcaataaaaaaagccgcccgccgttttgcgagaggcttattcaactacttcgaagataaatatgctaggacaaataataagatcatccagatagctcccataactgcagttgatcgctgcatgacagcttcaaagccgcgagctttttgtttgccgaatagttgatccgcaccgccggtaaatgcactcgctgcactattttgcttgcttggctgcatcataatcgcaatgaccataacaatcgataaaacgatcacgattcccaaaattaaattatacatatcgcagcctccttcccaaaagatatcgtctctttaactttatcatagataaaagtccgtgacaactctatataaatggaataacagctgaaagttcaaaactttcagctgttattcttatgactgacgtaagacgtctgatattctggtttcttttcaaactctttttttgcataagggcataaaggaatgatctttttcccgtctcgtcttgctaattctactccagtatacactagcttttcagctaacttttgaccacgatatgctggatctacaaatgtatggtcaatgatcatgatgtctgggcccgcatctgaccatgtcatttctccgatctcttgttgttcatcattgaataaagcaagacgattttttcttctttgatttccatatgccgcactcctcaaataactgatatttttttattcctaccttattttagcagtctcctgatctataaacaattatttatcctcgaattacttacaaaaaagaagagaaaattaattcatcgttattctttgttcaataaatgaaaaaatcactgtccaataggttttcggatctttcatcgatgcttccaagtgttctgcttccggaacaagcagcagtgctttatcccctgccgtagcattttgaatcgtgtacgctgcttctgtagggacaaaatgatctctttcaccatggatgactaataaaggcagatgattgctgccaagctgtctcgtagctgatgcttgctttaaggagtaaccggcgtatttctgggcataatgattcgcatatctcatgaccatttttttaggaaagacagtgattttacttaacatatatcggaattctgcataaacagaaacatatccgctgtctaaaataaatcctttgaccgctgatggaagtttttcaccacttgccatcatgatcgtagaagctcccattgatccgccgtgtaaaataatggacgcattcggctgttcatctaagatgagttggatccaggcaattaaatctagccgatctagccatcccattccgatgatttctccttcactttctccgtgcgcacgtaaatcaggtacaagaacgttgaatcctttctctgcatatcttttacctatatgagacatgtctcttttccctgtgcttcggtaatcatgtacgcaaatgacccatttattctgcttatttggatggatgaacatctgaccagctagtttcaacccgtcataacttttgattgttttgggtgttccctgctcccaaaagctttcacactcttcttctaatttttgtcgttttttttctactgacgtgactgcagcagggtccatcaaacgatgaccagtgtcttcataccagtcatatcctctctgtactcccgctcttactaatttctttgcataaaaataagaaagaaaatggtaactgatccctataattatcagaataagaatgaaataaaaaataaccattgtacacccgccgctttctgccaaactataatctatctattatccaatgtaccgatccataggattctttattttcggcacacgtaaattccatttctttttcattgtatcatttacttaaagttctcctcaatagatttacttgtaagagagcatttacattcgcaataaaagccagtatactaatttcgtgcattataatcaagacgctcgtcttggactggttcggaaacttcccagaataaaaaactaagtatctctaaagaaaggagattggaaataatgcgaaaagtaattattgattgcgatccagggatcgacgacactttagctttatcattagctgtcaaatcccctgatatcgaagtagttgctattaccgtagtttgtgggaatgtccctgcagatataggtacgcagaatgtgctgaaatgcctggaacgctgtgatcgtttagacattcctgtttatcaaggaatggaaaaacctttgaagcaacctttcatcagtgcacaagacactcatggtatggatggtttaggggaaacaaatttcccgatgatcttgagaaaacaggcagaacctctccatgccgttgattttttggctgattatttcaaagaaaagacaaatacatcagtcattgctttgggtcctttgaccaatatcgcttctgctttgaaagtcaacccaaatattgggaaacatatggaacgttttgtctcgatgggtggaacttacaaaagccatggtaactgttcgccagttgctgaatacaattactggtgtgatcctgaagcagcttcttatgtattcgagaatctcaaacaaacgatagaaatggttgggttagatgtgacaagagaaatcgtcttgacaccgactatcctcgaatactgctgtcaaatgaatcctgaagagggagagtatctaaaagcgatcactcgtttttattttgacttccactggaaacaagaaagaattttaggatgtgtcatcaatgatccgttagctgttgcttattttatcgaggaggccatctgtgaaggtttcaaaagcttcactgctgtggaaactcaaggaataagtcgtggacaaacattggttgatcgttatgaattttggcagaaacctgctaacagtaaaattatgacaaaagtagatactcgtctttttttccgaaagtttttaaccgttcttttaaatgcacaagaagaaacgattatgaaagatttggaaaggttaaagatgggctaacaaaatgaataaaaacaaaatggcaactcgcgtacttacagtgatggctttgtgtattgggatcaattatattggaggaacgattgctttatggcttcgtttgccaatctatctcgattctatcggaacgatttttgctggtgcattgcttgggcctgtacctggaatgctgacaggattgtccagcggtattttaagtggagtgactacagatattttttctctgtattattcgccaatccaaattctcacaggcttgcttgctggattgattttgccaagatatctcggcaaagataaaaacagcttgaaactgttattactcgctttgattttgtcggtacctggaacgatcgtttcttcgatcattaccgttcagttatttggcgggatcacctcctcaggatccagtatgatcgttcagctattacatgggttaggtttaagtcagacaacaagtgtgatcttggtacaggcaggtacagactaccttgatcgtttgttgtctatcgtcgttgtttcattagtcatcactatgttgccacaacgcttgatatattcaaaaagaaaaataggctgaataaacagagctggattagcaaaataatgctaatctggctctgttttttcatttattaaaaaaatcttacgctaagtaggataaaataattccttgatatttttcgatcatatccaaataattatcgatttcaacatactcatctacttgatgaggcaaagtaacgacaccaggcccaaagacgacaaagtcgaaggaatggttagctttcgtaaattcggctgcatccgttgttgctgccgctccaactaaaggtaatggctggctgaattgttgctgaatgcaatgaatcaaaggagaatctggatcagctttgacaggtattttgttgtaatcgatcatcaattccaaatgatagtctgtctcttgattcaattcattgacgattgattgcagcaatgcaatgattttatcatttgggtattctggaatcgatcgaatgttcccttggagctgcgcatggcttgggatgctgttgacttgattcccgccactgatcaatgtaacattatggattgtttttcctaggacaggattctcgattgtttcagcgaggtgattcatttcagcatttgctttcgtaatgaattcatttaggtgattgattgcattataaccttggtctggcatagagctatgcgcttcttttccgtgcgaggtgactgtatagttgattgatcccatgtgcgtatacatcaaactgtaattggttggctctccgatgatcaaggcatctaagtcatctacatagcctgctttcgtgagctgttccccacctagttcacccacttcttctccgacagtggctaataatttgactgttccgttaaatggttttcctgactctttcagttcgatcatggcaatcaccattgctgccaagccactcttcatatctgtagcaccacgtccgtacataacggttcccatggatttctgctgcaaagggtgcataggtccaagacgattcatcaccagccgccacgacatccatatgcccagataggcctaacacttttcctgattggcccttttggtaacgagcaatcaaattatctctaccatctctgtaagaaacaatctctcctgttatgtcatgttttgccaaaagcttattcaaataggctgctacttcaccttcgtttccattcactgatttaattcggatgatctcttgtaaaatcgcgattttttcttcttttttcatctaatcctctcccttgccatttctttttattgtatttgagtgtgctcgaattttcaaataggagcaaccaaagtaaaaatgaagaaagagagccactttatgaaaaatatgctgctacttccctcctattttatttatacgagaggacttgctcatagattcctattctactgttctatccttaaaagctcttatatgatgctagttattgttagctttcctttttcaaggatgatcttttcttgtaccattctttgtaaacatcatatacagaagctagttgcaaaaaaactctctacctgctgatatttcagcaagtagagagttcgattacttaactaagtgatcatactcgactatctttcaatagtcgatcatgtatcttcattagaaaagaattatttgttttttaagttgtagaaagatttcaaacctttgtattctgcaacttcaccaagttggtcttcgatacgtagtaattggttgtatttagcaatacggtcagtacgtgatagagaaccagttttgatttggccagcgtttgttgcaacagcgatatcagagattgttgaatcttctgtttcaccagaacggtgagatacaactgctgtgtagccagcttctttagccatttcgatagcttcgaaagtttctgttaatgtaccgatttggttcactttgataaggattgagttagcaattcctttttcgataccttcagataatttttgagtgtttgttacgaacaagtcgtcaccaactaattgaactttgtcgcctaatacgtcagttaatttcttgaatccgtcccagtcgttttcgtctaatccatcttcgattgagatgattggatatttagaaactaattcttcgtagaatttgatcatttcgtcagttgttttttcgccttcgcctgagtcagctagtacgtaaacacctttttctttgtcgtagaattctgaagaagcagcatccatagcaagaacaacgtctttaccaggtacatagccagctttttcgattgcttcgatgattacttcaaaaccttcttcgtttgaaccaaggtttggagcaaatccaccttcgtcaccaacagaagttgctaatccgcgagctttcaagattgaagctaatgcgtggaatacttcagcacccatacgtagagcttctttgaatgttggagcgccaacaggcatgatcatgaattcttggaagtcgattgagttatcagcatgtgatccgccgttgatgatgttcatcattggtgttggcaatacttttgtgttgaatccgcctaggtagtggtataaaggtacttctaggtagtcagcagctgcacgtgcaacagcgatagaaacacctaaaatagcgttcgcacctaatttacctttgttaggagttccgtctaaagcgatcatagctttgtcgatagccatttggtcacgaacatcgtagccaatgattgcttcagcaatgatgttgtttacgttgtcgacagctttagttacacctttaccgccataacgagctttgtctccgtcacgtaattcaactgcttcgtattcaccagttgaagcacctgaaggaaccattccgcggccaaaagctccgctttctgtgtatacttctacttcgattgttgggttaccacgtgagtctaagatctcgcgagcgtaaacatcagtaataattgacatgttttgtctctcctttgagtttgttttttcctaagggatttccctcatatacgattttagttaattttgctcattagtgcaaacatttcttgcatttttcacaaattttcaacaattattttacagcgtctaacaatgacaagaatgaatctgcttgcaagcttgcgccaccgactaaagcaccgtcaacattttcttttgccatgtattcagcaatattttctggttttacagaaccgccgtattggatacgaactgcttctgatacttcttttccataaagtttttcaactgtttgacgtacaactccacaaatttcgtcagcgatttgtgcgtcagctgatttaccagtaccgattgcccagattggttcataagcaataaccatgtttgacacttgttcagctgaaagatcagctaaaccagctgtaatttgtccttcgatccattcagcagttttgcctgcttcataggtttctaaagattcgccgcagcataggattggtgtcataccatttgcaaagatagcttttgcttttttattgatgtcttcgtctgtttcatggaaatattcacgacgttctgaatgtccgatgatcacataatgaacacctagatcagcaagagctgctggtgaagtttcaccagtgaacgcacctgagttttcccagtagcagttttgtgctgagatttttagttctgtaccttcagctgatgtcattaattcttgtaagaataatgcaggagatccgatgactgaatcaactttgtcatttgaagggattttgttttttactgcttcagcaaattcttttgcttctgatgcagttttgttcattttccagttacctgcgataataggtttacgcattgaggaacacactccttaatttattgaaaaatggctagggagtcatgaaaactcccttcaccttttgatcgattactcgtcagaattgagcaaacttggtcgtttatttatcgttgattgctgctagtcctggtaattctttaccttcaagcaattccaagcttgcgccaccacctgttgagatgtgtgtgaatttgtcagcgaatcctaattgttctgctgctgcagctgagtctccgccaccgatgattgttgttgcgccttctaagttagcgattgcttcacaaacaccgattgtacctttagcaaagttactcatttcaaatacacccataggtccgttccaaacaactgtttttgcaccttgtaatgtatcagcaaataattttactgatgctgggccgatgtctaaagccatcaaaccatcaggaatgtctccttcgattacttgtgtttcaacatcatttgaaaattctggtgcacagacattgtcgattggcaagacaagtttgtcgcctgctttttcgattaattcttttgctagttctactttatcagcttctactagagagttaccgatcttgattccttttgcttcgtagaatgtgtaagtcattccgccaccgattaagattttatctgctttaggaatcaagttttcgattacgccgattttatcagaaacttttgcgccaccaaggattgcaatcattgggcgttttggttcttctactgcttcaccgatgaacttgatttctttttccatcaagaatccagcaactgttgggataccagttgaagcgatacctacgttagaagcatgtgcacggtgagctgtaccgaaagcatcgttaacaaatacatcgcctaatgaagcccagtatttacctagttctgtatcatttttgctttcttttttaccgtcaatatcttcaaaacgtgtattttcgaatacgacaacgtcgccgtcattcatgttgcggattgcttcttctaattgttctccgcgagtttcaggtacgaatgttacttctttacctaataattcgcctagacgttttgcaactggagctaaagattttccttctttatcttcttctgtttttacacgtccaaggtgagagaaaaggattgcttttccgccttgttctagaacgtagttgattgttggcaatgctgctttgatacgagtgtcgtcagtgatcacgccgtctttcaaaggaacgttgaagtcaacacggacaagaacttttttgtcttttaaatcgatatctttcactgttttcttagccattttatttcctcctgaataaacttattatcaaaaaaagcggaagaagcgcgattgcttccccgcttttaaatgtacatgtctataatttacacttgtacgtttgtctatcttataagttagcgaagtattctaaagtacgtactaattgtgcagtgtatgacatttcgttgtcgtaccaagcaacagttttaactaattgtttgtcgccaactgtcattactttagtttgtgtagcatcaaataatgaaccgtaagtcataccaacgatatctgaggaaacgatttcgtctgtgttgtatccgtaagattcgtttgaagcttctttcattgctgcattgatttcgtcaacagttacttctttttcaagaactgttactaattctgttaatgaacctgttggtacaggaacacgttgagcagctccgtctaatttaccgttcaattcgggaattactaaaccgatagctttagcagcacctgttgagttaggaacgatgtttgcagcagcagcgcgtgcacggcggaagtcacctttaggatgaggtccgtctagagtcatttggtcacctgtgtaagcgtggatagttgtcattaatccttcaacaacaccaaatttgtcgttcaatgttttagccataggagctaaacagttagtagtacatgaagcacctgagataactgtttctttaccagttaatgtttcgtggtttgtgttataaacgattgttggaacatcgtttccgccaggagcagagataacaacgcgtttagcaccagctgttaaatgtttttcagctgctgatttagaagtgaagaaaccagtacattctagaacgatatctacgcctagttcgccccatggtaattcttctgggttgcggttagctaatactttaacttcttttccgtttacgttgaatgaaccttcatgaacttcaactgttccgttgaaacgtccttgagttgtgtcgtattttaacaagtgtgccaacattttagcatctgtcaagtcgttgattgctactacttcgattccatctacatcttggatacgacggaatgctagacgtccaatacgtccaaaaccattaatacctactttaactgtcatttaagatttcctccttatgaaaatcaaaaaaatatttattttaaagggttaccccttttaaaatctcatttgcagcagcttcatcagtgatgagccacgtttgttttggtgcatttttcatataagctcgaattgctttagcttttgattttccgcccgcgattgccatgatgatcgggactttttccaaatcttgcaattctatgccgattctagggaccttataaacgacttcacctttttcattgaaaaagtagccaaaagattccgcaacagcatttgcttgtttcagcatgactaattctttttcagtcatcttacgacgtgctgccatgtgtaatgcacgcccaatactatgaataacacaattcgcttcactaatcaagtttaagacttcttggatagatggctcattgagtaaagaattgtaagttgccagacttaattgttccggaacataaagtgcgcggtggttaccgtttgctttagcagccattcttgcactgacagaatttgcctgtacagttatcgcttcaccaatcccgcctcttgcagggacaaacaggttatgccgtttcttattttccagattagacaattgttcggctaccacagccatagtagttcctcccatcacagcgatgatattctcgccttctggaagtagtcggtctaaggcttcgctcagcgcttcgccgaatgcatcagccactttggtctgctcttcgctgtttcctgaaacaacgatacagcgttggttaccaaaatattctgccaactgttgttcggtttgatgcgtacctaaaagctgatccatgaagttttcaaggctttgataaacttcttcgcccttagttgtcagcgtcataccgctttttgaggtgtcgatcaaattcagatttttcaaaaggtctgtttctgttcgtaagactcgttctgtgatccccatactttccgataaacttcgacgcccaatcggctgcatccaatagatatttcgtaaaattttatagcgttcttgcaacacttcgataatatctggtgcaacagattcaatcatttttatttcatccagcatagcgatctccttagttggacactttacgtccaatgtagacttaaaacgacccatatacgataaaaaaagaaattaactattcgaatttcacatcaataaagggaaatctcaacctcacgactgtaagtctaacagttttgctctcgtttttcaactaaaaagactagaaaaagtgaaatactttttctagtcttttgactgattagttatcataacgttttctttttgatgaactcgggattcctaataaatcacgatattttgctactgttcgtcttgagatcgctatctcatcttttttcagcaattcaaccaatttctggtccgacaacggcttgtttttgtcttcttgatcgactaattcctgcagctttttcttcgctgtatctgctgaaaggtcttctgtctgttctgtactattcgtaggaattcgtgtagtgaaaaatttttttaattcaaatacaccgaaatctgtttccaaatatttcccgttgactgcacgactgaccgtggattcatgcacatctatctcagttgcaacttcctttaacgtaagaggcttgattggacgttccttgtcgataaagaaagctttttgccgggaaacaatgacttgagcaacccgcaaaattgtatccccacgttggaggatcgttttcttcaaccattcgaattcctgtttccgttcttttaaataattttcagtttctttatctgcttgttgtgacatttgtttgaagtaactctcttgaaagcgtatatttggctgattttttcggtttgagataacttgtacatttttatcgtcgtccactaatacccggacatcaggaataatgtacaattcgctgctacggtcgaaaatccggccagggcttggactcaacgtttgtaaatagtcgaatatctgctgaacagcatgtagatcaacagaaaaacgttgtgcgatttctttccattttcgctccaccagttcctcaaaacattcttccaacacgatataagctaattccggcgcataatcatctcgttctgtttgaagcatgagacattcttgcaaactacgtgcacctactccagctggttctaattgctgaatcagagtcaacgcatcgagcatttggataggcgtagctccaatctcttttccggcttcttctaaactaatcgtcaaaaatccgttcaaatcgatgtattctacaagataaagaacgattttcctcaaaaaagtatctcggtaattcaaatggacttgttcgatcaatgaatcaaataaagacccttttgtatcaggaatctgatttaggtaatttgtctcttctccttcataagaagatgaagaagcttttatgtaatctggctgccattccggctcaacaacttccaccaatggattttccattgcttgattctcaacgaatgccaacagctcctcactgttatattgtaaaacttggatggactgttgcaactgttgcgtcatggctagtttctgtgtctgctgctgtttttgtgaaaaattttgctcaaatttcatttttttgtccaatccccttgtaattttttatctgtttagttacaattatcccagtgcttgcgtccttagtgtagtggatatcacgtaagattccggttcttgagacgggggttcgattccctcaggacgcgttctactgctattttagcataatttacgaatagttgcttctttatttttaagtgaaaactgtccgccaaagagaattggtggacagttttttgttgtatctgtatagatattgttaagcctttgcaagtaaggtagttatgtgttcaactacttattaaaatgtgttatttattaaagatacttgtctcacttactgaactggccgatgatcgtttctgccataatagttctcgacagccgttggatgccctaataaatcgctaactgtcgtgatgcgatagccttgctctttcagataatcgatcacttgaggaacggcacgaatcgtttcaggatagatatcatggaataaaataattgacccatcgtatactgttgcttggatcttctgcaaaatcaaatcaggattccttgtcttccaatcttctgaatcaacagaccattcgatgatcggtcgctggatgatcgttgctcctacattcgtgacagaaccatagggcggacgaacaaaagcgggggttttgccagtgactttttttgatctcagtgtctgctttcgtcacttcctccgtcatcgactgggcagaaagagtggccagattctgatgatcgtatgtgtgattgccaatctcgtgccctgcttcagctgtctgcttcacgatttcaggatgctgcgccgtattttctcctaagacgaaaaaagtgacatgcacgttttttcttttaagattcgcagaagctgcggcgttgtggtcgctcctggtccatcatcaaagctgattgcgacgcttttgacagtcgggtcttggattgcttctgtactgtcttgtgttgattgtgatgattgactttgtaccttttccgctgattcttgaatggcttctttgacgttagctgtttcagttgattggcttttaatggttgattgttctgattgtttgaaagattgtgacgaatgctccgaagagtgtgtttgtccttttacttcggtgatcaaggaggccaccgaagtaatttcgaaaaacaaaagcacggataaagcaataatactgatgactaaataatttcttttcactatatctcttctttctctttttctcttcttattatttacttgtacttacttgaaaattgaaactgctagtcgcaactacttctcgtctaatgatccaaataatcttccgatgccaaaatcgtttttgtcacggacttaggaatgacaaattctggtgtacccatataaccaggagcaatttcgtattgagaaaaagtcaaaactaattgatgctctttgttcaaataaaaacttcgtgtaggcgtaacaagtgttggtttttctatcgtcccttcttgaatatcttgctcagtccaatagtacttagatggatcttccttgacttgttcggccatctgccgtttgacttcttttgtcaaaacagatagataagtgtcatctttgaataaaagtggaagtgagagctggacactgtttttcttgtcgattgtgtcgtatcttttttcaacatggctatctgctgctgtttgggtgatctgcctttcaatcacgagaaaccggttatcgtctacgattttctgataatctcccaaaacttggtaatgatccgtttcaaaatttccatattctttttcagctttttcaaaatctgcttgtccttcgcgaaagtatttttgatttaatccatgaattgttttattttctttctcattttgtgtattgatcttcggtacctgaatatcgattttttcagatcgatcagtaaagcgttcgcctaagatcaattcaatgactgatcctaagatgggtaaatcttctgcaaagcttcgaacttgactattaaaaagaaggctacttgttgtaatcattacgatagccaaagatactccgaacccttggagacgtctctttctccgccttgcttttataaatgattgctcttcgataataaaacgctggcggatctcctctttaagccctttgggaattgcttgttctttataagttttctttagtttttttaaattttctttttgggaatacatggcactcttctctccttcattctaggatttgacgtaaagcattcaatgagcggtacattttcgttttaactgtgttttcattcatatccaagatagttgcaatttctttcaaacgaaatccttcaaaaaagtagaggatcagaatctctttttccggactgtctattttatctaaaatcatatggagctctgcaacggaagtttctaaaggtaactgttgggggatatcttgaatttcaaataagtccacaggcgtccttttttgtctgcgccaactatctaatgccgtgcggatcaatatccgataaaaccatgcactaaaatgctcgatctctttttctttttcaaaatagttcaaggctttatgaaaactatcttgcatcacatctaaggcctcttctttatcatgtacgtaattcatcgtgatacggaacattttttgataatcagtttcgatgagtccattcagcaggtgacggtatttttcgatctgccgttttttcttatatccagtaaaaatcattctccactcctttctgcctcacttaatatgacgtacaaggtgcgctaaaagtttcaatttttttattttttatgtatttacttgggatttttatatacaaaaaagaaggtgtgacaaaaatcgtgtcacacctccttattctgataggctgatcgtctctgtcacaacctctcgtaagaaaataatgtttattctttttcagagtcagaaaattcttcctcttcataatcttcatcatcatcgtcttcgtctatgatacttaaatcttcttcgatatttcctggcaagtcttcttcatcatctgtcgggtcatctgctccgatttcttgcaagtcagaattataagcagcgatttcttcatcttcatcatcatcgtcatcaaacagatcatcgtcatcttcttctgtcagatctgtatcttctgggtcatcgtcattgtaatcgatcgcgtcttcatcatcattgataaaggcgttgactttcttgcgtttacggcgacgtggagtatcttcatcctcttcgtccattccatggtttacttcttcatcgatcgaatcgatagcataccatgaacgcaagccccaacgattatcccctaatgagataaagctgccgtcaatattcaagtcagtataaaattgtgcgagtgaatcacgaatttcactgtctgatttctcaagatagttttggatctggttagctaaatcagaaaaatccatgacatcgccacgttgttctaagatcgcgtgtgctacttcgatcattgataattcgcttttgtttgcaccttcaaatacactaatttccaatcaggacacgtcctttcacagtctactccttatcatacaaaatcagacacaaaaaatcaaacttttcttttatatttacgctgtaaaatccaaggtcaaataatattcgccgattttttccggtcccatgaacagatcataatcgattcgaaccttccctgctgtgggacggtctttcaaactaacatgcagttctttcgtaaaagtagcaatctggatcataccgtatggtgttcgataggatgtttctaaccgttctttatagccaaatttcaaacgcatccgcatttctcctgcacggatcagctgtacatgaccatctggaactaatttgatcgttacaggaatctcatcgcccgtctcctcctgaatctctttataacgtatgtacagcgtatcgccaattgtcaccatttgccctttcaaatcaaaataaaaatcttgcacttccccttgctgttttacttttgtacgcaatttgattgaaatcggtgttccttgtgataattccattattcattctcctttacttctcatagctacattgttcctagtttcttttgttttgtcaaccaacttgtccatttttacagaaaaccttttttccaaaacaactctttgattttagagtataatattgtagaaaatatgaatttatacaaaggagccggttgaatgaaccctgcgattcgactagatcagcacatttatcaaaaaaacgacttttccccttttgcattaacagatatattaacggaatattctaaagaacaccagcaaatctttttacatttctggcaatatgactgcacagtcatcttaggtatgaaggatgttcgaactccttttctaagtgacgggatccaaacactgaaagatgcaggttacgctccagtgatcagaaattcaggtggattagggatcgtatcagatgaaggaattttaaatatttctttgattttccctcaaagtgacacaaaaaaaataaccatagatgacgcttacgagcaaatgctcctattgactaaatacgcttttccaaaggcaccgatacaagcattcgaaatcacccattcttattgtcctggaacttatgatttaagcatccatggcaaaaaatttgccggtatcgctcagcgtcggatcaaaaatgggatttctgttatgatgtacttaagtgtcaacggtaatcaggaaaaacgcgggcaagtcatgaagcgattttatcaatctgctttaaaagaagactttggtacaaatggctatcctgcagtggatcctgctacaatggcaacacttgaagaactgcttgaccaacccctttttgtaaaagaagtcaaagaagcatttgcaaaagcttttgaaaagctgtattctgcaagtgatttacaggattctaccgactggctaaaaaaagaaatccagctggagcaatggaacaaccaaatccagagaatggaacaacgtaataacataaaggagctacattatgacaaccccttataaatatcaaatgctgcctatggaaaaagtttttcgtgatccagtccataactatatccatgtccagcataaagtaatcttagatttgatcaattcgaaagaagtccaacgtttacgacgcattaaacaattaggcacttcttctttcacttttcacggagcagaacatagccgttttacccattcattaggcgtttatgagatttcaagacgaatctgcgatatcttttctcgaaatttttcaaaagaaaaaataggcaacggaggctgggatgatcaggaacggctggtgactttatgtgcggcactgttgcatgatgtcggtcatggtccttactctcatacatttgaacatatcttccatacgaatcatgaagccatcactgtagagatcatcacttctccagaaacagaagtgtatcagattcttaaccgagtagaagaaggttttcctgaaaaggtagctagtgtgatccaaaaaacttaccccaacccacaagttgtccaaatgatttctagtcagatcgatgcagatcgaatggactatttgcttcgggatgcttatttcactggaacagaatatggaacatttgatcttacccgaatattacgtgtgattcgtccttatgaaggcgggatcgctttttccatgagtggcatgcatgcagtggaagattatatcgttagccgatatcaaatgtatgtgcaagtgtacttccatcctgtttcccgtggtatggaagtgattttggagcatctgcttcatcgcgcacacgagttgtatcaagaagatgccagcagttttgaactccattctcaattacttctgccatttcttgacggaagctttactttagaagaatacctcaaacttgatgatggggtcttgggcacttactttactcaatggtctgaatctgctgatcctattttaaatgatttagctaaacgttttttgaatcgtaaaccactgaaatctgctactttttctggcaaccgggattcaaaattagtccaagaactcactttgttagtagaaaaggttggctataaccctgtttattacactgctgtgaattctagctacgatctgccttatgatttttatcgcccagaacaaggcagacatcgcacacaaatcgagattttgcgaaatgacggaactttgatagaattatcacaggttagtcagcttgttgctgcattagcgggacaagaacaaggagatgagcgatttttctttccaaaagaaatggttgatccctccttgcgtgatcattatgatttatttgacgaaacttatcaagaatttgccagccatatccgtaatggcgcattgattgaaataaattaaaatatattggaggaaattatgtctatcaaactagtcgctatcgacatcgatggtactttattaaatgagaaaagagaagtaacaaaagaagtaaaagaagcgattgccgctgctgttgcaaaaggtgtttcgatcgttttatgcactggccgtcccttaccaggtgtccaggaacagttaaacgagttgaacctttttcaagataatgattacgttattacttataacggggcactcgtacaacaaacgaaatcaggtaaaatcatcgcccgtcacggactgactcatgaagatttcctagagatcgaagtgatggcacgccgtgtcggcagtcatctccattcgatcgatgacaaagcgatctacacgcctaatcgagatatcagcgcttatacgatccacgaagcaagtttagtcaagatgccgctaaaatatcgaacacctgaagaaatgacaccagacatgaacatcgtcaaaatgatgatgatcgacgaaccagaaattttagatgcagcaattgcgcgtttaccgcaaactttccgtgataaatacacaacggtcaaaagtgcgccctattacttcgaagtactaaataaagaagcaagtaaaggtgcggcagttgcgaatctcgcacagcaccttggtattgatcaagatgaaatcatggctatcggagataacgagaacgacttatccatgattgaatatgctggtctaggagtagcaatgggaaatgccgtttctcttgtcaaagaagcagcaaatgtcatcacttcatcaaacgacgagcacggtgtagctgaagcaatcaaaaaatatgtactgtaataaataaaaaaactgagagaaagctgatctactcgctttctttcagtttttatttttttcgatccatctctcgactgcccatcggtggctaccacgtttcaatttcacaagcgcttcttgagggctcacccaccaaattttattggtcttttcagttggttctcctatacgcttccaagaatcagcaacaaagaaatatcctggattataataataagttgcacgataattcgagtaaaaatactcatcagcttctcccagataagaagaaatttctgccacaattcccatttcttctatcagctcacggacaatcgcttcttctttcgtctcttctccttcgatttccccaccaggaaggaaaaaagcaccatttggagcctcgatcaccgcaatccgcttgtctctttctatgacaatatatgctgcataacgggtttgataattagcagattgctttttttcaccaaaaattggtttatccatgaattgtttccaccttaacagtattattttctatccattttacatgagaaatttctcatgaacaagcacaaatcaactattttcttacttctttttgttatgattgagtaaaaggaaaaggagagatgaatttatgaaaatggctcacacatgtgttcgggtgaaagatcttgaagcatcaatcgaattttatcaaaaggcatttggttttgaagaaagccgccgccgtgattttccagaaaacaaatttacacttgtttatttgacacttcctggagatgactatgaattagagttgacttacaactatgatcatggtgcgtatgatctaggagacggctatggtcatatcgctattgcagctgatgatttagaaaaattacacgagcaacataaagctgcaggtcttgagattactgacttaaaaggattacctggcactacgccttcttactactttgtcattgaccctgatggttataaaatcgaagtcatccgaggatagttagtatggggcattttactcttgattgaataaaaaacaaacaccaataattaaaaaaagacgcaaacttttcattaaattgaaaaagtttgcgtcttttttttaacaaccattgtagctataaggctgccactctccaccaatttatttttaattcatttgaaagaaatcaaataaacgaggtacctttagaaaacaaaactgcttttcctcctattatcacacgatcttcttttaattcacattctagatccccgccccttgatgacatttgataagctgacaattttgttttattcattctttctgcccaataaggaataagattagaatgtgctgatccacatactggatcttcattgattgttaattttggaaagaaggttctagaaacaaagtctttttgcacactttctgctgtcacgatgactctattcctaattcaaaatttttgatagctgtaaaatctggctgcaatttagccaccgttttttcatcttctaatacgaaaaataaatcacgtgctaagtaggcttctttaatcttagccccaattgcttcttcatattcagtcaatatcggcacttttttcggcataatactaggaaaatccatgtaataataatctttaattcttgtcacaaatagattaccgctttgagtagaaaatttaatcgtttcatcaggtattttgtaatagttaaataaaacaaatgctgttgctaatgtcgcgtgaccacaaagatcgatttctcgatctggcgtaaaccatctaagctcaaattcttggtttttcttcactgtaaatgctgtttcagataaattgttttcaatggcaattttttgcatcgtaccttctggcagccattcttctagcacataaaccgctgctggatttcctttgaacacctcatctgcaaatgcatcaactacgtaataatctaagttcattttaaagcccctttctctaatttgttataaatatattctgcacaacaaagatcttcaatagctagaccaactgcgtcgaaaatcgtcggcctcgattctcctttataaaatgtttttttctcagaaactaattcgcctaatgtaccaacaatacaagattcctctaaatctccttctgccatggctataagcaggtccccgctttctgttaaggtagctgagtaatcatctacatagatttgagaagtttccatcaacgatgtacttatctctcttgtatcaggagtaaatgtgcccacagcattgatatgtgcgtcttcccttacccactctttttgaagaaatgcctctttactagaggtcaacgtacaaatgatttccgctggacgtactgcatcttctactgatattgcatttataaacgttattttaggatactgttttttagctttagcgataaaagtatttcgtctttcttctaaaatatcgtaaacaaacactgtagtgatgggacgaatggtagaaatcgcagtcaaatgcgacaatgcttgttgaccagctccaattaaagcaagtgtttctgcatgcggatttgctaagtaatctgttgccagcgcagatacagcagctgttcgaatccaggtgactgcatttgcgtttatcaatgctttgggtagtccgttttgagcatcaaacaagaaaatctctcctaaatgagaaggtaaatgatactgatgattatccggaaaagcggtaatgacttttgttccaaaatatctgttctcccccaaataagcaggcatcatcgcaaacatatttttgtcttttccgtcaggtaaaatttccaccaatcgaggattttggctgattttaccactttcataatcaaaaaaacattttttcattacttgaatcgcttcttcaaaactaaaagaagctactacttcctcaaaattaataattttcatagacaattccctcctcacaaaagattaacttctaaaatcaatacaatcaatggtaaaattgtatggtatacaattttaaggagtggagaaaatgcctattaattcttatgacaattacccgttaacttggcgaccagacaaacaaaaattgaagcgtccttattatcgatcgttgattcaacaattagaacaagatattttaaagaataaattacagaaaaacactcagttaccctcccaaagagagctagctgattatttagatttaaattttactaccgttggcaaggcttataaatatggaattgagaaaggtttgctgtatacgaatattggaagtggcacatttatttctcccaatgtctttgagtccatcaccatctctaccaatgaagtaaccgaacatatcattgattttggtctggttagttcttttgaagaatgtaataaattcgttgtcccgtttattcaatcaactagtaataacccaaatcttgttggtttgcttaattaccaagatcccaaaggcacaaattttcaattgactactgcagcaaattggttaaaaactcaaggagtcattccgtccttagaatctctatctattgtttccggtgttcaaaatggattggctatcacactttctgcacttttctctccaggtgatagaatagcaacagaccgatatacatacgctaatttcattgaattggctcagttatatcatttagagatcgttccaattgattttgacgagcaaggaatgcgacctgatatattgattcaggaatgtagaaaaaagaagattcatggtgtctttcttatgccttcttgtaataatcctatagggtttcaaatctctcacaaaagacgagagcaattagccgaagtgattgaaaaagaaggtctatgggttattgaagatgatatccattcatttttaacaacttactatcaacatacgatcattcctcctttccaaaaattattacctaaccaaacaatctacttagctggaatgacaaaatttatttgttctggattgcgagttgcttatcttgtagttccagtacatgtccaaaacaagatagaacaagcaatttttaatataaatgtgaaaacttctggattagatgtggaagtcatcactcaaatcctccattcaaatgaagcaaataggatcttagaaactaaattaagtcttacgaaaagagccaatcagctttttgattctcttttcaaagtagaaaaaccaacgaatcgtgtcccttactatcgaattcttccagttgatcctgagattgatcctaagataattgagaatgactttcttgctaacggtatccgactttatcattccagacgctttactacacgtgcgcaaccagatgcattcgttcgaatttccctatcctctaataaccttgaaattttagcttctggactaagtatcgtaaaagaaaaaataaaaaaatatgaattataacctattgataaataaaggaatcaaatcttattgattcctttcaataagaaagaggcactacccgaggttcaacaacggatagtgcctcaaaaaataaacgaacattttgcacttaaagtatccaagaagcaagaaaaattattttattttcttattttactaaatcactaggtttctgtcagaagatgaaattatccaatcatgacactttcttctggatatttgtattttgattgtgttctttgtgcttttgtcatcagagagaagaccacagtcaatacaccaactcgtccaatgtacataagcgctataatgatcaatttccctattgcagtcaagtctggcgtcaatcccatcgtaagacctactgtaccaaacgcagagaagacctcaaaagcaatatattcgatgccagaagttttaggtatcgtttcagtcaccgataaaatcatgatggcgactacacacaacgtcaacgtaacaaaaaataaagtaagtgcccgcaacactgcgccttgtcggatggtacggccaaatgcttccgctctcgtacgtcctttaagcatcgaacgcatctggatcagcaacacacctaacgtagttgttttcaatccgccggccgtcgacccagatgttccaccgatgtacatcaaaaacatcgttaaaatcagacctgcatggctcatatggaggtaatcaactgaataatatccagccgttctaggtgtcacactcataaaaaaggtgtttgccaatcgttgaaacatattcccttccactagcgtttccccattgcgctctgtgaaaaagaacacaacgaatccgcctaataaaagggtacctgtaacggttaatgcgatttttgaatgaatcgttatcttctttttctgatgatattccagtaaatcacgccatacgatgaagcctaacccaccagaaatgatcaaagcagataccaccatgatcaaataaacattttgctggtgattggctaaactgtctcctaacaaatcaaaccctgcattacaaaaactagagattgcatggaacaaactgtaccagatacctttcaaccagccaaattcaggcacgaatacaaaagataaagcaaccgtaccaatcagttggatcacaaaggccaatttcaggatgtaaagcatgagcttcatcacacctgatacttcttctagattcagcgcttcttttaatataatacgtgtgctgagactgactttcttctttatcaatgcaaagcatagaatcggaaccatcataaaaccaagaccgccgatctcaatcaaaagcatgatcaaaaattgaccagcactgttccaatgctctgctgtattcaatgttgtcaatcccgtcacacagacagcagaagttgcagtgaaaagcgcatcgataaaatttgtcccatgcccactattactaaaaaatggtagggtaagtaggccgccgccaactaaaatcaggagaaaaaatcctaatgcgagaagctgaacagccggcaagcgtttctttatttgtttgctttgtttaatcatcgttttcctcttttaaaaaaggataccacttagtcagtggtacccatattttttactttgatcaaccttgttacttctgcgcgctcgttttcttccagcttcatacgaatataatagatcgtttcttctaattgagggatcgtcatatattctaatgcattgactcgccgacgtgtcttttcgatttcactcgccatcagttgacaagttttttcgatttctgtcagttccaaaagttttggaagcagggtagtaaaccgatcgattgaccgatccagttcggcactggaattcaaatacccgtattccaaaggtgtgtctgtcagctgttcatcatattcaaaattcatcacaggtacttttacactcatgatatttttgtctacgatagacaaatcaacgttttccgccggcaaaacaaataattcttcgatgaaaggctccgtgatcgaagcatttgccaatacaaaatcagacattgcttctgtcatagactcttccatttcttgacgcagctggttgttctttcgaatcaacaggatgaattgacgcatcagttcatcttgcttatcttttaataatttatgccctcttgtggcagttgtcaactgttttttcaatcgagtcaattccatgcgggtcggattcacattcaatcgtgccatcagaactcacttcccttctggcagatatttgtccagcatgtcgtctttgattcgttttaattcggttcttggcaacatcgatagcagttcccaccctagatcaagtgtttcagtaatcgaacggttcgtgtagaatccttgattgacatattctttttcaaaccgctcagcaaacttcgcatagatcttgtctacatcagataaagcagattcacctaaaactacggccaattcttttgcctgttttccttgtgcataggctgcaaaaagctgattcatcgtagctgcatggtcttctcttgtctttccgggtccagttcccttatcttttaaccgcgaaagagacgggagtacatcaattggtggctgaatcccactcttgtaaagctctctagtcaagatgatctgtccttctgtaatataaccagtcaagtcagggattggatgagttttatcgtcttctggcattgttagaatcggaatttgagtaaccgatccttttagtccgcggattcttcctgctcgttcgaataaagtagctaagttcgtgtaaagatacccaggatatcctcttcttcctggaacttctcgccgtgctgcagaaatctctcgcaatgcctctgcatagttggtcatgtctgtcatgataaccaaaacatgcattcccttttcataagcaagatattctgcagcagtcaaagccatacgaggagtagcgatacgctcgattgcagggtcgtttgctaaattcataaacatgacagaacggtcgattgcgcccgtttgacgaaaatcttccatgaaaaattctgcttcttcaaaagtgattccaatagcagcaaagactacggcgaaatcatctgatgaatcgagtaccgttgcttgtcgcgcgatctgagcagctaattctttatgaggaagaccagagccagaaaatactggtaatttttgcccacgaactaatgtattcaaatgatcgattgcagagatacctgtttggataaactcatctggataatcccgagctactggattgattacttctccgttaatatccaaatgcttttcaggcaggatctctggtccgttatctttcggtcgtcccaaaccatcgaatactcgaccgatcatgtcttccgatacacctagttctaaaggatggcctaaaaatcgtacagaagagtcacgtaaattgataccacttgttccttcgaatatttggaccattgctttatcttcttggacttccaatacttgtccacgacgaatctcgccattttgcatacggacttcgattaattcttcatatttgacaccagcaactttttcaaccgccatcaatggaccgacgacttcaccgatcgtacgatattctttaatcattgctcatgcctccttctgaaacgatcgtttgcatcgtttgcttgatttcaccaataatttgatctagtttttctaattctgtttccgggatatatttgcttcgtccgatcctttcacgaatcgatacggtaccgtccatgatctcacttaaataagcacctaacgacaacgcacggcgtccttcttcaccaaaggtcaagatcatcttcaacattttgaattgtttctctcttgaagtgaatgtatcgacatcatcaaaagcattttgctgcaaataatcttcacgaatggattttgccacttctaatgtcagacggtcattatctgaaagggaatcaatccctaccaaacgcacgatttcattcagctgctgttcttcctgcaaaatacgcatgccctcggtgaccatggatgcccagtcagcttgaaggatatgatccatatacttccctacttctgttgaataaagagaatagctttgtatccaatcgatcgaaggaaaatgtcttttttgggctaaactggaatcaagaccccagaatacttttacgacccgcaatgtattttgtgtgactggttccgaaatatcccctccagacggcgatacagcactgattgcggttatacttccttcgcgaccttctgatcctaatgcaatgactcttccagatcgttcatagtattccgcaagccgtgaaccaagataagctggataaccttcatcaccaggcatttcttccaaacgtccgctcatctcacgaagtgcttctgcccatcgtgaagtggagtctgccatgatagcaacgtcataacccatgtcacggaaatattccgcaattgtgattcccgtatagatagaagcttctcgagctgctactggcatgtttgatgtattagcaatcaataccgtacgttccatcaacgattctcctgtattagggtcaatcaattcagggaattcatttaaaacatccgtcatctcatttccacgctcgccacatcccacatagacaaccatgtccacatcggcccattttgcaatttgatgctgaacgactgttttccctgcaccaaaaggaccaggtacagctgctgctcctccttttgtcactgggaagaatgtatcaatcactcgctgtccagtgatcatgggtgcatccgggtttaatttttctttgattggccgactacgtcttactggccatttttgaagcatcgtcaaatttttgtcaccattttcggtttcaatgacacatactgtttcatcaatagtgaatgaacctttttcgattgttttgatcgtaccttttatcccatttggcaccatgattttatgttttataacttttgtttcttctacgatcccgataacatctccagcactcaccgtttctccggcttctactgttggttcgaaccaccattttttctcatggtccaatgcgggcaattgaactccgcgccctaagaaattactttgtgtgatttccataaaggtatctaatggccgttggattccgtcaaacatttgtgaaatgatccctggtcctaattcaacagataaagcttcaccagtagagcgaaccggttcgcctggaccaattccagaagtctcttcatatacttgaatagacgccacatcgccacgcatctcgataatttctccgataactcctagatctcccactagacacatgtcttggatactggcatcagacatgttctcagccattacaagaggtccggagacttttatgatttttccaatttgcaaaatttctatctccttttcatactataagatattttgacctactgctttttctacgtttttttgaatttcttccagccctatccctaatgatccttgatgattgggaatcaatacgatagcaggtatcatttgttccttgtaacgttcgatcgtttctgggctcaatgctgcacattgctctgtgacataaatcacgccatactcattctttgccatttcttcaattgcctgacgaacggtttgcttggttgtaccataacgaacatcaaagccaaacaatttgaatggcaaaacagaatctttgtcgccaactacaccgatcttatgcgtcatagacttgtctcacccgctttctgattgtttctggttcgaaatggcttcttttgccgataaccagtaaacgaaggtttttgctttctacctcttttgcgttcaaaaaggctagtagtggcagtggtccgaaagcctgggtttgtgcttcttgatacaatgaacttagataatcatctttcaactgttcaagctttacgagatcaagatttccctcacggatgacagggcgcagaaaatcagcataatctgtctctaatagaaaattcgtgtaatcttccatatctttatctacaaagttcaaaaatacttctttttcgatacttcccgagctggaaagtaccgtcgtcatgaacccatatgttcttttctgcaatattcctcgagccatcgttgtgatattggtcaagtcaataaaagcaatgacttctgtcagcaattcttgatatcctagcttatcggcaagccgtcgctgctctgtcaaaaactgtcgatcataaatcacgtcaattccctgaagaatggtagactcttcaaaataatcacgtacttctcgtatactgtccataatgctttcagggagttcatttgaaacttgcgtatgaatggcatccttcaaggtttctaatgaataaaatccatcgtcgatatacaaatggtccagattttgatttgtcatctcggcttttgtcaaaaccttcagattatggaaagtatagcgcatcgtatagatccaaacgatttcaggctccggtgctgattcctttaaccagcgaaatagacggctctgctcctttaaaagattctgttcgaagtcatattcatatccgtcataaatatatggactgtaaatcgtggatttcaatatttcaccaagtgcttcgacagaatttgtttgaatcatccgttcaaatgtctcattggacaaaagttcaagctctcttccgcgaatcaagggatttagttcgtggtattccatacactgatccctccttattcgaataattgattggcaatctcaaaactcatcgttccttggatatcttgtacaaggctgctgaaaagaaaattatactgaactccttgatcgtttatcagaaaacccgcttgatcagcaacagtttcatcacttaaaaccatcataaagggaagttcattgttccattcatccagcaatgtctgagaaagataagctgctgatttttctccagcaatgaatgttactttgcctgtcaaaggtaatgaatacaatgaatttttgataaactggatttgttcagattcatcccaattctccatttcagctattgcatctgcaaacaatcgtcgtaaaaattcctgcttcgcattcaaattttcttgtcgtacttctacttgttggcgattcctaagctgacggtattttttttcaagtaattcgatttgtttttctttttgtttttgatgttctgtttcgatttgcgtacgtttttgttcaaagttttgatcgatcttcattcgctcttcttgctctaacgccgctctttcttgctctgctgcttcattcatctgagagatgattttttcaatggcgttcatctgcttttcctcctttatgcttaggcattcaatactaataggaaggaaataacgaaacctaaaatcgcatatgtttcaaccatcgcagcaaaaatgattccttttgtagcatgttcaggttttttcgctaaaatttggatacctgctgctgcaactttcccttgggcgatacctgaaaacaaacctgtaaaagcaatcggcagagaagcgcctagaaagttcaatccttgtacaactgacatatcatttcctaagttgataaaaatcaaaaaggcgataacgaatccatacaacccttgcgtacctggaagcaattgcagaatcaaagcctgtccgaatttttcgggttgacttgttgttaacgctgctgctgcctcacctgtcattccaacacctttagctgaaccaatccctgaaaaaatcgtcgctgttgccatcgctaatactgcaaataccattccaccattttgactaattaagtaatccatcattgtataaaaatcctccaattatttattgttttttttcttatgattgatgttgacgtatttttccgccgttttcagcgggtcaaaggcacgtccgcctcctgtataaaattttccaaaaaattcgacatactgcaatcgtgcaccatggacataggcacttaacagtgtcaaaaacatattcagtgcgtgtaaagcgatgatcaaaaggatccctacactgaatcgagcggctggcggcatgaaagcaactagcatattgaatgccgcgccaatacttccgcctgaaatacctagtgccatcaaacgtgtataactgactaaatcaccgatataaccagtcaatccgtaaagattatacgctcctttggcagcacccttgactttagacggcgattggataatcggcacgattaagatacataaagcagcaatgatcgatagccccgcgccaagataaacaaatgctgtattttttatcaacatgacaccaatcaatgcaataacgatcccaatcaggatcccttgccaggcaaaaccatcactgacagcactcaagtaatctttcctcctgatattttcctttgctgccacgaataatccaaccaagatctgtatcagaccgaaaatcacggataaaatcaaaatcgtattgacgtcatccgtcgtagataggattgggaaaggcaagcggataccaaatagttcttttggtaatgcctgtccgaaaaatgaactgtagatcaatccccagatgatcgatggtaccgagagaatctcaaagaattttacgaaacgtttcatcccgcggggtaaaacaaatagtttttgagctagtattgtcccaatgagcatcagcaatccgtaaccaacatctgcgaccatcatcccgaagaagacaagataaaatggtgtcatccaaggcgttggatctacttcttcatattttggcagactgtacatttcagtcagcaattcaaaaggttcgataagcggatggtttttcaatttagtagggacttcctgctgaatctcttctgagtttggtgtttcgaaactaacgtatatatcttcttctgatacagtttcgtttaacacatgcatcaaattctgtttttcttctgcatctacccaaccttgcaaaacgatcagataagtggcatggataaaccgttcttttactttttcccgttctgcaacggcaagtgtgacttcttctacccattcaaattcttggatatagccgctgcactgacctaacgctgtcgttatctttttttgctgctcgtgaacaatggataattgctgtttggtttcttgcaatttttctttaggattttgttcataaggatacgtttctttattgaacccgtatttcccagcaatttcttctatagcagcaactgatttttttaaagcaacatacgaaagataaacttgttttggcgtataatctatttcttccatataaacgtcatcaagcttacttagttcttccttgaaactttcaaaatttgctgcactcacagtccccatctcaaaaatggtcgtcttacttgcatacatacttggagcaatatccagctgttgccaatgaagaagccattcttcctcttcttctaaacgatcacgtttttcagttagctgttcccacttttcttttaaatcaaggacttcttctaatttattcatgaaattttcttcggaataatttgcttccaagtcttgtaaggaaagttcttgacgtttcaaatggagtttcttttgacggctatcgccgtggtgttgtatgaattggatagcttcttggatgtctttcagccgattgcctaaagcgcttaattttgcttctttatcaataatcgtggtatctggaaaatatttttctacccactggttgtttgttctattttgatacagatcccggatttcaacattttggattccttgtactgcttgtaaaatcctctcctgatttcttttatctgaaatgagggtcactttttccatcttagtgacggccataagtttctttcaccctttcaatgattgcaccgattgcttgactctgatgcttttgatattggtctttcaaagttgcttgcaccttgtctgcttctgctttcaatttcattttttctttttctaattcttgcttttcgaattgttctttttcttctaccaactgtttcagctgttgccgactgttcgtttggattatctccaattcttgctctttttcttctgcataggtcttcaactgctgccgtagggttcgagcacgcttctcattttcttcttctgcttttcggatttgttccaaagcttctaacacttgcttcacttcctttcgatttaaaaaagaggtacatgctttcttttttcattgaaagtatgtacctctaaagataacttagtataggcaggccccttcaataaaatgtccttctcaccccttgaagaactagatccttgaagcttacgcccaacctttttatttctgcttactttttattataacaaattaagcaatattttcaactatcgtcatgaatttcacacgaaaattctctttacagatagtaacacagcaagaacagataagtataggggcaagtcttacatagtttaaatttttttaaatccttgttacaattagtctactttagggggaataaaaatgaaaccaatcatcggcattgccgggaatcaactgattcgagcgacagatactttccaaggaaatcaagtaagctatacaccgcagggatttgtggatgcagttttagatgctcaaggattacctcttattctgccagtcatgtctccagattcagcgcctcaactaattgagaaaatcgacaaactcattcttgcaggcggtcaggatgttagtccgcaactttacatggaagaccctcatccaaaactgacggaaacaaatattcaacgagaccaattcgaacaggcattgatcttggaagcattgaaacaaagaaaaccgatttttgcagtctgccgaggacttcaactattgaatgtcgtgttggagggaacactttatcaagatctttcattatatccaaaatggtccgtaaaacacgaacaacagcccactgccccgcagtttgcaactcacgaagtcaaaatcgtttcggacagtttattaagtgaccttctccctgattcatactttgtgaattcctatcatcatcaggcagtcaaagatctttctcctttgttaaaagccatcgccttttccaacgatggactcattgaagcagtccaaagtaaagataatatgcacaaaatccttggtgtccaatggcatccggaactttctcatcgtgtagattcatctgaacagcgtttattcgatttctttgtgaatgaattttaatcgtttttctgattaggtcgtgagcctgccgttcaactctgagtcacaaggagcaatttcaaaaaacagcttctcatgtttgttggatattgtgacttgtgaccgaggagttggcaggagaacaccgtttaaggaagaggtcgtgaaatcagcgccctgacctgagtattagagaaataaacagaaaaatagcttctaatattttaccgttttttgagctaattccgaaggagactgcgacacgccttttgttgcagtcgctttttagtctattgagcaatgttggctagcatttttctcaatcgtcctttcgataatccaacagcctttggagttgagtaatctgttgctgtaattccattccttttgtcgtattccgattaagtttgcgtgggagctgctgctcgatcactttttttacattcgtttgatcagatttttttgcaaattgttgttcaataggcaagaacggataatgtgtcacgatttggaaaccgtaagaattgcatagtaatgagtagccagcaatcccggttgttttttgataagctttggatagacctccgtcaataacaaatgcttttccgtttgctttgatcggtgactctcctttttttacttttactggcgtgtgtccattgatgattgctgaaccttcttcttttgcatcgaattctgccaaaattttttcactgaaccactcttcatctcgcaagtgataatagggattgcttttttcgacgtgcgtatgaggctctgtgagaaaatagcgctcaaaagttgccattttactcttgccgaataaaggcgaaaatggcccgctccacgcataccaaatcaaatcggtcgccaaatcttcatttgcagtcaaatcttttgcgctttcagttatctgtttttcaaaaaatcccagcagttcttttccgcgataagattggtctaattcaaatgctaagagctgccccttttcatctacaggtatacagccatggaacagtacatgctgattgttcgtgagatacattccccctttttcgatcaaaaacgtcatgtgtttttgcattcttaacgagtgctggaatgaatacatcaaactatcgatcactttttgttcctcttccaagaattttttaggatcatctggctggatcgtttgaaaacaagtccctttcaactcatagagctgaccttctaaaacgatcgttgattcctcatagttgattttttccaacaatttacgatcgtccattttaaattcaggtcgtcgattcaacaactgatgttctgatttgaattggaggatagaaagtgcttgatggatcttttctaattcttcttgctctctttcagatagatctttcctgtttttaggggtaaatactggattcttctgataggtttgatgggcaaaagaaaataatggacgtaaatttaatccatattctttctctaattcaaataaatagttgtagcgtgcggcaatccgtaaaagcgtcaataaacatgcctcagagccgcaatacgcaccaatccacaaaatatcatgattcccccactggatatctacagaggaaaaatccatgattcgatccattactttggctgcttgagttcctcgatcaaaaatatcacccacgatatgcaaatgatcgatgacagatttttggatcgtctgcgcaagttttgttaaaaatttttcttcttccttcatcaagacaagttgttcaatgattttttttacatagtcttttttcccgttgatacgatcatcgatatacaagagttcctcaatgatatagctatattctttcggcaatccttttcgaacttttgatcgagtgtatttgactgtcgtaaaccgtaaaagatcgatcaaacgatggatcagctgggatttatcttgttttttgtaccaatcagtcgtcaacacatattctggataagccgtaaaaatagtgaattggctgatctccgtttccgtcatttgttcagagaaaaggtctttgatcttttctttaagatttcctgaaccgatacgcagaatatgatcaaaagcaggaaattcgccatgtatatcgctcaaaaataactctgttccttttggaagctgcaaaattgcttcgagattgatgatttccgtgatgacatcttccgttgtagggaacttctctgaaagtaaatctaaatagcggtccattaaaacgcctccaaaaattggtatactcaacattataaagttgttatgctctattttcaatgaatatatatatccaatataataaaaaaatagaaataggtctatacaaaaaagaagctgggaacaataaatgtccagcttccttctatatttttctatattttatgctttttttcgttcatttctcataattgaaatcgattgtttcaatgaactccataatccgccttcgctatacacgagtacattcgatttgtacatgtttgcagacaagatcatcaataagaatgttacggctacaagtaccaacaaggaaatcaatgctccacccataccgactgtctcatttgctaagcgaaccggcataatatatgaagataagaatggaatatacgaagtgatccgaataacgatattgtttggatctgaagctcctagtatcaatccaagcatatatccgcctagagatagataagtcactggcaaaattgcttttgctgtatcttctgctttgttgaccaaagagccacataaagctgctaaaacagaaaaaatcaaaatgccaaagatcatgaatagaagagaataccacaagaatggtccaatcaagttatccaatgagataccgtctaatatatttttgaccatttccatatctttgaattgactgtatcctataccaaaaataataccgtataatgccatttgcgttaatgcaacaagtaaaacacctgttagttttccgtaaaaatgcttttgtgcagtcgtactggacaggatcacttccatgatccgcgtgcctttttcagaagcgatctcttgtgcaatgatctgcgcatacgtcaaaataataatgaacaagacaatcgttgctacataacttacgacatattggactgtcgagttatcttctccaactgtcatttttccttttgaatcaaaattgactttttgtcgagtcaaacttgcttgttggctcaagctagctacttcttctggtgaaatgcctaattgacttgctcgaagcatcgattgcaagccagtcagttgttgttgtatcagtagttgtgtactttgtcctaatgaattttcgctataaagcatcccatttatcttatcattctcagttgagactactaaatacgcatcgattttttcttccgaaagctctttttgtgctttttcttcagaatcaactgctttgaactcaaaatcatctgttttgacttggctcatttgctgactgatttgctcattatcagccaatacgccgattttattgacatcactattttgttgagcaaagtttcctgctacataaatgatacccagcatgataaaagggactaatatcatgatcaagaaagaaatcgacttaacattttttaaatagacatctttggtaataatccaaaacttacgcatcgatttcacctgctttcaatttgaaaatctcttccaaagttggcggttgctggttaaacataggaatgtagccgaactgagtcgcacgagtaaagatttctttcccagcttcaggatcttctaaggtaatctctaacgtattgtcttcatgaaggatcacttttttcacgccttcgatttcttctacttcctgttggcttaaaccagattccaagaataacttcgtacggccaaatgattcacgaatctcatgtacttttccattcaaaaccatttttccgtttcgcaacatgatcaaatgatcgcagattttttctacattatccatattgtggctagaaaaaatgacacatgaaccatgttttttcaattccaatattccatcttttagcaattcagcatttaccggatctaacccgctgaatggctcatccaaaatgatcaatttaggttcatggattaacgtggcgatcagctggactttttgctgatttcctttagacaaagattttactttatccgtctttttcccttttacctgaaatttttccatccaaaaatcgatttttggttcaatctcttttcttgatttccctctaagttctgcaaaataaagcagttggtcttgaatcgttactttcggataaagtccccgttcctccggaagataaccgatgacatcataatctttctccccaagatgatggccattccataacacttctccttggtcttgtgtcaaaaaatccaagatcaaacgaaaagtcgttgtcttcccagccccgttttggccaattagccccatgatttttccatcggggatttggaaagagacatgatcgacagctgtgtagttcccaaaagttttaacaagatccttgacttctaacatttcttcactccttcttcaagaaatcacatatatccttagacaccagacgtaagcgatttattatttaccaacaaaacgtaaacgctctttttgttgtacataaaatgataggacactttactttctttgtaaagtgccctttcctcattcctgatgtaatttatcaaatacgttttgtgcgacatttttcggcagtccgatttcttgtaattcttctgtcgtggctgctgtgatatttttcaacgatttgaactctttaagcagcattttttttcgttttggtcctaacccttcaatttcatctaatcgggaagcaaaactgtttttactgcgtagctgccgatggaaagtgattgcgaatcgatggacttcatcttggattcgctggagtaagaaaaactctggtgaatttcgctcaagcggtactacagccaaatctataccgaatagcaactcatttgttttatgtttatcgttttttgccatgccagcaataggaatatcgattcctaattgattttctaagacatcttttgccacatctacttgtccttttcctccatcgatcaagatcaaatcaggtaaaggcaacccttcgcgaatcactcgtgaatatctgcgatagatgacttctctcattgatgcataatcatccggtccgttgactgtttttattttatatttccgatattcttttcttgccggttttccatcaatgaatacgaccatcgcagccacaggattcgtccccatgatattagagttatcaaaagactcgatacgtattggggtcgggatattcatcgcgtttcctaaacgttcaactgctccgatcgtccgttcctgttttctggcaatcagatcaaaccgttcattcaaagcaactgaggcattcttattcgccaattcaactaattttttcttttctcctcgttttggttgcagcactttcgtagctaacaaagcttctacactgggcttgtcgatcgtatcaggaatcaagacttctttaggaatgaaatgctcattttcctgataaaactgaccgaggtaagtcaagaaatcttcttctgcttcgttatagaaaggaaacattgaaacatctcgttcaattagctttccttgtcttacgaaaaacacttggacacacatccatcctttgtcaatcgcataaccaaatacatctcgatccagtaaatcagtatttgtcattttttggcgagtcatgattgtctcaatggcacggatctggtctcggtattctgcagctttttcaaactccatgttttcagcagctttttccattttctgatggatctctgactcgattttttcgtgtcctccgtttaaaaactttttcacttcatcaacgattttcgtatagactttcggatctacgtcgaaataataaggacacagacattgtcccaaatgatagtaaagacaaggctccttcgtctgactaggtttgcattttctcagaggaaataatcgatcgaggatcttctttgtctcattcgccgcaccgacatcgggatatggtccaaaatacagtgctttgtcttttagtactttacgagtaatcaccaaacggggatatttttcattcgttatcttaaggaaaggataggttttatcatcctttaacataatgttgtatttaggatcatttttctttatcagattgatctctaagagcaatgcttcgatattcgattctgtaacgatgtattcaaagtcttcgatttcactaacaagccgttccgttttcgtattatggctgccagtaaaatatgagcggacacgattttttaatattttggctttgccgacataaatgatcgttccatttttatctttcatcaagtaacagccgggctgatcaggaagtaaagctaatttgtttttgattcgttcgttcatctggtactccccttcatattcaattaaagttattatagcatgtctgtcaaaaaaacaatccagcctgacaacgtaattatactcaaaaaatattaatttgaataaccttaactcaaccgcaaaaaaaccgaggacggaactggattcagtcccaccctcagcttatttttgctgtaagtttttataaatattgatcgatcatttgacgtagttgttcttttgaatgaacaccaacagctttttctactacttgaccatcttttttcaacattaatgttggaatgctcatgataccgaattgttgaggagtttctggattttcatccacatccattttagcaattctgaattcttcttcatcatattcttgttccaactgatccaaaatcggtgcttgcatacgacatggaccacaccaagttgcccaaaaatcaatcaatacaagtcctttatctgtttcttcattaaatgtcttatctgtaattacttgtgacatatcaaagacctccatttttaaaatctatgattagtatagcatttctatacttggatagcgaaccatctgcttacctttagtaagctttacttaaatttaacaattgtcgcaccatttccgccttggtttgccggtgcaaactcaaagcttttgacgctccgatggtttttaagataatcagtaattcccttgcgaagtgcgcctgttccttttccgtggacaatagtcacttgaggataaccagctagaatggcagaatccaaatattgatctacctcacttagcgcttcttcgtatcgttttcctcgaaggtccaattgattcggcacgtgactactagattcagatcgtacagcatggataactcgttgtgtcggctctttttgaggagcaacaggcgtcagctcgtcttcggacacattcatttttaatataccgatttctacttgccactgattcccgtttttacgtaaaagcgtccctctttggccgtaagtcgtaaccaacacttcgtctcccggtttcaacgttttttgttctttcgccttcttcaatactttatttttcttcaaagtttcttcttgatgtagatttgctaattgggtctttgcatcgatcaactgatgctctttcacatttccttgcccaatctgctgttgcattttacgaatatcagcaatgattttttctgctttttcttccgcctctgacacgacttcgtttgcttttttctttgctttttccatttctttttcacgttcttcaaagaaatagctgtaagcttctttcaaatcatcgtgaagttcttgtgcctcagaaacaaaatgacgcatttccagatattcggtctctgccattttccggcgattctctaaatctgtgatcatttcgtttaaatcttggctctcatcattcatcaactgcttcgcttcatcaataacttctgtatcaagacctaatcggctagagatttcaaacgcattgcttcgtccaggaacgccaatcagcaaacgatacgttggacttagtgtatccacatcgaactccatgctggcattaatcgtatttgcccgattgtatccataaactttcaattcaggataatgcgttgttgccatcacataagcagactttttaccaagatcatctaagattgcgattgctagagcagcaccttcttgcggatctgttcctgcaccgagctcgtcaaataataccagacttttttcattgacttttgataaaatatctacagtgttcgtcatatgagaagaaaaggtcgatagactttgctcaatcgactgttcgtctcctatatccgcaaatacttcctcaaaaataccgatttgactttcttcacctgcaggaatcggtaatcctgcttgccccatcagttgtaacagacctaaagtcttcaacgtgatcgttttcccacctgtgttaggtcctgtaatgacgatggcttgatagtcttttccgattgtgatgtcattagaaactactttttcctgatcgatcagtggatgtcttgcttgtttcaagacgacatgattgtcttcactgattcccggcacgatggcttttacttctttaccaaatcgtgcttttgcattcatcagatccattttaccaatcacataagcattgtggatgatttcttgacgatggggaacaagttcagcagaaagttcacttaaaatacgttgaatctcatttcgttcagcgatttggtattgacgcaaacgattattcaaatccaccacttgttttggttcaataaataaagtctgtcctgaagcactttgatcgtggactacaccgccaaatacaccgcggtattcttgtttgactgggataacgtagcggtcatttcgcatggtgatgatcgcatcacttaaatactttgcatttttcccacggacgatcccatctaactgttcacgaacagcttgttcacttcgccgaatgttctgtcttatgctctttaactcaggagaagcgtcatcagtcacgcgtccgtcttcatcgattgcttcctttaaacggcggctcaaaacagggatcgtgactaactgatctgcccacatatacaaacgtgcaaattcgatttcactgtcagaaagatcatcaatgaaacgattcaattcgcttgtcgtagacaatactctggaaacttgtgcaagctccactccattcaagtctgctccgatctcgatccgtttcatatggggacggatattttcaagtttaggtatagggatcccgcctcgcagacgttgcactttcaatccatcctcagtttcttgaagccagtttgtgatcgtttgtttctcactcactggtaccaattctgccagttcttcttttccttgtgcagtcactacaaattgtctgaccatctgtttgactttttcaaattccaatgtttcaaggattcggttattcattttatcaccttatctttcactatgaaaaaagagctgtgccggacatacgctacgcagccttcttaaataaactactctgtacaaaaaacgaaatattttccagcactattttccttaattcaaaatattcgttacccaaagctcatacatcttgttggtaagaaatggcgttctctcaacgataaaacgagcgaaactatgctcgccgaattgattttggaccacatctaatggaacaaaggcaagtaactgcaaaatcaaaaatatagtaacgtaagccatgattagtgacaggatgcctcctgcaatccagtctacctgtctcaagatcggcacatacgtcaatccatggacaaaaacccccacaaatcgggtaagcagccagccaattagcaaaataatcagaaaagcagttcctgcataaaaagcttcatctaggtgaaaagcaaatacctgatcaaaaaatgctaactttgatgttggggtgacagctgggtatggaatgtataattccaaatgacttgctaatggtttgtaaaaatgctgggcagcaataaatgacaatacatatccaatcgcgaatatgatttgcaaagcaaacccgcgacgtgctccagaaaaaaacgcaattagcaataaaaataaaatcagcaaactcagcatgctacgttcctttctcttctaacttttttaaatttttcttattttgataaaaggatcttaattagaagatttttgtttaatttgtccttttcgtttctcgtttaaaatctgttgtgcttccacatgatttttaatggtatgatctgcttgaccattttctttcaatacttcccgagcttcgttctcgattgcttcaatgcgtttcacacgattttcaagctctgtaaatttgatcatttttttctttaattctgctgtttcttcttccagctccaagattctttcttgtttcttcaattgatccgaaagcgcattgacagccatcaagattgctgcttgttcattatccatttgtggtgataattgtttcaattctgctaactgttcattgatcagcttcgttacgatatccatatgatgcttggtttcccgtccgataatagtatatgtttggttggcaatcactgctttgtagcgtgttttttcgtgcgccatacgaatcatttcctcctatttgatgaaagttttatttagtgtaccatgaagttggttctttcaccgttctccacaaatatttttcacatacttaactattatatgataaactttaaaaaaatgctatgtctcgcaatctcttagaaaacgaaaagtcgtgagttgcggtatagttttatgtataaaaacgaggagaattttatgagcaacgtcattatcaaagcaacaaacgaccaacttagtcaaatgaaagcatactatcgctcttatttgttaaataaacagattccttatactagctttgctgcaaaaaaagacgggacgaccattaccgcttatacatccggaaaagtgatgtttcaaggtacgaatgcagcaatagaagctgataaatggggggaggcacaggataaacaagccaagccagcaaaaacagcctcttctttgccaaaaaatatcagtcaattatccgttttaggtagtgatgaggtcggaaatggcagctattttggtccgctaacagtatgtgctgcttatgtgaaacgtgatcagcttgcagaattacgtaaacttggtgttagagattcaaaagagttaaaagatagccaaatcatccagcttgctgacatcttaaaaaaaaccatcccctataaactgcttgtcttatctccagaaaaatacaatgagatccaaccaaaatacaatgccgttcggatgaaagtcgctttgcacaatcaagcgatccatttgctgctaaaaaaaatcgagccagaaaaaccagaagcgattttgatcgatcagtttacgccggaagcaaattttaaaaaatatgcgcgtttagaaaaaaatcaattacaagaaaaactgtacttcgttactaaaggagaacaatatcatttagctgttgctgctgcttctatcatcagtcgtgccagctttttggaagagttacacaaagcatcagctgaagctggaatcacccttccatcaggagctggaacgaaatctgaccaagtagcggcaaaactattggagaaaggcggcatgcctatgcttgaaaaatatgccaaacttcattttgccaatacagaaaaagctttgaagctgctaaaaaaataatggaactgtgacaaaagtcatgtcacagtcccttgttccgaataaacggtgttctcatgccaactcctcggtcacaagtcacaatagtcatcaaacatgagaagctgttttttgaaattgctccttgtgacgcggagttaaacggcaggctcacaacctcttccttaaacggtgttcaaaagcttgcatctgcgataataagcccggccaaacgaaaaatatgaggagctatttttgtttggctgggcttatttattactgaaaataagtggtcaatgcttgtgtcaaacttgcagcaatctgctgctgataactgtctgttactaattcctttaaatcactatcattattcatataacccatctcgattaaaatagaaggttgaagattttctcgaagaacttgatagttcccagtggagattcctcttgaatccagaggcagatcagtgaaggagtcagcaattgtctgtgctaatgtttcctcttgtccatagtaataatatgtcgtgattccagttgcttcattcgcatattccgtagagtctgcgtgtaaactgataaagacatctgcctttttttcttcactgtagtcgcatatatctccaagctgtactaattcatctgtagtatgggtcaaataaaccgttgctccagcatcctctagcgccttttttacttttatggctgtacttaatgttatatctttttcttctgtttgttcatcattgcttaatgccccagtatcatttccgccatgcccaggatctaatacaatcactgcatcagatagctcttccggttttgtttgtatattctttgtgactttggttccatcttcgagggctaaatatccagtatagccatcatttgtcttgatctgataagcattttttgtttcagaaagaaactccgccagctctccgccgtttatagttgcaagtggggtagttagcgagtcatctgtatatagtgtacggtcattttttccgattttgattaatgtctcttgttctgtatcatcaaatgattcctttgtctttgtaaccgtactgttcgtactgctgaccgtttgtccaactatctttttttgaccaaaaacatctatttgaaaacagataataatgataatgattgcaaatacaaaagctccaattatttttttcattcttgactctcacctcgtagatccagactaagggtcaaaacttaaaatcagcttaagtacgcaaaaaaggggctgtaaaagatataaccgtagaaaataacattactgctaaaatgatttttttcatttttggcatatcctgaaatctccttttgactattcgtggtgattcatctacccaataaatagtttccttcattctacaaacaattaatttcttcgttattaaattaaaacacttcctggaacaccgacataataaataaaaatataccctgataatcatgagagaataacaaatttgtatttatgaaaaactacctatataaaaaaaacaagatataacgatcttcgtcatatcttgcttcttcacctaactatttttctccctatataacagctttacgcttctcctaatacaccattcaaatataaatcgatcaattgcgccacatttagcggttcttccacaggtcttttcgaccgagtgatgtaaggtgctaacactaagaaaaaatgccttgctgcgatttcttttgaaatcccatttcttagcacagattggtttgctgaaaagatttcttcaaaaggttcacgataatttttcttccatagaaagaaaagatgatctcttgtttcctttgaaagattgctttcaagatcgtgaagcatcagaaacaaatcgaccagatgtgtctcaatcaaaaactgcgccatttttgtcaaggttacttgaaatcccgtttcgcttgtttgaacgatttctctcaaagcttttccaacatcttttaagtggttttctaaaactgccgtatatagtttttctttatcaccgaaataatgatagagattgggttgggtgatcccaactttttgtgcgatctctcttgttgaagtgccgagatatcccttggacataaacaagtcagtcgcttctttcaaaattttttgctgtgtatctttgttgtatcgatggaccatttttccacctgctttttggttattctttttctttcaatacaccatcttccatcataaatattctatcgcatttgtcaatcagccgtgtatcgtgagtaaccatgatcgttgctttatttttgtcttttgattcttttgccaagatatcgactacttctcgtgccttttctgaatccaaactagcagttggttcatctgctagaataatggacggatcattgtacaatgcacgagcgattgcgaccctttgccgttctccaccagatagttcttctggatacttgttgatcaacttatccacgccaagctgctcaaataattcttttgcttctttttgacgatgttcatgtttgatcttatctactaataataactgcttttttactgtcagaaaaggaaccagattggaagcttgcaaaataaagccaatttctttaaaacgtagtttaacgcgttcactttctttttgattactgaattcttgatcattgataaatacagagccactgctaggcgtctgcaatccgcctgccaaagtcaaaaaagtacttttacctgaaccagaaggaccgatgattgcaacaaattcccctttatcgatactcatggttgtttctttcaatgctttaactacttggtcgccatcttggaaacttttttctacttctttaaattctattgctttcatgctcttcctccttcttatccaattgccttcaacggatcgatttttacgattgtccgaacagaaaatagtgcgcctaacacagctactaccagcatcaacaagctaatgacgccaaaaaacagccaattgctttggaatggaaccgcatcaggtagaacaagggatgttcccactgttcctaatagaccaagaagaataccaacaaatgataaaatgaatgtttgtgccactacagaacgcgcaataaatcctcctgtgatcccttgtgctttcattacaccaaagatattaatcttttgcatcgtcagtacataaatgaaaatcccgatcacaatagccgcaataacgatcaaaaatccgatcataaatccaaaagtcaatacttgcgcattatatccaggtaattcattgatgaatttagaaattttgatctgttctaaatcttcaggtaaattactgattttacctctgacaactattgcgttaatccgtgcattttcacttgtatcttctttttcgaagcggatctcttggtaagcattgatggttgtatagagaactggtgagacattgaatttggcatgatccgtaaagccagttagtttaaacgtcttgtcactaccagataacttaactgtatctcctacggctagaccatattcttctttcaaactaatatcgcctactgcctcatcatcgttatcaaaagcttttccttcaacaagattgggcatgatgaattgatttttatcgataccgaagaagctaacattgatttttccttcttctgtactgtctttactagtcacgactccaggtgtctgggcaagatacgccactttcccaccttcgacttcttctgctatcttcttagtaatcatggacatccctagatttgaatttgcatctttcgaaagcacaatcgaatctgcctcccacttgtcgactgctgttcgattatcttgagctaagccataagctaacccagtcaaaaaaaataccaggtaggcgatcaaaaacatcacccctgcaactaacgcataacgtaactttgaatgcataatttcatttaatgctaaaaacatttaactcctcctcctgaaataatcattttatacaacaattttatcacttgataaatttttggcgaatattatgctcaaaaaattcttccgctatttcattatatgaattttttattctcgattgattaatatttattatatccccacacaataaaagaccgtgatatttctcacagtcttttatctactctattgctatttgctctcttagctagtactttaaaagctaactcattgaggtagtgaaaacgagaggtgtgttcagacagaaatccaaaatcctcaactgctagctgtggaatcgtagttttgtgtttcacgatatccgcaagcaggttcaaatctgataataagaattcttggcttatcagctgtccgccaattatttctaatgtatccggatggtagatcagctttgcatttactgttttgttttcttcatcgtattgtggaaatagatcaaattctcctgaacacgaaccggtattttgttccaagaatggcgcttcatcttctgtcagccctacagttcctaaaaagtagtctataatgactgctgctgttatcttttgtctgaggtcgtaagcggttggctgaccactcaaagttagcgctactgctcttgccatatgtacagctcgagtaactaaaggtaaaaagagatgccgtttatttttgtcaaaactgactgggacgatatctccaatcgcatagatgtccggatcacttgtctgcagatattcattgactatcacagtctcatcctcatacaaagccactttttcttttaacaatgtcgtattaggacgagtttgggcagaaaaaatgaccatatctgcctttattgcttgagatagaagttgtacggatactactttctcttctgattttttccaatcgatcaagaattcatttggataaaaattgatttgcttagtttgcagctgattttgaaaactgttgatcatatccttatcgaaatatcttgataaaacattcggcatataatcaactagatgaataatgtatcctttatttctcaaagcatctgctaattccaatccaatataaccagcaccgaagatcactacttcttttgcttcttttaaagcggcaagtacttgcttagattgcactagatttttataggtgtagacattttcagcttcaatttgtttatacaaggtgacaggagaggaacctgttgctacgattaatttatcataggttatggtctcgttttttccttctttggatgcgaggatgagctgatgtttgtctggatcaagttcagttactctccattcggtgatcagttttgccccactttcttgaagagtccgcatgttatgggcaacttcagctaaactacgtatctttccttttaaataaaggttgattccatttgaaacatagcctagtccatctttatgatcttcatcgatcagtaaaacttctgctttcggttgaagttttcttagatttagggcagctgtgatgcctgcatgggaagcaccaatgatcacgattttcatgttttattcatccttaaattcaatttttctaaataacattcttttaaaaattggttcaaataggggaaatcataattatattcgttgctagtgaatacaaaaactttagcggacttctgtgacgggtactctttcaattggctagtcaaaatgatatcatactgcttttctttctcgtattcgactaaatcatatttgatcgtattcagcaattgttcctggatgatttctttcacgatatccgccattagcctttcataaggaagatcataagcaatttgcagacgtaattctaactgcttgatcagcgtccgcaaaatagatgcatagcgagcaaataattcaaagcgggcattttcctcgtctacttcagtaaaatcaacaatagcaaatgtttgtctgaccaatctttcacataaaaccaggaattgtttatcttctacttcagttaaccgctgttttaatccttcttggccaaaaatattcatccatcctctaaaataggcaaaatgagcgtgattttgcatcactgtcaacgcaatcttttgcgaaatctcttctggaaaaacataaaaagagaaatattcttctatcgattgtttaaacgttcgattcaattgagctactacgtcgtctttgtatttttcgcttatcaaaaactcctggacatgcgagttatgtgtatctaatgtaaagttactgatcatgaaaagataaaaaaccaacgtttcattttgattccaaggaaaggcatattgaaagaagtaacgggtcaaaaatgtatggaggtccaataaaaattgtgtcgtttgaaacaatccaacaggaagattgctataatctggtttggattttttcgtacagcgcattcgcttcttcataatggaaagccatatttcaaatttcaatcgtccttcttctgtaatagtaaaactaaactctttttgcagcagatctaaaaaagtgtttcctgataaatcactgtattcttttttgttttcaagataaggacgtccaaaccaaaataattggaaataaaaataacaaatttgactttctggaccggtcagccgcccgctttttattttcagatgaaactcatttaaagaatcatttaattccttcactctgcgagacaaagtagccgaactgatattaagttccatgacaagtttctgccgatcaaatgagccattttccaacagataaagaagtatctgatattttgtagaatagcgcaagtagcaatgataataaacatcgactgctgctatatttccatgtctgattaataaaatattcccttcttggataacaatttccaattgtttgatattttccaagttagcttgtaaataaaacagatcttctttcaaggtagcccgatcaactgataagcgggtaagtacgttattaacggaaatctctcctttttcctctaataaaagttggaaaagtttgatttgccgttgttcatttttttcaagcaaactgaaaagttccaagtccactcctccaagcatttctgattttaacagcagaagtttccttctcatccttgaaaaagaggatctgtgacagttatcacagatccatacaaattctaatcacttagctggttggcccagctgtcagttcccatgtgaccatgccttgatacgttgcgccaggttgagcattcgtactgctatttacctctaagagtaaaccatcggtatcgggaaagtcaacgagaacctctcctttagctgttccatcactctcataaatcaacgtgttttgaccttgctgaatcaattgttttgatccagaatgattgaagtataattttgttccgcttaattcttgaccttgatcattcttaaataaagaagtcaatgtccctgtcagttgccaaggagacgtgcttggaagccgagtatcccgcacatcaaaagaaaaatcgccttttgcttcataataacttgtcttcaacggtttggggagatcgttaccaaatgtaaaatcatctggtacattaactaatgttaattcttgtttggggacaagaattgttttagcagatgtttggacaactgggttaggaagcttagcaccatctgctaatgtaatattgctggaaagtacagctgcctttgtcagtatgctgacggattgtacagaagtatctacagtatttaattgatagttgtaagtaagatgaatggtatctcctattttgctcaatagatctgctgggacagaaactccttgttgaatgccggtatctgcgatagttgtaccatttaattttaaggaaccattgatataagtagtattttcaggaagtgagatcgtgatttttttgtcggttatcgcatccccagattttgttaacgtgaatgtcacattttcttgaatcgtatctcctgatagagcagacaggggatctcctgtctcaggttgtctgctaaggttttttagctgactatctgcactcacagatggaaaattagccactgttatttgaggaagagtggtgattccagcttgttcagactgccatttgtacgcaaaagacggatacatgttagtaagtacatcgtccaccaagcgataatcaaaataatattgccctgaagccaatgcaggtagtgtagaagtagctgtatttacacccccgttatttgattggatcgtttggaaaagttgatctgtccatcctgtcgctaatttttgggttcctttcgaataaagcctgtaatggatcgaacccttttttagttcagttgctgaccaattggccgtgacttggtacgatgcagaagaaaggagctttccccactgactatcggctgttaagtttgttggtaaaaccgttccgtctagcttgtactgctccaatacctttaaagcaacaggagaaagcaatccgccttgcgcatctttcccactgtacacgatattggctgtctgattcaatccacttgtgcttgctggagtatgagtcagtattgctccttgtgtaacgttttttcctgtaaaatagttgactacgcgatcaaagcgactaaatggcaactgatcaaaacgtccttcagtcagccccatcgtcaatgtccgactattggtagagcctggaaggttctggttatttccatccacgtattctgtggtatcagcaaatgtattatattttcctgttgaatcacttgttgagatgtaactattccacgtatttatctctgcacttgcagaaaatgcatatgctcctggattcaagtttccgccagttaatttaggataaaatctacctgcagctggagctaaaatcgaattgaacatacgatcttggataatattattcgaatcataaaaatcaacagaaaaaacggcctttttagacatagaaggttgtaatttacccttggtcaaaattttgtttggactcgtatcatatttatctccgttttctgtcatcttcgcgacattagctgtaacatcaaattgaagcgggatatcgtccacgttgaattcgcctcgcgtaataatagcaataatatctgccaatagagtatttgtatcccacgaccccatcccaaaacgcaaggtatggcttcctgctgataataaactaccgctagtaaccttgatgggggcaccggcaatatacaagtaggcgttgttccagtcaattgcttttaatacatcactgcttgatacatgttccggcaaattgatgatcgccacaaatgcaaatccttgtgcagtgatattcaccaaatcaagtacatttgttagtttcacatggctttcccaatgaaaacggaccgtgccacctttccaaggatcatttgaaccatcgttcaaataagtagcagtcaatttaggcaattggttagccccagttagttggacaagcttcccgccattgactgcactacgtccaccatttggaggtacgatattttcatacgtgtatggatcataagaaatggcaggaggcgttgctccaacagcttctgccgaaggtgaaaagataaatatacttaaaacaaaaagcgaagtaaaaaagaaggagcgaaaaaatgaaaatttattttgtagcaacatgttcatcctccttttcctttcttctccataacaacaaccacgcaagaagccataattctataccaatgatcaaataaagaaaacggatcttttcttcattcgtctccgggaatacgccatgttgattagattctttataaatcggtagctgtgtctgctgttttgatgcgccattgactgaaccacttggatgcggaactggacttagatcataaaatgtaatcgtacctgaacttttggtatctgcttggactggctcttgccagctgaagaacagcaaacttgcaataatccctcccaataagatcgatgttttcaacgaaatcacctcatcatgttgtttctccttttttctttttcttgtggacccacaaaaacagcaaaatcaaccataacactagaactgcagcaaccaatcctgcataaagccatgggaaagattgttcttgtactgcaaaaacggaattttcatttactttttgtgctttttcttttttgatcgtaaagttttgtgtaaatcgccattcattactgtcgcctgattttgctatgatttctgcgcggtaatcgccggcttttgctttatcaccagctaaatcaagattcaagtgaaaattcgaatttggtgcaactaaaaattcattagacgtattttcaatataaagctgattttcataaaagatcttgctcgtaaatatcaaattgctgataatcctaggctgaggattttggaaacgaagctgaacagttggctttgcgttgacctcgtccaaatctcctgataaaagtttcagatccggttctatcgtctcttgactttcttgtaaaacgactgcgagattataagcaatacgatttttgatttgtgctccttctgtagcattttctgtttcagcttcttctttaggtgaaacatgaatacccgctaatacacgtcccttaaagctttttgctgggattttcacttctataggtatagttgtttctgcatgtgctgatacattgatttcctttttcgcaatgagcaaaacgtcacggacatcaaacggcaatgtctcatctaacgttgggtttttttgactataatcgatcgttccaccatcactcgttaccgccggattgacagagacctcaaatgttcgttcttcatctgaagaattgctgataattacttctagtgtctgattttgttccggtgccactaataaatcaaaataaccgattgctttatctatttggttctctggaaataccggtttgattccaaagtctcctgctgaatcctttgcttggctgattgacggaaaaatgaaaaatagacttaaaatagaaaaaaacgaaacaaacagtcgtttactttgattcattgtccaccacatcctttcaacaacaactgcggtaaaaaatccttcacctatagtattttcaccgcagtttgttgaatttatttcatactctatgctactgggccagccacgaggttccaagtcaaatcagccgtgaatgttccagctgctgctttcggcactttcagtgtgatatttgctggatcataaacagaaagccatgttcccagaccttgatcttttgctgctgtaaatattggtgtcgctgcacttgctttactcaacccagttacagtttgactagttggtccagtggattcgttatctgacgtacttttaacagtggatgttccaaaatctaattcagcgccttgcaaaacttgtgaaccgtttacaaaatctgaaaccgaaactgtcacgttccacccttgtgcttggccatctgcacctacacctcgacgatctgatacttggagataaggtgtatcgttttttgaagcgtctacttgatacgtttttgttccgctttcaatctcgtgtgtaccaaatggcaattcaggaactacatccaatgttaaagaacctgtctggccagttgctggattttccggatctgctggctctactggttttgaaggatcagtagggttaagaggctcaacggtatttgttggttcagtaaaggtaatatctccttttgaagtcgcttgaccctcagcaaaagctggtgttgccaagccgcctagaagaagtgttgaaagtaataatgtcccaatcatgttctttttcataataaatcactcctttttcttagtgacctaagtatagtagagacagtatgcaaaaaatcctcatgaattcatccgcttacttgaaattatgaccctttttgtataaaagagaaaaaaacaataaaatcgtttacatgaatattcttccttttttattaagtatgaaaaaatatttcaattttattttttcgtttcaaattattctattagtgacatccttgaactataaaaataggagtacggcatcatctgccgcactcctatttttttcgtcatttatttcttaaataaaacgattctcacgcaattttatttttttgatatcttctactgtttgtgttccagctaattgcatgaccatttccaattctgttttaaagaaatcaaacacttgatggactcctgtacttcctcctaaagacaatccataaataacgggtctgccaatagcaacaagatcggcacctgatgcgattgctttgaaaacatgttgtccacgtcgtacaccgctgtcaaacacgattggtacacgtttatctactgcttctgccacatattgcaacgaatcaaacgcagcaggccccccatctaattgacggccaccatggttagatacccaaattccaccagcaccagattctaatgatcgatagacatcttcttctgattgaacacctttcacgtagactggcaaatcagaatgagcagcgataaattctacatcttttggactaagtttttgtttggaagatttatatacagcatccatcgtttggcctactcctgattgataagcctgaacgatcggcattggcagcgggaaggtaaacccgtttctgcggtctgtttcacggtttccgccaactgttgcatccgctgtcaatacgattgcttttgctccattacgcttggccacttcaagaatatccaaattgattccattatctttgctcatataaaattgaaaccattgcggtgctttctccccgcctgcttctcttatctcttctaaagtacaagaagcgtaagaacttgctgtatagatcgtcccaaaatctgctacaccttttgcagaagctttctccgccttcacatgagctaatccatgagcagcaactggtgccatgatgattggtgcagtcagcatttcttcgtcaaaatgtgtagttgtatcgggtaattctacatctcttaatacatgaggaataatcaaacgatgattgaatgcccgttcattttcttgataagtaaataagtcgccagcaccactgctgatgtaaccataaccaccagctggaatcacttgtgaagccgcgatttctaaatcttccatattgataaaatctactattccttcatttgtacctgcttgatatgttttttccatctcaatgccttctctctataaaatttgaatgatgaacaatatgatagcgtttacactttttatattactcttcgacattgatacaggcaaataatctgtttacatttcagccattccagatgtcactactctggaagaaatgattgtaataaaaatagataaaaaaccgatgggactttgacaaaagtagtgtcaaagtccctttttttgaataaacggtgttcaaaagccattttctcggtattaagtcaaatttatgcaaaaatgtggaaagccattttcacaaaatttttcttactactcgaaactaagcgactttttcacaacctctcgataaaacggtgttcaatcagctgaccctcggtattagctcaaaaaatggcaaaatatgaggaactattttgccatttgtctctctaatactcaggtcagaacgttgacttcacagtctcttccttaaacggtgttcaaaaacttgcatctgcggtaataagcccaaccaaacgaaaaataggaggagctatttttgtttggctgttcttattacttgatgcagggcaggtttttcacgacctctgattcacggtgtttctttttcatcaacatttttacgaaatactgtggaagactattgaaataagtgtggattgtttctttgtgtttcaatcgtttcttgccattcttcatttaattttggattaccgttttcttccttgaactcataaggtcctaattcaaaaatcccagacagtatttgattcacgatttcatatagttcagtgtgatcagacacatgattcttgaagatcatctcattatcaccacgtttgaacctcacattcgggctctcatgatgaacctctatgcatttttctcctttttttaactgacggacttctgaaaacatctcataaatatcttctccagtaaaaccttcagcaagcgccagactgtccacaagaccgcctactgtcagttcagagattattgcttgattggaatctaattttaatgtatagcttgtcgcttctactacgccacatgcattgcaaccgccttctgatagttcgctttttctaatcaattgaacttctttcattttctcttcctcctcttaattttctacttatgtatttttatcacctgacataggtgactcctatcaacgctatcatgtgcttttttcctcagaaatcctatttatccattccatctatcccttattcttctacttttctttctctagcatataagagatacgcatagtattcaagcaaggattgtcgatataaaaagaacaaatactgctattttgatttcttttggctatattacatataaataaaatttatcatacctgctctttttgactatatcatcatctgacttctatacttcgtttgtattaaaacttaggaggaatcattcatgcttacagggttaaacttattaaataatccttttctaaataaaggaacagcttttacaaaagaagaacgggcaaaatatggaatcactggtatgcttccaagtactgtccaaacactggaacaacaatctgttcaagcttatggtcaatacttaagcaaacaaacagatttggaaaaacgtatcttcttaatgaatctattcaatacgaatcggacattgttttataaattgatgggcgaacatttagttgaattcatgcctgtcgtttatgatcctgtcgttgcggattcaatcgaacaatacaacgaaattttcttgaaaccgcaagatgctgcatttctttcaatcgacgaaccagaaaacatcaaagcaagtttgaagaacgcggcagatggacgagacattcgtttgattgttgtgactgatgcagaaggaatcttaggtatgggcgactggggtgtgaacggtgttgacatcgctatcggcaaattgatggtctatactgctgctgctggtattaatccagcacaagttttgcctgtatcgatcgacgctggtactaataatgaagaattattgaataatcccttatacttaggcaatcgtcatgctcgtgtagaaggcgaaacttactatgaattcatcgatcaattcgttcaatcagctaccgaattattcccagaattgttattgcattgggaagattttggacgaggaaatgctgcagcgatcttagaaaaatacgaagatcaaatcactactttcaacgacgatatccaaggtacaggaattgttgtcctagcaggtgtattaggcggattgaatatatccggtgaacaattgaaagatcaaataattttgacatttggtgctggtactgctggtgtgggtatcgcaaacatccttttagatgagatgatccgtcaaggtgtacctgaagaagaagcacgccaacatttctatcaagtagataaacaaggtttattgtttgaagatacagaaggattgactcctggtcaaatcccattcgctcgcaaacgctcagatttcactaatgctgatgaattgacaaacttagaagcagttgtaaaagcgatccatccgacaatcatgattggtacttctacccaacctggagcattcactgaagaaatcgtgaaagaaatggctgctcatacaccacgtccgatcatcatgcctttgtctaatccaacaaaattggcagaagcaaaagcaaaagatttaatagaatggacggacggaaaagcattagttggaacaggtatccctgctgctgatgttgaatataatggtgtaacttaccaaatcggtcaagcaaataatgctttgatgtacccaggtttaggacttggtttgattgcttcaacagctacacgagtaaatgctgaaatcatttctcaagctagtcgagcattaggcggaatcgttgatgtaacaaaaccaggagcagctatcttgcctccagtagcaaaaatcactgaattttctcaaacgattgctgaaactgtcgcaaaatcagttgtcgcacaaaacttgaatcgtgaagaaatcacggatatcaaagaagcagttgaatctgctaaatgggttcctgaatataaatctttagaagattaagatcgttatagtaaaagaacatacagaaactttgtatgacgtctaaaaagaaaaaagcgactgcggcaaaacagcggccagccaactcctgctcttttgtcgcttttctttggcttttttcatatgatacagaataagaaaggatctgtaaaaatggcacaaaaaacaacaactgcaactgcagttgaggaaaagaaaaaagaaggtttttggtccacaaaaatcaccggcgtaagtttgccactttatttgatcatggtccttgtcctgatcattgcaatggctttagggaaattaccgacgaatatgattggaccaatcgcagttttggttattttcggtaatttatttcattttatcgggacaaaaatccctatcgtcaaaagttatttgggtggtggttccgtttttgcgatcttcgcttctgctgcgattgctacatttgggatcttacctgaatatgtagtgaaatccacagaaaactttgtcagcaatatgggctttttggacttttatattgctgccttgattactggtagcatccttggtatgaaccgtaatctattgatgaaagcttctgttcgttttattcccgttgcacttatttcaatggtcgtctccttttttgccgtaggactcgtgggcatgcttatcggaaatggttttgcaaattccgttttatacatctcattacctgcgatggctggtggtgttggagccggagccgttcctttatcaacgatttatgcaaatgttttaggtacggatgcttcttctatcatttcccgcctgattcctgctacagcaatgacaaatgtcttagctatcatcggtgcagcattagttgctcgtgctggacaatcaatgccaaaattcaacggcaatggtaaattaatggaaaaaggcgatcttggcgatggaaaacctcgaactgtgaaaccttccattccacagttaggtgttggtttgatggtatcattgactttcttcatcttaggacaaattggtaactattttgttcctaaagtccatgcatacgcatttatgattattatcgttgtcatctgtaaaatcgccaacctattaccagagtattatgaagatgcagctatcatgttcaataacttgattgtcaaaaacttgacagcagctgttcttgccggtatcggtattgcgttgctgaatctgaatgtattagcttctgctttgacatggcaatttgttgtcttatgtctgacaagtgttatcgcgatttcagttgtttcaggatttgtcggtcgtttgtttggtttatatccaattgaatcaactattactgctggcttatgcaacaactcgatgggcggaacaggaaatgtagccgtcttatctgcagctaatcggatggaacttattgcttttgctcaaatgggcaatcgacttggtggtgccatcgttttgatcatctctggtttcttgatgcaattactttcttagtcaaaaaaacaaaaatacctgatcatcaagtatcggcttggtgatcgggtatttttttgataaagatttacaggattttcaaaaatcttttttgcattttatcggaatgataaccgatgtgttcataaaattggtgtgcttctactctgtattctgcagaattaagccttattgtcgttattcctcgttttttcgcttcttcttctacgccagtcatcaaagcctttccgatgcctcttttttcagcatatttagacacagcaagtgccataatattgaacattggatcgctaaaaatcgattcataggactccgcttgtacatagccagctgcttttttagaagtaggatcttcataaaccaagaaaaaatttttctctggctccttcagcagtttcttcatttgtctcaccgtaacggttaatggtatatcataccctaattgatccgcattgatttcacgtagtgcttctgcatcttctaaacgcatttcccgtaacatccaaatcaccagccaatttctgattttttaaaatgaatttttttatcatagtatactctttttttcatttagaacaatatgtttcagtgattttgacttgcgttagtctagattctcctaatgtttgtaagatgacaaaggcattgtaacaattgaccaaaagaaccacgaggacaattacttgaaaaataaaggtcactttttttggagacaaaatcctgctaaattttgctccccacaaacctccaataacagcagcggggataatataaaacaacatagataaatcaaagcgcataaagccacttgttaaagcaatcgttactaatttagccagttgagaaaagaaaatcgtagatagagaatacagcgttgcttcttttattggcaaggcaaacatcagcatcagtaatgaaacattgatgggtccaccaccgatacctaaaaagctagctaaaaagcccaagatccccccacatataagataccaaatccatgacgttagatgaaattttggctgatgatgcttggtgtagaagaacgcaaaaaccaaggtcaataccgtcaagaaaatttggatcagctgcacatgcttttcattttcaaacaaccgtaaaaaaacttcgaatacaatgttaccggctattcctccaactacagctccaccagatacccaaccgacaatctgccaattcagcgatttcccacttgatacttgtcgcactgtcgaaacaatagacatcgtgaatactgcaaccgttgagtaaaaagaaatacctgcaatagaatgggcaccgataagatcaagaatcggtttgatcaacacgcctccgcccatgccggaaatagcgccaactgtatttgccagaacgatcaccacaaaataaatcagaccaatcatatcatcttgtatatcctttctcttatttatatcttttagcgatttttactctttgcttatattatacagtaaaagaaacaaacgaggcttcgaaagcttttctactttttaaggaaatgtagtactaaacgaaaagaggttgtgaaaaagctgtcctgcatcaagtaataagaacagccaaacaaaaatagctcctcataattttcgtttggttgaacttattaccgcagatgcaagcttttgaacaccgtttaagaaagaggtcgtgagcctgccgttcagctccgagtcacaaggaacaatttcaaaaaacagcttctcatgtttgttgaatattgtgacttgtgaccgaggagttggcaggagaacaccgtttaaggaagagactgtgaagtcaacgttttgacctgattattagagaaacaaatggcaaaatagttcttcatatttcgccgtttttcgagcgaatgccgaggggcagctgattgaacatcgtttatttggaaaaagggattgtgacaagacgtttgtcacaatccctttttttatatcttattaattcattcttttgttctattcttcttcttccgccatgaatgagaaacccatatcaaagaactataaaggttatcaaaacagcgtttatgactaaatgaattagagttatctatcactatttttcaagcgatttaaaccaaatggcatacaatatggcatacaaaaacttcaataagccgtgggggtttttaaatttcttcttgttctttaaaatcaatgagtggagctacataatttgaatccactttttcaaacgtcactttttgcatcgacgaatgttttctttcccaagataacgtaaatagatttgactctggacttataaagtctacttcaccttctagtattactttcttatgcaaatattcctctaataaatatagacttgctaaagcatacaacacattttccaaatttgcttccttataatttgaagaacgaccatgttttactctgttatatattttccaccaatctggtgtatcttcaggccacccatctccaaaaggttttagtgaagtcaatgttaaagaattcataaccctaacaccattatccaaacacattaattcgctagatttaataacagctttaaaatcagttatgcttttattgctactgctatcaaatccgcaaagttctttgaaaataatctcacactccgaaccaatcgctagtagtagtttttgatattcaatagagaatgttttgaaattattctcatcgagcatcacaaaatctgtggtattaataaactcattttctaaatgtagataatacttccaataaaaatttgtaaactctgctttgtccattaaatcacctcttttgaattataacaaaaaaaacacgtccacaacagacgtgttctttgatttctacacaatcagcttgccaaaaccatccaatcagtcctagcatgcctgtattaaaattgaacgttcatcatctatcatctttcttagtccagcatgtttgcaaccacacctacaattttcagtccaacaatagatttcgactagctaagtcttgcaaaattcaggcagctaacccttcatttactaccttaattatactaaatacccacaacgtttacaagtgtaatcattctaagaaatctgtttagctatgatcgttgtataatctttaaacgccgttccttcattgattgaaataattttataactcttgtttttccaagctactttcatatcgtttgttagttcataatcttgatcgtatcgaataataaacgtcaacgttccttcaagaatggtacctacactagcaagcacgtcttttagcatttgtgaacgcacattagcccaacattcaaatacagtttcttcactatccaccatctgcccatcttcatcttttacccgttttgtctttttaaacttgactctctcagtcaattcatttacattcttaatgattggcataataagcacctctcatttgttgtactaatgcttgtaccgttactggtatccgttcgctgctggcttcttgacggttcaaataccaatgttgagtaagtaatgacaccgccaaatcaaattgctgataattatccatatctttatccgttgcgctactatcaatagcactttttatatattcgcctgctgtatcaatcaattgttgaataaagtcatcatcaatagtgtgatcgatccgcatacttttttttatgctatccaaaattaccattttatctctcctaatgaaaaaaaggcagtgggataaaccgccgcccaatatttttctatacttttggtgttacaactggcgtaaactcaatatacactgaagcattttgatcaattttcttataatcgttgcgaacgatcactgcaagtccttgtgagtagtaatcgaatttttcccattgagtcgttacttgatttctacgagcaacaaagatagattgtgcaatatcccccataatcatagggaatgttccagctttaggattggcaaacaatgtatctgcaatcaatactactggcataccgaataatgatttaccactaggtgctgtcacatcgggttgtaaaatgtaacgtccatctgaatctttcaatgtatctaggtggtaatatccgctttggtttagaattaccattttatttaatgctgggtctaatgccacattgtatagttgtttcaaatcgtccaacgtagcagccgttttcttagtgaatgtttttaataaatccatgatatgcttattgtcagtgttttctaccaatttcgctaactgatctttgacctcttgtacaatattcactgctgaatcttccacaacctcatttgataaggcaatcttaccagcacgagtttctactttataatcaactgaagtaaacatttcagcgtcaatatcaccaatttcagcaagttcagcttttgttgctaacactgcttgttggttagttgctactggatatttaccttgtccatttgatactgtttttactgttgcatattgagctaagttataatttgaacgtttcaaatcaaagacttcaccgattacttcttcgggaacaactgccgctgcatttacagtagtgactccatcacgcacttcgccttgtgaacggatatattcttcatacccacgcaattctgttttttcgttatcgattaaagttttttccatgttattactctccttttgtgctttagaagtggattctaagctattgtttgtttgttttgcttggttgttactcataaacgattcgtaagaacgcttatttacttggacatttgatgaatcataagcgggaacggtcacgacactaatttcattaagtgctttgattttatctattgatcgttcaattgtgccatcttcttttttgtcgaatgaatctaatccaagcacgaacccaaaggacatagaatcaacaaccccttttgagatattctcatacacatcatttgaataggtcgtgtcggttagctctgcttcaaaatgtaatcctgtatcatcgacattcaatttcaacgtacctgctttgacactagctagtggctttgaataatcgtgtccatataataagaacacatttgataaatccacctcttttaatgcttcgggtgtaatcacttctacaaagccgcctaaatcttttgacggttgcccgaatttcaacgcatagcctgaaatagttttgccgtctgttggttgtttttcattttctttctctactttgggagaatcggctgttagctcagcttcttctgtcagccgtttttccttttcttcttcattattcaactggtgtaactccttcctgttcttttaattgatatttctccaacgtatctaaatacgtaaagttcaaacttgctagtaaacgatcgccaccatccatggggggtagccccattttcgaccgcccctcattaatcgtgagaagtgaccctttgacctgatccaatacattttttacttttgtttcaggatcagtctctagtaactgatcggaattaaagcggatattggtttcaagtttcgtatctaattcactcacaaacacattaaagtaatgaatcagcgtactttggatatactggagattactttgaacggtgctagaatgttcattttcaacgcctaaacgctcaatcggtacaccaaacgccttggcaatttgttttgtgttccaatcattggaattgataagcttcaaaacatcggtgtttatttctaatgttttgtagtccattgtttcatcaagaatgatcgttctaagagcattatctccactacttgaaccgttggcttcttcaaacttttcacgaattgcgttctttgctgatccgtctaaatctgacttatgaaccttcaaaatacctgacccactgacaccacgagtaaagaaattgtgcaatgtgcggttgccagcttgttgaattttcagttcatcacgtaacgcataaagtggtggtaatcctgttaaaccatcttgggtgaaatatttgaagtgcaaaatatcgctagacttcacacgtctttttttatcaccaatctgataagacaacgtaccattatctaattgagtaaccgttacacttgagttaggtaataagtgaatttcttctaccttttcaccgttgcgtttaatctctgcaaagctattaccgtttagcaacatattgaccgccaaagcaaactttaaatgccaaccatccatttctgaattaggtttctcgtttagtaacttcaccagttcattatcagcttgtggcatattgtttttgaccaattgaatcggacttgaagcaatatcactagcaataattcgaacggctgcaaacacatcactatttcttaatgcacgaacgcttgtaaagctggtggtgtaatcatccgattggattgataccacatgttgtaggaaaggatctcccgttgtattttgtctcgctttaaaaaatgccatcttttaacctcccttctgttctgtatttagcatgaccgctaccccaataagcactatgcccagcgctaacaagccatagtagacatttgttagtaaggtgatagcaaccaacacacacaccaatccaagaagtaaaagaacggtatgaatgtaattagaaagaaaattcttcacttgtataaaattcattgtctgctttcgctccttccgttgtggtgaagtaatccattgcaaacacataggcattgattaatgcagctattggatcaattttgttactgttctttgatttattaatctgaatgccgttgttatccgtttttaaaatagcgttgttcactgcatgggtgagaatcgtatttttattgtgaataacgttgccttcataaacttgttctctaaaagttcgggtcggaacgtttagagtaatcgttccttgtcttacttctaacattgggtagttggctttttcagctttactgataagcgaattagcgttatacgggtcataacaaatccccatacattccaaatcattttcttgaatcaaatcttgaataaactgaaatacttggtcatagtccacgattccactttctaattgagtaatggaacactcaccagctttttctagttctcgataaggcaaaccgtcgcgcttttctttgtcttgaagcccatatttggtggctacaaagctatgtgaatcacaataaagttcgccgttatctagcggtacgatccatgaaacgctagttaaatcatctgttttagataaatccactccgatataaacgggcttgcctgtaatatcttgtggttctacttcggttgcctgccagtcttcagcaatcatatagctgtcctcactcgcttgtctccataaattgaagtttttcaccaatacagaattaaggttattttgtttcaaagcaaggttcacatcatcttgaatggttggaatcattacttttttgatttcttcactttcaaaaatcggattggctttgatccatttctcttgatcgtgaatttcttcgggatcgtccaattcccatatcgctataaagtacctgtcggcttgttcttcgccttttagcacacgatctaacaataagtattcctcgtacataggaacgtttaaatcaagcccagcggtactaataacacacaataagccgttcttttgttgggtcattcctgacttaatgacgttgtacgttttacgagtttttgcttcgtgccactcgtcaagaattgcggttgttggtgcaaacccatctagcgtgctggtttcactagccagtgccatagcgaacgaattagagggcaagtgctgaatcttagagttcataattttcagttgtggtcttaaaaacttactagacttgaccacgtttctaagtgaattagacagcatatcatagcccaatttagcttgtttcaaagcgttacttacaaacaatacttgccttgcttctgctggttcttgttccataatcaacgcattggcagccatgccacttgcgatatacgttttcccattcttacggctcatactggtaaacgctcgattgaatcgcctgtaattcccttctttagtacgccagccataaagactgcctagaatgaatttttgaaatcctaacatcttgattgctttaccgtccgtagatggtagcaactcaatgaatttaatcgctttggtggcttgttcttcatcgaacacataagggaagctatctgacttagaacgctccaaatcgcttatatgacgctcacacgcttggataattttcttgggtgcaatcagcttacctgataggactttctcaatgtaatcattcatgaattcatcaactctttgaacgggtcttcgggttcatcatttttaaccttgttcaaagctagttttgatcgtgattctaaggtcatacctagtgaggtggcttgttttttcaaatcactcatagcttgtgattgaacccgaaccgctggattggctttctttactccgttttcgcatgtgataaacgtacctgattttcttatctcggcttcggctgttttcattcgagcaaaggctaaacaataggctaccaatgaaccataatctgcttcactcaatggataatctttttttaatgttggtacgatacgattccattcacttctagcgctcgctgccatccagtcagggggcgtgatatttattaatggttgctgcttgaacaattcttctctagcgtccacacggattgctttttcttcacttgatatattgccttttgtatcgtgtaatattttagggtgtcccatgttgtcctcctttcagacaaaagaaaaaggaacgtaagcaattaagctcacattccttcgtttttcgatcagaatttttctttatctaatttatctatataaatgatttttccgttctgcatttgaatggtcacttgaccaaaatgaggtaactcaatggtgcgctgtttccctgttttatcagtaataacaattgtatttttcaataaatctcctactttcattatatactttttcacttgtgattacaagtgtaatcgttatttgtaattacccttatgccttttcacaacggttatttgtaccaaaatgagtaggcatcgattgtcagtaagtttcacactatgcccccttaactcaaagggtactcttttctcgtctttgtctttcattggctgtcttggaattatggtgtgcatggcataaagaacgaaaattagtttcatctaaccgtctattccaatcatcttttagttcaattttgtgatctacaacatcagctttccttatcaagccttcttctaggcaatcctcacatactggatgatttaaccgatacaagtatgaagcctttcgccatgttctactttgatagaattgaaaatatttaccttcgctttgctttctttcttcacgcttaattgccgtttgctttgctttatgcttcccacaatacttctgcctataatcaatcaatgttttacatccagcatgattacattgttttttaactgccatagattaccaaccaaagcgatctcgttcgtcagaatcatcttgttcccattttgatttgtattcaatataaggcgaaactatcttcaagcacgttccgtctttaaaattaactttagtgattttatcttcctcaaaactaataaagtctacatcttcttgagtgtttgaatactcaatgtgtttctcaccatcgaagtatctaatactttccatatgcataattattctacctccaataaattagttatcaattcatcatctgttagtagcaaagccaagaacttatcatggatgtttaaaaacaaattatcctcattcgatgtaagctctcgttgtctcgctcgatcatataggttaagcagacaattaaattcatccattagctcacctgtatcatcatagttgccactatctaccaatgatcccactactagcgattgacaccacgctactgactcctgcagccaatcaggttcttcttccattatctttaatacttctggatcaaatgtggaataatcttctgttaccaatcccacactaaatgccagcgtgttcattagaaaccgatccatttcatctgtatattgaaagttcggtgctttgtttgttgaaataatattgagcatttactttcctccttgattcgtaacacgtggtaacacctacgtaacaggtacccgttaccactcaatcccaacggggacaagggttctagcgttttggtaacaggtaacgggtaaaatccagtaacattattccccagcatattagctaactatttcaaaagttttaaggaaataaggtgttaccccgttaccaaattgctgtatcccttggggcagtaagggtaaactagtaacgggctaggtgttactgacccgttactacccgttactttttgtactttccagctcgatttttattttcataggcatttgacttattgtaaaatcctcgtcgtttatttctttttggcagttgcttccgttcccaaccaggaatactgctaataatcaaggcaatctttttagtttctgcatctgatcgaccattcaataaatcctttgcttgtttatcaaaaacagcttccaaaatatcagcggtgagtacgctatcaactaaataaaactcttgttgcatagtagctccattatagaaatgctgtaaatttttctcattacatttactgtcaggatagttctgataataagaacgtctcgcccacgctggagcttcttcccatttatacgggatttccatttccaaatatttagtgattgcttctttaattggattctccatcttggcatcctcttgatagtcttttgcaatttctaagacttctttatcttcatcgggactaaaatagattcgttgtcctttatcaaaaagcacctttgcttcagctaacacttgaagaaaatattcatcctttgttttaaacggattcatctttggcttattcttacaaggcaaaggataaaaacggcggtttcctgtatcatctttcaaatactgcccatcattcgacgttccaataaatacacattgccttgcccaagctatgacattccgaccataaggaggtctaattttatcgatcttggcactgatgaagttttttatctgttcaattttagttttgttcattgaagataattctccaagttcaataattacattgccttgaagctgcatataatcatctttcttttcacctagcgaatctaatgaatcggtgaaaaaatcatccgtgtaaagtaatgctggaacggtactcttaccaatcccttgcggtccatccaaaactggaacgatctcaaactttattcctggtttatagatacgtgcgactgatccgactatccaacgttttgttacttctcgtgtgtaaaggttgtcgtctacccctaaaaggtcaataaacagtgtttccagtctaggctgttgatcccatttaactttttcgatacgttcttttactgggttgaaaacattctttctagccacatttactactgctttgtgtattttgttgtcatcaaaaactacattgtagttttcttcaatatatgccgttaaggcatcctcaaaactgtcttcccattctccagcggtacgattgatccaaggagaatcttttaataggtgaatgtatccgctaaattcgttataagcaattgttccagctaaattgctatcattggttaaaatcaattctgcattcacaacactgttacttttaatctgatcgtctttattgcatcttaatcgtgacatccaggttttcaattcaatgatattgtcttcacgctcgctggcttcgggaaagtctaaaatactatctaatttatgcttatgagccatgagctttccccctcaaatcttttttaatcatcgatcgaataatttgattcacttctttatcttttagcggtggttcattgtacgcatttgctgtataaatcaattctgctaaagtttgattatctacaccgtgccatagtaaccaaccgcataacttagttaaatgatcgtttctactaccttcgccagcgccttgaacaatcatatctaatttttttgctgtccctgtttttgctacgggtcggtattgagtctttatttcttgcggtttttttagcagtaggttcactagccaatcgggagctggtgcaatattatttagagatacgttttcaataggttcatatgctctcccaacacttcttgaaataatcatagttggcgctattggaactcctttagtgataatatcaatcccgcttaaacttttacctttatcatcacgcccgaagatatcagcaaatgcacctgtttcttgttggataattacaccatcaggaattttaaagaagaaatggattcctttacctggtgtgatttccgtataagtagaaggaaatggatcatacattgaagcaagttttttataattctcaacgccgtttcgtgtttcagaatgttgatctaggtcaactaccaccatttgatgatcttcaagcattaacccaatatttctagttgcatcttccgtccaccattcattaatttgattagaatcgttagttgcatcattccaaccactagagccttttattggaattttagttccaggagataagggataaattgaccatcccgacttttgtaattccgttgctgcttgataattatttgccaataaacctctcctcctttttcaaaatactggtataaatcattcagacacctccatgagcttcaactgctcaagttcgtatttcaacccatcccgaacaaattcagcaccttttaattgattctgatactttacccatgtattaaatgttttcacccttgcttcttgcatatcagtaatgtttaaccatgcggttaaaatctgattttttagctcgttgatttctcgacaaattattttgtgttctgcatgttttttgagtacatacaaaactgttagtttttcattgaatgaatttccaaagtaggttttcccgatattattttctagttcagcgatcccttgattaatttcctctaattcaaggctatcgagttggtttaatagttttgttttgtacatctacttatgccctccagttcttaattgatagtcgtactcgtcataagcagtgaagagatataacgctaatcctgcaaagatagctatttttgcaattaatggtaataagccgaaaattccgccgattaaaatgcttcctataattaagtttcgtttcataatggttccctccgattttttaatatggtataatcggaacaaagaatatcgggttttatcccaattaagttgcctttatcctgtccgccaagactgttatggataaggctttttctttgttctcgatcatgttaatgctcctaagttgtctgcaattcagcagaacgattataaattttctcactcactgaaaactgcaacccatatttttctttaacagtcattaattctactgtctcatctaaaataggttcacgatcaaccaacatttcaggagtcatatctttcttttttaccattttggaatgaccataaatagttgatacagctttattggctatcacattcgctttaatgtagtctactggttttggttcagtaatagcgtggcttaatttagtcattgcttctttttggtgttctttgtctagcatgcggaatacttgaaagccttcaagtcctgtggactggcgtagttctttgatgatgtcgaaaatccagtcttgaaatgcctcggcttcttttttacggcttttgaatgccatgcggtaaatattttttttcgttgatgatgtttacatcttgtgttctgcccaatgaatcgatgaccttactagtagtaaccccatctttaggcaaagagtgaatggctctagtaacctgtttaagacctaacgcttccgcaacatctttcgccactgcccaccattcatcattaatatcgacaaatcttataatgtgtccgttccaaatttcagttttcattcaacgtcctccagttcaagccctagcaagctcgctaacaactcaacttgctgatacaaaatttcttgatactcttcaatagaaagtcgttctttaaactctgcttgtactaaatcgttcaagccacgcaatactccgcttaccgttggttcttgtggtagcaatttttgatagtccatttgttcgtacaaacattcaaacgtttcttctagcgctttgccttccaagtttgctaattctgccgctgtgtcttctgtaagaattgttgataatactttttcgattgctttattttgtgtcgattccattattatttcctcctattaatccctttgcccccacggcttgcgtttatttttggtattcttccataaagcgatcacattcatcttgtgaaattcttacgactccatcaactataatcaactttaaaccgttaggaacatatttctgcatcatagtattgtatgaaacgttcatatacttagcagcttgtgccttgttcatatattttggaaactggtactttttttctaataatgaaagtaacgttccttgagtttgctctacttgttgaacaactcgatcgtcaataattttaaaagctggatcatcaagcgtgagtttgtcaatttttaattccatatttatcccccctcgttagcatacatttctatacaaagattttaaaaaaatgcaagaggctcttgaatacatttctatacctcttataaactcaatataccatcataccttttcatttgcaagaattttaacatacttttttgaacttttatgtttcacacatatttaaatcgtgatatagtagagaaaatatatgaatggtggtgaaaatgtggctagaaaaaaataccccgaagcagtggagacaggacaaagaattagactggctagaattgaaaagggactctcaatggaacaacttggaggtaaattatccccaccggccagtaaaggtgccgttagtaattgggaaaatggctataatcttcccaataacaccaggcttaaacaactttcaaaggtattagatgtatccactacctatctattaaacggatcttatacattaagagatatgcatatgatgcccgaaattaagcgaaatgtgcttgaaaagcaattgaaaaaaactattgaaaaaaataactctataattgattctaatctttctaatgctatcaataacatcgaagaagataacctgactgtctcacagaagatttatttaacaaacgcaataaaatatcttaaaacaggatctcgaattgaatttcctgacgggagtaccccaattgcttatctcgcagctcttctaaatacgcttttacgatatgactcattaattaatgattcagaaaaaaatacagatgagaaaaaagagtatcaagaattttatgaaaatgatcttctaaaagagttcacagctcttgttactgagctaaataaacactattcaaaataataataaactgcctcctccaaccgcccccacggcttgctacactatggagggaaaactattatggcaacattcaagcaatatgaaactaaaaaaggtaaattttggctctatgaagcctatcttggaatgaacaaaatgactggcaaacctgataaggttcgtagacgaggttacaaaacaaaaaaagaagcccagcttgccttgtcacgcttgcaagtggactacgataaaaacggtattaaaaaagcgaacaacgaaacgtttaaagaagtttatgacttgtggctagaaacatataaaaccactgtccgagaagccaccttcatgaaaactgaaatcaagtttagaaagtggattcttccaaaatatggaaatcttcgtgtgaatgaagtcacggtaaaaaaagcccaacaaattgtaaatagctgggctgaaactactgaccaatacaaggtacttcattcaacttctaagcgtatttttagctacgctatcaatcttgggattattgagactaatccactagacaacgtattaatgcctaaaagaaccaccactaagcataaagaaaaggtcaaagtttacagtaaagaacaactgatcaccttgtttgattacctaaacagcaaacctgaaacttatcgaaacgactttgataaaacgttactacgctttctcttttatagcggggttaggatcagtgaagcccttgcattgaattggtcagacattgattttcaagaaaatacggtcaccatcaataaaacactaagccaatccaaaaatggctataaaatcagtgatcctaaaactgattgtagtgctggggttcttccactagatgaaagaacaatttctatattaaaaaaatggcagattaatcagcggaaatatatgctgacacttggtgtaactgatccgactatgattttttgtggtatctataaagaactaatcacacaccacgctatttatgcaagattgattactatttgtgaaaaagctatggttccatttctcggtgtgcatgtagcaagacacactcatgcttcaatgctcttggacgctggagctactatggtagaagttcaaactagattacggcatacaaaaattagtcagacgatcgattgttacggtcacttggcaaaagaaacgaaagaaaagactgttgaaaaattagtacaacacttaaatattgactagatggcatacaatatggcatacagtaaaaaataaaaaaggagaaaccctatcatatcaaggtttctcctagctttatagtctattcttcttcttccgccatgaatgtattgaatacttcttcaatcatgtcccattctgcgtctgtttcgatttgttctaactcgccttctgttccatcttcgttttcgatgtatgcataagcttgtaattctacatcttcatcttctgaaacaccagcaggatataaaagaacatagttacgtccaaattcttcttgtccgtcaactgttagtaggatttcatataatgtttcatttccttggtcatccaccaatgtgatgtgttcgtgtccttcatggtcgtgggaatggttatgttctgtcataagattacctcttttcttttattattaaaataattgcttacctgagccgtctaaataattttgtaagatcatcacagctgctaatttatcgatgactttttttcgtttggctcttgaagtatttgcctgctctactagcatacgttctgcctgaacagtggttaatcgttcatcttgataatcaactggcaaggagaatagttctttgatcttttctccgtatgacatggaagcttctgcccttggtccgatggaattgttcatatttttaggtaatccaactacaaaccggtctacttcatattgtgctactaattccttcaaccgatcaaagccaaactcttcttctgcttcattgatccgaatgatctctactccttgagctgtccagccaaaggggtcactgatagcaacacctactgtcttagaaccgacatccaagcccattactctcataaattcactccatgatttgagaggtagtccttgacaattacttccatgatctcatcgcgttcgtgacggcgaatcaaatttcgagcatcacgataacgaggaatgtaggccgggtctccagaaagcaagtagccgacaatctgattgattggattgtagcctttttcttccaaagcccgataaacaatcgctaatgtttcgctcacttcttttttgcgactatcgtcaaaaccaaaacgtacggtttcatctgtaaaacccatgattctacacctctttcccgcaaggtaattccagcttaccttctacaaccttattttactcgaagaaagggaaaactacaaacaaatattccaaacttccgaataaattaagaaacactatttgtatgtttttttccttttttctgtagctttatcaaaagtactcttttcataaagtatacgctatatttctttgaatgtatgtttttacacaattttttcataatattcataaaaaattcgaatagctgctactaattttttgtttttgttgcttgtcctgtctcataattgatcgtgtagccatcttgaacattgtagataaagacattgaattcaatttttttgtcttcaatgctttctgcttccaattgcactcccctggctaccagttcattcccctcaaaatgaggagtgacacggtagcgtacatgatgatttgtttctttgatatatgccgcaatatcattttcgtgagcaagcatgtatggagcattcaacgaacgtgtccctgtcatcaagtttttaatgttgttattttgaccagtcagctggaaaccaattaaatggctgcgattatataaccattgcccgtcacttaatttcttttgtttccaacctgtcgggtcaatatacaaaggctctctcttttcagtagggaacaaatcttttccaagcatagcattggcttgtcctactctgttcaatttatcaatatttgaatagctttcccatgttcctttggaaaggctaagatcctcttttgtaaattccggctgattcccattgatttctatttcttgatgttttccatcatattctggcacatccgctacttgagaagcttgtggtgtggaatcaaaaatagttgtaatctgctgaaagatatctgaatctttttgtgtggtggaaacaccgaatgcccctgcaatcacagcagcgacgatccccacgatcgccttggttgtttttttgctcatttctttactcctttactaacagctccctaaatcttaacatatgttcccctataaataaatactagaaagaaatagaaacagcaaaaaataaaacctgttttaagatggcttaaaaatacaaaaaagagacggattcctcgtctctaatcagtcaccactctatctgtaaggtatttattattattcaaaaattttcttcatactcaagacaatacactgatttcacaaccgcttggtaaacggtgcgcaaaagcttgcatctgcggtaataagtccatccaagttaaaaacataagaagttgtttttgcttggctgttcttattacttgttgcagagcagctttttcacaacctattttaagcgggtgacgggaatcgaacccgcgacatcagcttgggaagctgggattttaccactaaactacacccgcaatacaaaaacagtatacgcctcttttattccttcctcaagtttttttattctttacgcttctggtatgttttgtagtaaaataaaactaatcaatcaattattggagaagatgctatgacgggaaaagaattagatctgttgctggacacttgtttactcgctgggaaaatcatgatggaaagcaatgcggagatgtatcgggtagaagatacgatgagtcgaattgctttagcttctggaaatttccgtttggtcagctatgtcactcaaaccggtctctttattggtcttgatcgtacctcgaccatccgaatggaacaaattaccaaccgttcgattaatttagaaaaagtagtaaaagtaaatgatctttcacgtaaatatgttgcttcagagctaacattagaagaactttactgcgaactgcaagcaatcgaccgagaccgttctttctttcctgtctggttgcaaatcgttagcgcggcagtgatcagtggaacaattatggtgttatttggcggaaagatgaccgatttacctgtgactttagtcattggaggattgggatacgcagcttatctatatagtttgaaattttttagaatcaaatttttatcggaatttttatcttctttattgattggcatagccgctatctacagcgtacgttttggcttaggaagcaatcaggatctaatcattatcggatgtgtgatgcctttagttcctggagttcaaattacgaacgctatccgtgatttgctagctggacattatgtctcaggagtttctcgcggaacagaagcgatgatgactgctacgatgatcggttttgcgattgcttttattttccagcttttttattaggaaaggaacacaagtatggggacgatatttattcagttttcttttagttttttagcgactgcggcatttgccgttattacaaatgtacctaggcgttcattgatttgttgtggtctttctggtgcttttggctggatgatctactggatctgtgttcaaataggcggatctgctgcttttggttcattgcttggttctttaggagtagcattcatcagcgatcttttctctaaacgtttgaaaatgcccgtaacgattttcaatattcccgggatggttcctctagtccctggtggtttagcttatcaagcggttcgaaatctcgttactgaatcctatcgagaagcggctcattatgcggtccaagcaattatgattgctggagcaatcgctttaggtcttgtattatcagaagtctttaaccataacatccgtaatttcaaagtaaagcgtgacgcaatcatgatgaaacgaaaaaaacggctttttaaataaacgaagtgtaacaaagaaaaggttgtgaaagagacgttcagccttgagcgatgacaaaatatctcacaaacattgcgacaagtaaccgcaggagcaataagaagtaattatgagtattaaaaaaagttttgtaaaaatagcttctcacatttttacataaaattgacttaatactgagaaactgacttttgaacaccctctatctgtaaaaaaggggctgcgacatgatttttgtcacggcccctcttctttattcaaattttttccaaaacgttcgttgataataaacgatccatagagcggaaagtattagaactaaaccgatcacaggaatattcactaaccaaaatggataaaacaaagccaacattccgtataagacgataagaataatactgatgatcaatgaacccatcatagttgcgactaaacccaaacttcctgaacctctgttaaataattggttaatattggtccagttcagcagcagcaaccgataatctctagcgaaataacgtagtgacaataagtagcagccgaataaagaaccaaatagcaagctagggataaaaaacaaaggcagctgaaaagacagtccgcttaataatgcgatcccaccagttaaaaaactctgcaatatccatccgaatctgaacttttcttttaaatattggttcatagagattggcaaagaacggataaacagaaaattttcttgatccaaagaaataagattgctgataaaagaagtctgattaactgttaagaaagccaatgcgatccctaccaggaaaacaacaccgattaacttattatctaaatcagttaattttatttcgcctcctagggcaaaagcaagaataaaaatgattggagttaacaaggaagaagaaagaacttgcataatcaaattaggttcttttactaattgagcattgtaactaaataaaagctgatgcacattttggttctttttatgggttctttttattttgaactcactgtttgaatcagtcagttgctctgtaagctttggtactatcagctgttttacagcaaggaaaaatcccagagccgtgatagctagtattccccaacccaataaaccttgttgagaaagtggctgactggcagcatcatagaatggcaataatatcgaaatcggatgccgatctgttaactcattttcaatagtccccgtttgatgattcatccacatgattccagcaaatgcgatcagcatcgagctgccaagcaagatactagaaactgtttttctatgttttttaaacactgctgttcgagccaaaccaaaaacaatcaaactagccagacaaaaaagaataatcaaaaatagagaaaacaaaaggattgagataatgatagtaagcaaaatccctagatcagctcgccatccggttaaaataaacatgactagaagcggaaaaacaaaaggaatgatggtcaaagcaactaccaaaatctttgctgaaaaaacctgttcttgtccaaaaggcagaggcaaaaatacttgcaggtcatttccttcaaaaaagatattataaatgactgatatactttgagttaaacctaacataccaaaaagtgccacgtaataagtaaagaaacctggcaatttaacaaagttcatagcaaacatagcaaatccgtaaatcagtaaaaaaatcagccctgaaaaaagattttgagacaaaagatagatagttaatcgctttcccttttttcctttctctcttgctttattcgtgagctgtggattaacatataaaagattaactcgaattaattctaataattgtcgcttatacatacggtccatctcctgtcgcttgccttccagccattttcaaataaatcttttctagcgtttcatcaggtgagccattcaataattcactaactgccccctgataaatcaattcacctttcttcaaaatagccagtttatcgcataactgttgtgcggtatccaatacatgtgtagaaaaaatgactgtttttccttttgcggcatgagccttcatcatttctttcaaatcaaatgctgcttgaggatcaagtccttgcaaaggttcatccaatacccaaatatctggatctggcagcaacgtgccgatcaaaatcgttttttgacgcattccatgtgaaaaacttgcgattgtttcattttgatgactatacatatcaaaaagcgctgtcaattctgctaaacgcttttcttttttttgtgtgtctaattcataggcagctgaaatcaagtcccaatattctccagccgtcaattgtaaaaaaatatctggggaatcaggcacataaccgattttttgtttgatactcaatcgattttccgtcaatttcattccatctactaaaatcgttcccgatgatggttcaataatactaactaaacttttaatcgtagttgattttccggcaccattatgtcctaaaaatccaaaaatttccccttgtcttatcgagagagacaagtcttttaatgcttgttttttcccgtaacttttacttacattgatgaattcaatcatttctgtactccttttgtttgttattactttttattgtacccttcgttattggtggagtaaatgtcaaaaagagtgcataacaaaaaaggatagaaacgactaggctgctacttgggttgttctcttctacaggaaaacactcttctaacaggtaagatatgagtctttgttttctttaaaatgattcattttctatcttttcttgcataaaattctttagtttatcaatacttctctttcccatctctagttgttctccatttgcaaatgttactatttcgtttactctgctaatagatgtaatgttttcagtattaatgatataagcttttaaatctttacataaatactcatattcgagtgattttttatattttttaattgtgccgtttacgagaatctcttcatctttcaatactaggcctattttatttttataacctggcatgctcattagataaaggatttcatcgtaatggatatagtgatcgctattaccataacggacagttgtccacctttttttcgtagcatgttgaacaggatagttttctttttctttcaataagtaactttggatgctttttttatttttttcataagtgaattcttttatcaaataaccactaggcgtaatctttcgattaataacagttattgctttattcggatgagacgttagataaacaattttacacttttcattcttttctctaagcatttcgcctagttcgataccgctataataggcgttcaaatcgatgtctaggaaaaaaatatctgaggaatagatttcattatttttaatgaattcaacaaattgtataacgttcaatccctgaacgatctcaaatttccaaggacttaataaaattctggattcttccaaaatttctactagcattttttcaaaaaccaaactatcatccaaaataaatatacgcgttaccataaaaagtacctccactcgatattttactatcaaaatcatttcatacaacttttcaacatacatgttaggaataaattgtaattctcttcacaatcttttccaacacctttgaaaccgatatcaaatactttcaggatgctgcttctaaaataaatatcaaacaaatgaatacatcatgcaaaaaaagccagacaaccgacgtccttgcgtgtcagctgtctgagctatgtttatttattttgttcttttaaaaagaacgatacacatactgatttttcggagcagagactttctcagcgtttgtaacaactacagatgggatttcacgcttgaatggttgataatagtctgattggatggttccttctattttataccattcatcatttttaaccgttactccttccggcatatgcgtcaacaaaccaaagactcctgaatctgccacacaatggataatgccgaatcggaacaagaagatatctgtattgctatcgttcggtgtttggtaaacaaatccttcatagctgatttttttgccaatgaattcgctagggtaattataaattagctccataacttctaaatagttttcatctgtgatcttgatagtttgcttatccccatacttttctttcaactcattcatttggtctaagtagtctgatttgttgaaataaatactggtatccggctttaagtattgtgtctgcatctccggatcccctactgattctttacttactgggaaattaaatcctttggcttctacgatcgtagtgtcgagactaactgttggaaacaacgtccccacgattactggcaaagctagcagtacataagcgattccacgttgataaggttttgacaacccatggtcatgatcgtgctcgtgtgccttttcttctgcttttccgtttttgacccacaaatacagctgaactaaagccaaaagagcagataaaatcattgaaagaatagctaagtagcgataatggacattgatatattgatcgagtttgccagaaacttgcaagtacatcatcaattcgaaatacccagataaaatcaaaaaccgcagcatattttccctcctaaataaataatgtgaatccaataacgctaagggcaatcagtccgatcagcgataaaataaagcgtcctgtaaaatatcgtttcatcatcagtagatttttgatatcgaccattgggccaaagaccaaaaaggcagctacaggtgctgtgccgaacagacttaacaaagaagatcctataaacgcatctgcttctgagcaaagagacatcgtaaaggccaataacagcatgatgataatggctaaaatctttgttgagccgagcgttagcataattctagttggtaaataagtctgcatcgcagctgcgattaatccgccaatgatcaaataacgacctgtatcaaaaaattcgtcgattgaatgtgtcaacacatgcccagtttgatggatcagctgattttttggttcattcttctcactttgttcttcttcatggacatgatgatggtgattttctgctactttagacgtgattttttctttcaatacagcgtctttttgaaaataggcaagccagacaccaatcacaagggcaacaaaaaagctgcctatcacccgccagcttgccatctgccaagaattgccaaatgcgataaaagtggaaaaaatcacgattggattgatgatcggagcagtcagcataaaagcaaacgctgtgtgaactggtacgccttttttaacaaattgatgaacgatcggtacgatgccgcattcacatgaaggaaagaaaaatcctaagatcgaaccagtaaaaatagagaagatacgattttcaggaagccatctcttcacacgttctggggtcaaaaatacttgtaaggcgcctgagataagacagcctaataatacgaaaggtaatgcttcaataacgatcgataagaaaatcgtactcatctgcaaaaccgaatttggaataaaagaaaacatgagtttcctcctttttatttctagttcattcgctttgcaaatatacgcttttattcaaaaaaaacaagttgctctgtaaatttttacacaactcttattttttaccaaagcacttcaattgactttttctgttattcccattaaattaaggtctcatacatatcacttctatcataaaagggagaataaaaatgaaacaaaccactaacttgactgaagttcaagacatactgcaacagtcatccgttgccgtcatttatctttcgatgcctaattgcagtgtttgtcacgctgttcgtccacgactagaggaacttctcacacattatgatattccggcacttcatttggatgcatttgaaacaccagaagtagctagtaaatttgaagtgctgactgcgccagttgtcctgatttttcatcaaggaaaagaagtctttcggcaagcacggttcatcgactttaaaaaaatccgttatctactagatgaactgacagcagaagatgattccctttcttatgaagaaatcttccgaacaaaataatcgttgtccaaacagaaaaaagcgattgaacaagtgaaagttttgccttcatttgttcaatcgctttttatttttattctgctgtattttcggaatgcgcatttgcgtcagaatgcaagaaatagatcaaggtttgcaattcattcgtcaaatcaacattttggatcaatacatctgacggagcattcaatcgagcagcggtaaagttcaagattcctttgattcctgcttccgttaactgattgactacttcttgtgctctttcagcgggtatcgttaaaattgctacttcgatttgttggatcttgatttgttctgacatatcttccattggataaacggggataccgtctacgatgcgcccaacgatttcctcattcacatcaaaagcacaactgatacgtatgctattactttgatggaatttgtattttagtaaagcacttcccaagttccctacaccgatcagcgcaacatttgtcaattgatcgtcgtttaatgtctttgcaaaaaagtgcataagatcttctacatcataaccatacccacgttttcctaattcgccaaaataagaaaaatctcgacggatcgttgcactatctacttgaacggcttcacttaattcagttgaagacacttttttctttccagcattatttaaaatccttaaatagcgataatacaaaggcagtcttttagctgtcgcctttggaataatatgatctttcacgaaatgacctccacgtattgtctaattacatctttgatttctccatcatagcagtatttataggaaaaaatcaattccattgctcagatattgtgaaattttattctttattcatttatttatcatttctgcaaatctcgcagtataatggaatttatggtagactactaattgaaaaatagttttttatttgaggagaattcacaaagtagaaaagaggattccatgatattattacaagccaatcagattgctcgccattttggtgcagaagtcttatttgaaaacatacatttagaaatcagtacaggcgctcgtgtcgctttagttggcagaaatggcgctggaaaatcgactttattaaagatcattgctggaattgaagcacctgatgaaggaaagatcgctaaaaataaaacagcgactctcggatacctcgctcaggacacaggacttgattccaatgaaacagtttggaacgagatgctgaaagcttttgaacaagttagacaaatggaagagcggatgcgcgagctagagattttcattagcgaaggtacgccagacacacctgcttatagttcttatttaaaagaatacgaccggctgcaacacgatttttcagatcgaaacggctatggttatgaaaatgaaattcgttccgtattgcatgggtttaaattcgattcttcattttatgatcagaaaatcgatactttatcaggcggacagcgcacacgtttagctttagctcgcatgcttttgcaacaccctgacattttgattctagatgaaccaacgaaccatttagatatcgagacactttcctggcttgagaattatctgcaaagctatactggtgcattattgattgtttcccatgaccgttattttttagataaagtagtcaatgaagtctatgaattaagcagaagaaaaatgcgccattacaaaggtaactattcgaaatatctagatttgaaagcagaacagttagcaagtgaatggaaggcttatgaaaagcagcaaacagaaatccataaattagaagacttcgttgctcggaaccttgttcgcgcctctaccacaaaacgagcgcaaagccgcagaaagacattagaaaaaatggaccggctggatcgtcctcaaggggatgaaaaacaagcaaactttctattcagtatagaaaagccttctggaaatgtagtcttgcaaatcgaagatgccgctatcggatatgataatgtcaccttatctgaaccaatcaatctagatatccgtcgtcaagaagcgattgctctagtaggtccgaatggtatcgggaaatcgacgttgctgaaatcaatcattcaccagatcccttttatccgtggaaaagaaacgctagggacaaatgtcaccatcggctattacgatcaaggtcaagctgatctgcatacaaacaagacgatcctagcagaattgtgggatgagcatcctaccactccagaaaaagagatccgaagtgctttaggtgctttcttattttctggcgaagatgtagaaaaaccaatccctctgctaagtggcggtgaaaaagcacgggttgctttagccaagttagcgatgaacaaagaaaattttttgattttggatgaaccaacaaaccatttagatattgacaacaaagaagtattagaaaatgcattgatcgattatgacggcacactgctttttgtttcccatgaccgatatttcatcaatcggatcgcgacaaaagtcgtcgaactctctgaaaatggcagcaaagtctatctaggagactatgattattatttagagaaaaagcaggaagaagaagaaatcgccgaattgttggcacaagatgagccagaatctgctcctgctcccacgaacaaatctgattattaccaaagcaaagaacagcaaaagcttatccgtagccttcaacgaaaaattactcaggttgaagaagaaatggcgcggatcgatgaatggatcgatcagttggaacaagaaatggtcgcgccagaaaacctggaagatcacgtaaaactcaatgagctgaaccaagatttagaagctgctagacaagatcaagaaacaaaattgacggaatgggaagaactaagcttggaattagaagaatatgaaaattaacgaaaaaaccaaaacagaaaccattcatgctgttttggtttttctttttttattttatcaaacaaaaattccatatttacctttttcaccaataagaagaccaattactagtcattctcactaaagcttctaaataatagtaatcaccccaaatacaaggtgtatttaccccattatttttgggcttattataaacagactgtgttaaaaagccatcttcttcttccgttgtagcatatctttctttcaattgtcgcataattttccaaacagcagactggtataagttcttttctgttttgtctaatagacctgattctattaattctaataatccacaaaccatgatcaccatactagatgtatctttttcttctctgctagaatcatcaaagatcaaatcccaataacaaatggtatcttctggcaaccgattcataaaataattggctaatattttgcttaaatcaaaatatttttgttctttcaaataacgataacttaatgcaaaaccgtaaatcccccatgcttggcctctagcccaacaggaattatcactataaccttgatgcgtacttccatatcttggttttccatctttgacatccatataaaatgtatgataagttgaaccatcttctcttactaaataatctgctgcattttgaatatgagcctgagcagcttttttatatttttgatttccagtttcttcactcgcccaatacaataatggaagattcatgcaacaatccatgatcattctaccttgttgtgaaggatcactaggatctccccaagcttgtataactcctgccttctcccaaaaacgctgaagtaatgtttctgcagcatcaattgaagcttccttcatttttcgatttcccgttattttataatctgctacggttgataaagaatacaaaaaaccaagatcgtgatgattagtgataatttgacagtcaatcctgtggataaaatctatatctgctttttcagctgtttgttgaaataaaggatcacccgtcttctcaaataacaaccaattaattcctgtccaaaatccttctgtccaaccaatattgtctcttaatggataacgtccttttataggacactcgcttgggaattgatactgactgttactgatacgtttgattaacctctccgtgtgtctgcgacaacgctcgatctcattattccattctttttccattaattctttataacattcatttatccatttttctggatgtattatctcttcaaacatcactttatcaagcatttccccaccagcctttagcataattttagtctttttttattgtttttattttggatagttagcccggttgtcccatcaaaatcaattttgggacgattgttccatacttctaaactataatcccgatcttgatgagcaaccactcctgttccgagccaatgggttccttttccaaatgtaccctctaatccaggaataaaagtgttttcccatgtcatcaagtttgtattgggcaaacccataatagctgtggattttcgtttaatagtatcgtcacttaaacagataatacctgaaaagccagcttcactcaccctatagttttccttgtcttcttctatgattattccttctttctcaggagaacattcaatagcaaaccctgtctcatatagaacatattctgtatctaattctactttgtgtacgcgaatctgccagccttcaaaaggaataagccaagttctgatttttgcctgtaaagtaggttcccatgtagaggcaagtacctctttcttacatacaatgtctcgtacattatttcgaacgatgaactgtccataggttttgatgctctcattcttaaaactggtcgtgatatatgtgtccgctcgctgaatccctagcattgaatccattgccatttctgctttcaattgattcgctcgcggtatcgaaaaaccaaattgactagaataagcaaattttaaatatttttcattggtcaatgtatggaaatttggccctaattgtcccgcattcaaaaaaaatgtatgtccattatcatgttgtatgagcaaattggcttctgaaagaagtttagttccttcacgaataggcataggcatttctttagccgtccaatactcatggtcttcaggtagcgccaacaataaaaaaatcttattcagccataatggagataacgtactattatagggttcagtcaatgtcaattgagggtaggtataaccaatattcaggatacctttttcatcaaatatttctttttgcatccaccatcttatattccgattgactaaccccttgatttcacctaatttaaaaggcaaaagatcggcccacaacatagctgaccaaaagcttgaaactgcaaaacgataaatcatgcttcgaccaaaaggcacatttgcaccatcttccgcaaaaaaatgaatatagtctctagaaaaatcaatagctcggttcttatatatctggctaatgggcttttctggttctagtacgctataaatcaaaccataataatgaaatgcaaaaggattataataatcttggcgacctcttgaactgtctcgataccagccattttgaagataacaattttctatattatcaaatgcttctttcagtgctgattctttaactggataaccaaatttttggataattgttccgacaattatcttaaaaaattgccaattaccatctgcacattcatattcaaaaatttgcgagaaccaatgaataatctggcttttttctcctgtatctaattttttccataataattgttcatgatgatataacgctaataacattgcgggcatttctaccatacgctggtctctttcatgtatttctccccaataatcgggatgggaaggatctgttccagcttttattcctgatagaattaatttcaaccatcgttcatctaattggtcaattgcgggccccgctccccataaaacccgagagaatccttccattcctgcaattttatttccatatcctaccccttgatgtatataatcaatttgtgcgccacttgctcgataaaacggctggagtggttgatttatctttttaaataagtcaaagtaatcctgtctggtccttaatagtggtactggatgtttcattgtattttctcctctttttactaccaaatagctaattccgactgttctaatcgaagtaagccttcaataaaaaaataatcagaatagatcagtggcacattataagtcagttctctatggtatgcttctgctccgcctccaatgatcccatcttcatccatattccaatttgcatagtgcttttctgtcttttggagtatattgatagcagcttcatgatacatttttgatcgtacagaggaaacatatcctgctaattccagaagaccgcatgcagcgcatactccagcactggtatcaatattcgaatcttttacagcaaaatcaatgagaggaatataaccagttttttcgattttctgaataaaatttactgctatcttttctgctatagctagatagtacggattttttgtgtaacgataacttaacgcgaatccatataaagcccatgcatttcctctgctccaacaagaattctcattgtatccttgcccgccaagtaaccgaatatatttccctgattctgcatcaaattctgcgatatgcccggttgatccatctttcctcactagatacttagctgttgtatctgcatgctgccgagcaattttagagaacctcggatcaccagtttccctcgaagcccaatacagtaatggtaaattcatcatactatcaataatcatccaaccaggtttatggtcattccatgctactaaatagttccctgaaatattatagcgtccagcaagtaccgtagctgcatgtaaccctagttgtcgactatgtttgttttgagactgttgataatgtgcaatagccgatggtaagaataaaaaacctacatcatgatgaacgtctgaaaaatggtacagggcagattctaataattgttcttgttgtattgctgcctctttgaacttttctcgttttgtcttgtgaaagagctgccataaaataccactccaaaaaccattggtccaccagtcgattcctctgtcctttattacgtctgtatattttccgttgtaagaaatatatggaattttattccccattctgtctaattccgcatctatcttttcagaagctacattcaaaatttttcttgaccattccttcgtctgttcattcatggatatcccgccattcttttaatttttatgaatgtggagttgctcctagaacgaactagatggttaacattcgttattttttttacttatttgcagctccaatgtcattctccttaaatttagactgcgcccacacataaatcaagaccattgggatcactgaagttgctaaaattagcataattgcgccataattaattggctcacctgtactagaaaccgtcatatttttgataattaagggaaccgtatatttatctttatctgaaagcatgactaatggaaatagatattgattccaacttcccataaagataagtaaaccactagtaataatcgtaggtgataaaatcggtacagcgattttcgtaaaaatcacccactcattggcaccatcgattctggcagcctccatcagtgctgtaggaaattgactgctatattgtcgcatcataaacactgaagttgtactggcaatcgaagggatgatcacacctgcataagtattcgataatcctaaacgactcataatgtaaaataaaggaatcaatgtggtaaaaaaaggcaccatcctagatagcataactgtattgaacaacagtttattccccataaaacgatactttgctaatgcataacccgccattgtagaactggctgtagctaaaactgtactgattacagcaataacaatcgaattccaaataatcaagggataattatatctcgccatgatggcttgccagttttttaatagcatatccccaaacttgaaattgattccgccacttaaaatttcttgattactttgcgttgaagctacaatcatatataaatatggcatcaaaaatattaaggcaccaaacacaataatgacgtacgtaaaaattctgctttgtatcttttgtttagtcatttttatcacctccgaatttaaattgaatagccgataatataacagatacaaacaccatcgtccaggcaatagcagaggcttttccaaaatcaaccatttcaaaacttgttttatataaattgactcctacgaccaaagctgaattttctggtccattggaagtcccaaagaatatatttgggatattgaaattacccaagccattgatagtggctaaaactgtggccattaaaatgattggctttagcatggggatcgttaataaaaagaattgccgaaatttcgatgctccatctatttcagcactttcgtatatctctttagaaatcccttgaagaccagctaaaaataaaatagtgttatatcctacactaagccaaatcatcgtgatgatcattgatattcgtatccaaaaaggatttgttaaccactgtacaccgttaattcctagcgcattcaaaaatccattgaataacccagtcggattgaaaaaagtcatgaatacggaagctacagccaccgttgatgtaatggttggaatataatagacagttctaaaaaatccttttccttttaactgtgctgaattcaataaaacagcaaagtaaatagctaatagcatcgttattggaattgatcctgccatgataatcaaaacattcgtgtaagatttaataaacaatggatctcggaagatagctagataattgtcaaatccaacaaattcaaatgagtagccaattttcataaaactaaaagcaaacgagataatgatgggaatcaaaatcgtcacaataaagaaaataacaaaaggtgtgaccaatccataagcactttttttatgagacgtatctgttgcttttttcttgctgttctttattgtcttgcttggtaacgaagattgcatcatcgttaagtcctcctaatattttttaatcaccagttaattttacgccgtacttatgagcaaaattttctgcttcttttagatatgaattttcaaaatcacctgtttgccaatagttatatgcagcggtagtcaaataagacgtagcatctgaataagtggctggtaaaacagtatttgatgtattttcattgattttattcaatagttcatagtatttttgtcctccttagtagtcaaactttttctcagctgcttctgtttgataggccaatgagttagatgtagccacgcccagctccagtgcgttggctaagcattcttcatctgtcagcataaatgtaagaaattgttgtgccacttgtggatttttggcatctttagggacataaaaacttgatcctcctgatactgcaccttttcctggattttcttttgaaaaaggaatcagtggagccatgcgccatttgtcagatgcatcaggaaaattcaaagacatattcgtagcataccagccgccagcaacaaacattgcagattcttgaaatgctttctcagcatcttgtgcaccgtagaaatgtacaatatctgagtcgatcatttctttgattaactttgcagcatgtttcgcttctttagtattcagacggatatttccttcttcatcaagcaaagattgattctgctgggctagcatgttgataaacaattcttggtccccagattctggcaaggcaattccaaaactaccagttttttcttttaatgcttttgccacctggatatattcttcccaagaactgatttcttcaaaatctacacctatttcagcaaatttttttggttgataataacaaagtgctggggtaaaatcactagcccaaggaataatcgtttcattactcgtttgttgacgcaaaatattcaatttttgatcataaaactgatcgccatatttgtcataaaatccatattcatcagcactataaaaagcatcttgaaatttttccagcacacctgctgctgaagtgtctgccatggagataatatccggcatatcttcgtgtgttaccaattttggggtgatcatttgtactgttgctgttcccgaagctacattcacaatttttaagtcaatatttgctccagttttgcggttatagatttttgcagcattttcaacatagtttgtcagtttgccgtttgcgacatatacttctaatgtagtggctttttttatcattggatctgcgatgtttgctgttacttcttcgttagtttttccacatgcacttaagctgaataatagggtaatgtttagcaaagctatcaccaatttgtatctttttttcatgtctatcccttctttcttttcaagttcttatataaaacgctttcacttatgtatattaacggaattagtaacacaaatatttatataaaaaaatattttacttgtcgttttggcttttcatttttgttataatagtcattaattataaatagaaagctttttatataaaaagagaaaggaaagtggttcttttgttaacaaacaaccaatcctccaatcttgtcaaaaaaacactaacctattccatagatacccatcttcatttatctgctgctccctattttcgactactaataaatgaaagcgctaatttatatgctgaatttgcacataaatctatagaactagataatccttcccttttattcattgataaacagcaagaagtccaaatcttttctactcaaaaggaaacacaaacttttatcattatccagttttattttgatgagcaattattagcacatattacgggacaatctttttctatagatcaagaaataacatctatcattacttttctgaaaaatgaacagttcaaaattgattatctaaaacatagtaagccagctatttcctatgatcaggaaatcaattcttttttcatactatgccaacagatgagcattcatttgctttccttattagttacttattgtctgcaaaaaattcaattgtcttccttaccaaggcattatcaacaggaacttgctttattgacaataccttcaaatgagaaagtcattcctaaaaaaaagcatattctttattcagatgaattagttgatccaatcatacgatatttagaagaacatctttcagaaaattttttgcttgaacaattagcccaaattttttttatcagtccagccagcttaaaaaaacattttagaaaagtgaatggaaaaagtgttattagctattttaaagaactaaaaatggaaaaagcaaaacgtctcgtgctagaaaatgaattaacctatacagaaattgcagatatattaggatttcattcgatccatcatttttcttcagcttttaaaaaatatacagggttatccccttcaaagtattatctatccttaaaatagaaaaaaatttttaggttttatccacaaattatttctctatattttctgtctattcaaaataaacaataattttccggcacaattatttgctgttttttaccataacatagtacgatcaacgtagaaaaggagatgtttttatgaaagttgttgtcattggcggtgtagctggcggtccttcatttgccactcgtttccgtcgattgaatgaagcgcacgaaatcattatctatgaacgcggagaaaatatttcttatgcaagttgtgctttgccttattatttaggaggtgtgatcactgaccgtgactcgctgatcgaacgtacaccagaaatattgaaaacaaaaaacaacatcgatgtctttactaaacacgaagtaacagcaatcgatccttctactaagcgattaacagttaaagacctatccacaaatgaagaaataaaaacagattacgataagttgatcatctcttctggtgctagaccagattatccggatattcccggagtttttgaagcagaaaacggctttgtcctccgtagtgtgacggatgcggatcgaatcaaatcgttccttgaagaaaaaaatccacaacatgtcgtcattcttggtgcaggtgttatgggtctggaattagctgagaatttcaagcatcgcggcttagacgtgactttaatcgatcaattgccacaagtcgctttcccttatgatccagaaattgctaatttagtttatgacaaattgctgaaagaaggattagccgttcatttagaaacaagagttactgagatccgtgataaaggtcgagaaatagtattatcagatggctccgtcctttctgctgatatgctaatttttgctgttggtgtttctccgaagaatgaagtggtgaaagcaaccggcatacaattatcagatacaggtcagatcattgttgatgaccagttacaaaccaatctgccggacatctatgcgattggcgatattatcgaaacgactagtgtagtgactggtcagccgatccaaagtatgctttccagtgcggccaatcgtcaaggacatatgctggcagatattttaaatggtacgcctatgcgctatcgcggatatattggtgcaggtgtcgcaaaaatctttgatcatacagcaagttatgcgggaatgacagaacatgaattaaaagcatcaggcataacaaattataaaactgtttttatcactccctttgaccatgcctatttctatccagaagctacaagattaaatctaaagctgatttttgatgcagatagcggtcgtattttaggtggacaagcatttggagaaaaaggtgtcgataaacggatgggagaactttctgtagcaatcaccggaaacttgacagtctttgatttgcctgatttggagttgccttactctccaccgtattctactacccgtgacccgttgaatatagctggttatgtcgcaatcaatcaaatgacgaatatcgtagaaacgatcaaagcaagtgatatacccgaaaacgatttgaaagaagcgttctttttagatatacgtgaacctaataaagcaccttctggcagtatctcggcaacaaaaaatattccaatgaatgagttacgagatcgaatcaatgaaatcccaaaagataaaaaagtttacattactttcagaagaggattgaatacttatacttctgcccgaatcttggcaggtttgggtatcaaagcgattttgattgaagaataaaaaaacgaccgcggtgggtagccgcggtctaggagttatttttacttgaggagtaaaaatgaaaaagtatatagggttgttggttggtatgtatatagaatagaagataaatgtgaagaaattgtgcattatttcttcacatttattaggttatagtttaagaaagtttaaacattgcgcaatttaattattttagctgtttcttttcataaaaaaacatgttgtgactctgagacaaatcatagtccatagtgatgtctctagagtaactacgcctaatattacgaggcatcatattaatctatcagcactagtacctaaactagcatccctttcgaatattttttcttatataataaagtttgctttcactcctctaatctcaccaaatcgactggcttgcgttgtgtgatactaggaactgattggtttagaacgacttttctattgtaatcatatttttcgccatcctcgttgtcttctaatccttcaatgaatgatccctaatgtgtgtattaaataatttaatttttttgttcctatttatttaacaacgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagagtttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatattgttaaaaaaataaaattttattggttttttcttaaccattttgaattggtttttgcaaaccctttaacttcatattcgtttgtttcttccatgtacgcttcgtccaaaaccattgtttgtcttctcaactcgcttaatttctgtccttcgttgcttggcacagaaagtgtataaggggtcattagttccatcagctgacgtttgattgcttcgatcaacgccatcttaccttctttcgtctgagtagaaatcaatacatttgggaatagcgtaggcgtgaacatcgctgggtcgatctggtctgccttattgtaaacagtcagtatcggcatttctttcatattcagttcatccatcaattttaagacagtctgctcctgtaaaatacgatctggagaactagcatcgactacatgtagcaaaagatccatattttgactttcttctaatgtagaatggaaagcatcgatcagttgcgtaggcaggtcttggatgaacccgacggtatccgttacagtaatctcaaatccttcagcaaaacgccatctcttagtcaatggatctaacgttgcaaacaattgatctttcgaataagtatccgcttgtgtcaatagattcaagatagttgacttcccggcattcgtgtagccaataagtccaatctgaaaaatctcgctattttttcttttttggcgattgcgctctcgatgagcttctacttctttcaattctttcttaacagcaaaaattttattccgtatatgtcggcggtctgtttctaactttgtttcacctggccctcttgttccgatcccaccgccaagacgagataatgttttcccttgccctactaaacgaggcagcaggtattctaactgagcaagttcaacctgcagcttcccttctttcgaacgagcacgcatcgcaaaaatatctaagataagctgcacgcgatcaattaccggaagaccaacagcatcggtaatcagttggctctgtctcggagttagctcatgattaaagatgatcaaatccgcttcatgcgcatccgcttgttgaactaattcttgtaatttccctttaccgataatcgtttgccgatccacttgtggtctcttttgtgtaattgtgaatacgacttctcctgatgcggtattcgtcagctgaactagctcttccattgactctgaaaagtaacgctggtttgcttcggtttctacccctacgatgatcactttttcttccattttattccgcctccagccattttttgattgtttgctcaatctgacttttttgatttggctcacttataagatcaaaccactgtgcatccaaacggttacgaaaccacgtcaactgacgtttcgcgtatcttctcgaatgtagtttgacttgttctgttgcttcttccaatgtttctttcccttcaaaataagggaaaaattctttatatccaataccttgactggcctggacttctccaagctcatacaccttacgcgcttctgctactaaaccttctgctagcatcaaatcgactctttgattgattcgttcataaagaatactacgcttcgtatctaatccaatcatgaggtaatcatacaattgctttggctcttctttaggtgccgtgatactatgtcctgtcgtctctaaaacttccagagctcttatcactttgcgttgattgttccagtggattttctcagcagctgccgggtctttttctttcaactgattccataatgcttgggaaccaattgtttcagctaacgtttcatacttttttctaatctcaggattcgcttcttctgtcgctcctaactgataatcatatagaagggattggatatagagacccgtaccaccagctatgataggtaggtgccctcggttcgcaatctcggtaatcaattgtcgacctgaatgctgaaaatcagcggctgagtaacgttgagtaggttcgatcacatcaatcaaatgatgcggaacattattcatctcttcttctttgatttttgctgtaccgatatccagatttttatagatttgcaatgaatcaccactgatgatctctcctccaaatagttgtgcgagttccacacttagcgctgttttaccgactgctgtcggaccgacgatcactaatactttttccatattttacctacttttcgttgattgtttccaccgaagagctttctccggaaaatcagttattattccatctattttgagttcttgacatttggccatttcttcttcatcgttaatcgtccatgcacgaattgcttttggaaaatcagctgcctggactggatgttcgaacaaccaagtattttttggatgtactccttctatataaggggtttctgctgctagttggatctttttatcagaagtactcatcaataagtccagctgtatctccggttccagtaatgcgattttttccaaagaatccaaatgaaagctgcaatatgcatgttgaaaaggccaatctctactttttaatgtttcggctaatttttcttcgataccgggatattcatactgatcagttttaatttcaatcattagcatccctcggtaatttttttggaggagcagtcctaacacttctctcaattcaggaactttagctgctggaaattctttgctgaatttgccccctgcattcaattttttgagttcttccaatgttttttctcgaatcagccctttaccgttagtcgtccggtccacttcttcgtcgtgcataacgatcaaataaccatctttgcttagatggacatctagttcgataccatctgcacctactcgtacagcttctgcaaatgcaggaagcgtattttctgggtgggtgccgctgcttccgcgatgggcatagatttgtaacatctttcttcactccgttcagttctattgtatcattaagaaaaaaagaaagcattaccacgctctcatgtgcaacggcaatgcttcaaaatatcagctccaaacatcatctttcgagaagaaaccaatcggctggcgcgtcatagtcttcaactgagcttttttttcattgatcatttcagtcagactatccgtaaaattctctaaaatcacgcgtccgcctttataagcatatccaccaatcttcattgtttcatctggagataaaatcacttttcgatgggagatattcttaaatagctcgtctaaaatataatttggcagataaaaactattttgcgctgaaaatgattggagatacgcaaaatcgtcaatcgtgatataacaatcatcaaatgcatcaaagctgacatattcttccatcagcgttgtccgtttttgcaagatctcgttgatctttttatttaattgattcagcgtctcgatttctttgactttcaattccaattcacgtctacgctgttctttattttccaagtgacgcatttgcagtatcatgccgatatagacaactacagcacctgtcagcactccgataaggccagtaataccaactatcaatctgttgttcctccttgttttgtttctctgcttatcataccataaagcgggtttatgcgactaatttgcctaagttttttatttgaccttttttgaccaaaaatgtatactacattttaggtattagaaactaaattatggtacactatttctaaacgaaatcaaggaggaactctattatgaatttaattcctacagtcattgaacaatcttcacgaggtgaaagagcttacgatatctactcacgtttattgaaagaccgtatcatcatgttaagcggccaagtaacagatgatcttgctaattcgatcatcgcccaattgcttttcttagacgctcaagattctgaaaaagatatctatctttatatcaattctcctggtggttcagttacagcaggtatggctatttacgacacaatgaactttgtcaaagcagatgtccaaacaattgttatgggtatggctgcttcaatgggaagcttcttgctgacagctggtacaaaaggtaaacgatttgctttaccaaatgctgagatcatgatccatcaacctcttggcggcgctcaagggcaagcaactgaaatcgaaattgcggcacgccatattttgcaaacacgcgaacgcttaaacaaaattttagctgaacgcactggacaaccgcttgaagtgattgaaaaagatacagatcgtgacaactatatgacagctgaacaagcaaaagcatatggattgatcgatgaagtcatggaaaacagttcttcattaaattaatctgtttcaaaggaagcttttttaagctctcttatctaaaccaaataaaaaaggatggtcaactcaaactgaccatccttttttattttatggatgctactgcctatctttgctccttgaattttccttgcgcatgcatccgacctatctcgacataatgctggatgttttctttgtttttttgtatttcttcttttgtcaaaggacggatcactttagctgggcgaccaaaagccaagacattaggaggaataacttttccttctgttactaatgatccagcaccaatcaaactattctcaccaataaccgcatgattcaatatcgtggtccccatcccgatcagcgcccctttttcgattgtacagccatgtagcatgcactgatgtcctaccgtcacattctccgcaatatctacaggtgcatcatgatcgacatggatgattgtaccatcttggatattcgttctttgtcctatttttatccaattactgtccccgcgtaaaacagcttgataccagatcgtcacatcttctgacaatgtcacatcaccaatcactgtggcatttgatgctataaaccgttccatatttatttttctcctttcattttttgtagaaactaatcctattgaataaaggtatcatagcatatatttatttcataagaaaaaaaacaggtaaaacctgctcaggccagatgtctatttacagtatctggtaactgacgttttacctgtttttattgtacatctatattttcttctattactttttttaaaattaattcgtacacttctatttgtgctgccaagcgttcgatttgaaactcattttcaaaaaaatcagctgaatcaaaaggcttcgtctgacagacgtgcgttaaacgatcaacttctcttttggcttcagtaattttttcatttaaaaactgttccatctccgtgtcctcacttttcttgataactttactttaccattatcaagaatagagaacaaaaaataagttttaaactgttttattcttatatgacttattctgcttcctcagcaaattggctgttatacagtttttcataaaatccaccttgtgccaataaactctcatgcgttcctttttcaatgatctgaccttgatccatcactagaatcagatctgcatcacggattgtcgataaacggtgagcgatgacgaaacttgtccgtccctccatcacgcgatccattgctttttgaatcaacgcttctaaacgggtgtctactgaacttgttgcttcatctaaaatcaagattttaggatcggagaccactgctcgggcaatcgtcagcaactgtttttgtcctaaagacacattgtctccctcagaattgatggccatatcatatccatctggcatcgttcggataaaatgatctacgtttgctgttttcgcagcatcaactacttcataatctgtcgcatcaagctttccgaagcggatattatctgcaatcgttccttgataaagccatgcatcttgcaagaccataccaaatagcgaacgcacatcactgcgactcattgatttggtgtcgattccatcaatccttattgctcctttgtctacgtcataaaaacgcatcaatagattgatcaatgtcgtcttgccggcaccggtcggaccgaccacagctacggtttgaccagctttcacttcaaaattcaaatcttggattaatggtttcttcggatcatatgcaaaatcgacatgatcgaatgtcacatctcctaaaatcgtttctggcagtgaagcatctactttgttttctttttcttctggctcatctaaaatctcgaatacacgtttcgttgccgctgatgcactttgcaaaactgaagacaattgtgtcacgttccccattggctgactgatttgccaaatatattggatgaatgcttgtagttgaccgacaacgatcgccccagtaataacataaaagcttcctagaacagccataccaatataagtagcataggcagttaattgaactagaggcatcatcaagccagaaatgaatgctgcacgaaacccaaagtatttcaagctgtgattaacttttttgaatccttccaatgtttctttttcgcgtccatatactttcaatacactaaaacctgtcatattttcttggacgtagccgtttagctcaccaagagaattctgcatgctttgaaaatatttctgcgaagcattgatcactcgttttgagatccagatcgatgttggaatcatgatcatagagatcagcgccatcatcggctggatataaaacatcattgctgcagccaacgtaattcccaatatcgcatttacgataccaataaaagcttgttgtaaagcaccgctgactgcatctacatcattcgtcacacgagacaaaatatttccttgctggtttttatcgaaatatgaaaccggaagacgattgattttttcttctatgtctcttctcaaatcatgcatggcactttgaacgacatttgtcatcaaaacaccagaaagtaattgcgaaatacaataccctattccaacaactgtgatccaaatgagacatttgaatatataagaaaaattgattgattcgccattggcaatattacggctgatttctgtagtaggaagtcctgtaacatatggcaaagccacgttgaaagccactgtcagaactgtaaataggatcactaaaagaaaagtctcacgatacggtctgatatatcgagctaaacgttttaaggaagaaaaggtttttttcatgctaattcctcctttgataattgagaagcggcaatatcataataaatcgggcatttttccaacaactcccgatgcgtccccataccgacgacttctccttcatttaatacgatgatcttatctgcatgcatgatcgttcccacacgttgtgctacgatcaatacagtagattctgtcgtttcttttttcagacgagcacgtaacttcgcatccgtttgataatctaatgcagaaaagctgtcatcaaaaatatagatttccggacggcgtatgatggctctggctattgccaatcgttgtttttgtccacctgaaaaattggaaccaccttctgataaatgttcattaaatccatctggttttcgagaaatgaattctgaagcttgagcaatctcagctgcacgttccatttcttcttgcgtagcatcttctttcccgtatcgcaaattatctgcaatcgttccagtaaatagcagcgctttttgcggaataaacccaatcttatctcgcaacttgcttagccgataatctctcacgtctactccatcgatcaagatctttccttcactcacatcataaaagcgagggatcaattggatcaacgtagattttccgctaccggtacttccaataaaagcaacggtctctcctggagaggctgtaaaactgacatttcgtatcactggctcttgcgaatggcctggataagcaaatgttacattttgaaattcgatataccctttagtttttgtatcagatataccatttggatcttctacaatcgaaggtttggcatctagggcttcttggatacgtccagctgaaacagctgctcttggatacatcatgaacacactagcaaataacatgaatgagaacaaggcatggaatatatactcgataaacgcaatcaaatctcctacacgaagctcgcctgcatcgatttgcactgccccgctccagatgatcaataccattacgatattaaataagaaataaaaacccggttgtgcaacagccatcaaacggaataagctttttgaactagaagcataattctcattgactacagcaaaacgtttttcttcaaacttttcattgacgaatgcacgaatcacacgcaatcctgaaagattttcccgcaagatactgttgattttatctaagtttttttgttgctttttagataacggttcagacaccttagcaatcgctacgactgccaataatagtaaaggtaatgcacctactacatacaaactgagtgtcacacttgtacgcatgaccatgtacaaactgacaatgaacatcattggtgccataaaaccgatacgtaaaatattttgcaggaacaacatgatctgataagcatcgtttgttgtacgagtgatcaatgaagatacgcctagattttcgtattcctgatgcgaataactttggatcttttcgaacaaatcatctcgaatatctgctacgatattagtcgtaatcctcgaaccaaaataacctaacaagatattcaaaataataccgattacagtaataacgatcataaatatcccttgttgcttcacataatcaaaatcatcattgcggattcctacatcgatcatacgtgctaaaatcgtaggaagtcttaattcaatcaaaataaaaccaaatacgcatatgaaattgaaaaacaagaatttcttataacgcatggtataatgccacattagtttcactttctcatctccttttaatcttttgttacattttcattactaaaaatgatagcacaacgagcctattaatagaacacttctctcataaaaaagtcattatgattatagcgggatgataaacattgattttttctttcaatctagttgatttctatacttatttgctgttttatgctagaataacaattaattgttgtatattttttatacagaaggtacggttgaaaaaatatccgaacagataagcaaaaacgaggcttgtctctttgactcgaatccagtattctagtcaaagcatatgaaaaaccaggtggcttgtcccctcgttttgtgttgtctaaaaaaatcaactagctaaatcactgctttacgcagataaaggagacaaaacaatgatctataaagtttattatcaagaaacaaaagtacgcaaccctaaacgggaagaaacaaaatctctttacattgaggcaaaaagcgatgtagacgctcgccaacgtgtggaagaaaataccccatacaatattgaattcgttcaacttctagaaggaagtcatctagagtacgaaaaagaaaatgctgatttctcattagtggagttttaatatgaaactttccatcaaaaataacgagacaggcgtctttgctattggtggattaggtgaaatcgggaaaaatacgtatggggtacaattccaagatgaaatcattttgattgatgccgggatcaaattcccggaagacgatttacttggaattgactatgtcattcccgactacagctacatcatacaaaacttacacaaagtaaaagccttggtgattactcacgggcacgaagaccacatcggcggaataccctacttgctgaaacaagcaaatattcctatctatgctggtcctctcgcattagcgttgatcacaaacaaattagatgagcatggcttgcttcgagatgcagagctccatgagatcaatgaagatacgatcatccgttttagaaagacttctgtcagctttttcagaacgacccatagtatcccagatgcattagggatcgtggtgaaaacaccttctggaaatatcgtagcgactggagacttcaaattcgatttcactcctgttggcgaaccagcaaacttgcataaaatggctcgtatcggggaagaaggagtcttgtgccttttatctgatagtacaaatgctgagattccaacatttactaaatcagaaaaaacgattgggcattctattttgaagatcttttcaaaaatcgaaggacgtatcatttttgccagctttgcttctaacatcttccgtttgcagcaagcagcagatgccgctgtggcaactggtcgtaaaatcgctgttttcggacgaagcatggaaaatgccatcgtcaacggtcaacgtttaggatatatcaaagttccagacggcacatttgtagatgcacacgaaatcaatcgcttgcctgccaatgaaacgatgatcctatgtacaggttctcaaggagaagcgatggccgcgttgagccgcatcgcgaatggtactcaccgtcaaatccaaatccagccagacgatacagtgatcttttcaagttcacctattcctggtaatacaacaagtgtcaatcatttgatcaatttgctgtctgaagctggtgcagaagtgattcacggaaaaatcaataacatccatacttccggtcacggtggacaagaagaacaaaaattaatgcttcgtttgatgaagccaaaatattttattcctgtccacggagaattccgcatgttgaaagtacatgcttctctagcacaagatgtaggtgttcctgcagaaaactgcttcatcatggaaaatggcgatgttttagcgttaactagcgattctgcgcgtcctgctgggcattttgtggctggagatgtgtatatcgatggtagcgggatcggtgatattggtaatgtcgttttacgtgaccgtcacctgctttcagaagaaggtcttgtattagctgtcgcgacagtggatatcaagaaaaaagaaatcttggctggtccagatattctctctcgtggatttgtctacatgcgagaatcaggagaaatgatcaatgaagctcagcgaatcttattccacgctttaagagaatgtttgaatggacctgactgttcagaatataaattgaaagaagcgatgactggcgcgcttcagcctttcttattcgaacgtacagaaagacatccaatgattttgccaatggtaatgacaccagatgaagaataaataagaggttatgaaatcagcaccttgtcctgaatataagagaaaacaaatgaaaaacatgagaagccatttttgtttgttcttattccttgatacaaggtggctctttcatagcctcttaaatttatttactttttcatacaaaaaaatacctgccacaagagaaattgtctcttgtggcaggtatttttgttactcgctttgttctctcgtaaaaattgatgtctaccatcaatttgatttacagataaaattaagcttttacaacgtttgcagcttgtgggccgcggtctgattcttcaacgtcgaaagtcactgcttgaccttcttctaatgttttgaatccgtcaccttgggatagctgagaagtgaacgaatacgtcgcttccatcttcacgtgagataaatccaaatcctttttcagcgttgaaccattttactgttccgttttccataataatatcctcctcgtgccaaaagcactaatttaaattgtaacattgctcgtgtacgatagaggtgcaacagatgtttcaacttctattcccaaacaaaattacaatataattgtacacttgcttcattttttttgcaagaaagcaacttacttctcttccatcattccttcttctctcaaactaaaatatcgtttgcgtccgatgatcaagtggtccagtacagtgatccccatcatttctccacacttttgtatccttttggtaaaattcatatcctgctgcgatggaataacattaccagaaggatgattatgcgctaaaacgatccttgctgcacaataacgtacagcataatggaaaatttctctaggatgagcgactgactgattcagcgaaccgatgaacactgttttttttaagatcacttgattcttcgtgtccaaataaatacaaaccaaatgttcttgtttgtgatctttcatttccagaatcaattgctgggccaattcgtagctggtacgaaccggtggagccgctctttcatgatccgtctgaattcgtcgacctaattcgatcaaggctttgatttcgattgctttcacgcgtcctatccctcgaatctcttctaactcatgcaaagtagcctgtcgtaaagaggccagtcctccaaacgtttttaacagatttccagcaatcgacatcacactataagggtgttgaccggtacgcagtaagattgccaaaagctcctgatccgataaagcttccgcgccataaatttccatacgttcccttggtaaagagctagtaggtacttctttgatcaatcgttttcccaaaaaaacatctcctttctatcttatctaaaataagatacgaaaagagatggatttttattttaacaatgcagggatttcatgtaaagaagaaacaaccccagctgtttttttgatcaattcttgggatggtggaagcagatctggtaccatgactaccgggatctcagccgcagaagctgctaaaataccattttgtgaatcttctaaaatcaatgtttctttcttcgctgtacctagcttctgattagctaacaagaaaatttctgggtctggttttgctcgttgaacattttctgcagaaacaatcgtctcaaatcgttcaaacagattgttcttcttcaataaaagttcaatgactgctcgttggttactggaagcgacaactttgggaatctgatgttcttctaaaaaagagaggagttccaacacaccgggcttcatttgtaccgctccttgcgaaaaacgttcaagcgtttcctggtatgaatcatctatgaatctttgtacacttgttttgccaaattccgagaaaatcatatgataattcgcccatacttcttcatctgaaacacctaagaattttaaatacaggtctttatcataaggaaaacccatcttgtctgctactacttgtgtggcttcgtaatacactaactctgtgtcgaacagcaaaccatccatgtcaaaaatcactgcattatacttcatgatctcctcctaattgtattaataaatggcgaacttctgaaatgaaataaagtgaaccggtcacaactaatacgtcttcatttgtcatcttttccaatatatctgctaatccgaattgccacaatgaaacgattgatactctctcacttgctaaatctgatacttcacttaattcgatggcttttggatgttcaaaggtcgtcaaataaatatggacatttggtacttgctgcaatcgttctagcatttctctaacatttttagttcgtaaggcggaaaacaaaatgttgatttgatatcctttgaattcttttttcaaattctcaacaagccggttcattgcatgcgtattatgggcaccatctaaaacaactaatggctcgttactcaaacgctccattcttcctggccatcgagatttcttcaatcccttcaaaacatctttttctcggaaaggcagcttttccaattgacagtaaacaaaatacaattcgatggctactcctgcattttcagcttgatgttgccctaaaagcggagtggttaattgagggatctttcctatttcattaaaaaattcaaatacttctccccacatctcatcaggatgcagatagtttattttataattttccccgtatacataaagcggtgcattttttgctttagctgtttgttggatgacagtaaaagcttctggggcaatatttcctgttactactggaacgccttgtttgatgattccagctttttgtgcagcgatttcttcaattgtatctccaagtatttcggtatgatcaagtccaatcgttgttattcccgtcagcattggtacagctacattggtagaatccaataagccgcctaagccaacttcgataatcgctacgtccactttcttcatcaaaaaataatcaaatgccattgctgttaatgtctcgaattcagtaataccagctactgcttcaaattgatcaagttgtttgatcagtggctgatatttttttacaagctggatcaaatcattgtctggaatgcttttgccattgattgcgatccgttcattgaacgtttcgatataaggtgaagtaaatgtacctactgtcagcccagcctcttctaataggcttctcaaataagctacagtagaaccttttccgtttgttccagcgatatggatcgtttttacttttctctctggatgccctaccacttctaataaagcttcgactcggtcaaggccaggacgtgaaccaaatggtaatcgactatggatccattctattgcttcttcaatcgtcatcaacaattcccccatttctcttttattataacaaatagaacacataagaaaaataaaagtatgacaaagagaaaagaaacagagagaggaacgattttatcaactactttattgactcttgatacatgatccacctccctccttctcctacataataagagtagactaaaaaagagatgcgacaaaatttatgtcacatctccttatgaatcgaagctaagagtgaggctcaaactctttcctgtaacgatgttcaatcagctagcttttagtaatagctagctgatttcacactctctttttctattcttattgaatagtacgcaaactttcgattcgttctttgacagccgtttgcttctctaaataatctttttcttttgcacgctctgcctctactacttcttccggcgcgttagaaacaaaacgttcattagaaagttttccttggacacgttttacttcgcttgtccacttttccagttctttttctaatcgtttgatttcttcttcaatattgatcaatcctgctaacggcaagaagatttctgcacctgtcagaacagctgacatcgctagatctggcgcagtgatctcacttgatatcgtcaactcttcgggattacagaagcgttcgatatagcttgtattttcaactaaaaattgatcgattttagcatcgtttgttttaattagcaacgtaattggtttagacaatggtgtattcacttctgaacgaatatttcgaacggctcgaatcaattctttcaatacttccatccctttagaagctgtttcatcatcaaactctggacgtacaacaggatattctgccactactagagaatttccctgatgaggaatatgttcccatatttcttctgtaacgaatggcatgattggatgcaataaacgtaggatctgatcaagtgtatggactaagatgctacgggtggtttgttttgaaacagcatcatctccataaagtacttctttactcatttcgatgtaccagtcacaaaaatcatcccagataaagttatacagttgtcgacctgcttcaccaaattcaaaacgatcaaatagctcagttactcgttcgatcgtttcattcaaacgagtaaggatccaccggtcagccactgatttttctccagataaatcgatctcttctacggtcattccttcgatattcatgataacgaaacgtgaagcattccagattttgttgataaagttccaagaagcatccattttttcatagctgaagcggacatcttgtcctggtgcagaaccattcgataagaaccagcggagagcatctgctccatacttttcgattacttccatcggatcgattccattacctaatgatttactcatcttccgcccttgttcgtcacgaatcaatccatgaatcaagacattctcaaatggacgttcgccagtaaattccaagctttggaaaatcattctgcttacccagaagaaaatgatgtcataaccggttactaaagtgctagtagggaagtatcgcttataatcttcgctttccgtatctggccagcccattgttgagaaaggccacaaagctgaactaaaccaagtgtctaaaacatcaggatcttgtacccagttttcactatccgctggtgcttccatccctacatacatttcacctgtttctttgtgataccatgcaggaatttgatgtccccaccataattgtcgtgagattacccaatcatggacattttccatccaacgtaaaaacgtttgattgaatcttggagggaagaattccactgcttgatctgtttcttggttatcaatggcttttttcgctaacggcgccatttttacaaaccattgagtagacagccgaggttcaacaacgacacctgtccgctcggaatgacccacactgtggatcatcgtatcgattttaatcaatcgaccgatttctttcagatcttgcacgattgctttacgagcagcaaaacgttccattccagcatattttcctgctagttcattcatcgtaccatcatcatccataacatttacgcgtggaagatcatgacgattacctacctcaaagtcgtttggatcatgtgctggagtgatttttactacacctgtcccgaattccatatctacatattcatctgcaatgattgggatttgtttattgactaaaggtagaatcacttttttgccgatgagcgcttgataacgctcgtcttctggatgaacagcaatcgccgtatctcccaacatcgtttctggacgggttgtcgcaatttctactacgcctgatccatctgctagttcatagctcatatgataaaaggcgccttcgatatctttatgaataacttcgatatcagatagagctgttcgtgcttgaggatcccagttgatgatatattcaccacgataaatcaaacctttttcgtataaggtaacaaaaactttacgtactgcttcagataatccatcatctaatgtaaaacgttccctactgtaatctaaagataagcccattttagcccactgttcgcggatgtggctcgcatactcttctttccattcccacacttgatcgatgaacttttcacgacctagatcataacgagaaatcccttgctctctaagcttcgcttctacttttgcttgtgtcgcgattcctgcatggtccataccaggcagccataaagtatcatatccttgcattctcttttgacgaatcagcatatcttgcaaggtcgtatcccaagcatgccctaaatgaagttttccagtaacatttgggggcgggattacgattgaataaggttttgcttttttatctccgctcggtttaaacaaatcttgttctaaccaatgctgataacgtccagcttcaacttcttgcggattatattttgttgataggttattttcttccgtcatgctgttttcctcctttaaactaaaaaacgtcctaaaatactttcgtattctaggacgtatgatttacgcggtaccacctaaattgcaataatcaatcattattgcctctcaagtgagttaacgatcacgactcgtctatctctactccattcaagacagaaactcccaagctaccttcactggttgtcattgagaacctttcagcagatagttctctctctaagaatgaatgtgccagttactcctcttgttcagcgttatgcttcattctacaatggtttttttttttagtcaacaagtggtcgtgaaaaaaccacttcatttagtactaaaaaatttttgaaagaattacgacgagttctcgcaagatcaataagcctactcaaattttcctaagaaaaaacttctgagtaattctcatcaaagtaaataagcgtctgcaactcggttgtcaaatcaatgtattgaacattgacataagctgggacagttactctgtcaggcgcaaaattaagtatagcggttacatttcctttgacaatttcatcaatagcagattgtgaatatttacttggtaccgtagagattgctactgtcacattttttgctttggctatctccgcgaaacgatcaatcggatagatcatttctccatcaattactcgattgatcagtgctggatcattatcaaagacgcacacgatatttagattttcatttcttctaaaattgttgtgtttcaatgctttgccaagatttccatatcctactaatgcgattcgtttttcttctttagtattaaggatattattgaatacatcgataagaaaagggacatcatagccatatccgcttctgcctagctcgcctaattgcgagaagtctctgcggatcgttgcagaaggaatttgggtgatttcgctgaactcatttgatttgattctacttatacctgagtcatccagcatcttcaagtagcgtaaatataaaggtaatcttttcgcagttgcttttggcagtgtatctgttttttctcgcataacgacgctccttgttaataatttcacatatttagtgtaacatgtttctaacacgggagcaaggttacaagtaggaaggaaaagggtgtgagacaaataaaacggtgttcaaaagcttgcatctgcggtaataagctcaaccaaacgtaaaatatgaggaactatttttgtttggctgttcttattacttgatgcagggcagctttttcgcaacctctgatacacggtgttccagaagtaacttcttcgaaaaataagccgaaatttcacaaaaatttgaaaagcaattttcgtaaattccttcttatttcttgaagctgcccacttctgtcacaacctcgctatttcatgggaaattctcttttttatatcatttatcaactgtagcttgatctctaaataaaattttatttttcagttagtaaaaaagaaccggcttttccataacttcttgataaatggtattcaatcagctaatcttcgacattagttcaaaaacggtaaaatacatggagctattttttcgttttgtttctctaatactctggtcaaaacactattttcataacctcttatagcaattctgaaaattcttcagttttttcattagacgattctgcttgtatctcttccatcttcaagccagctagtgctcgttggatcatttcatctattgctaaacgctcttcatattgatggaccttttccagttgagggcgtgtttttggctgtggaggagcaaaaatcgtacagcaatcttcaaaaggctggatagaaagattaaatgtatcgatctgttctgctacttcaatgatttcaagtttatccattgtcgctacaggccgaatgattggcgtattcgttacttcattgatagccaccatactttgcaaagtttgtgaagccacttgacctaatgattcaccattcaaaatgactaaaccatgacgaatacggcgaatttcatcggtcaaacgcaacatcattcgacgagtaattgtcatccaatatccttgtggcactgactttttgatttcttcttgaatctcggtaaatggcacttcgataaaatggatcgttcccacataaggtgctagtttggctgttagatcttttgctttttgcagtgcttgttcacttgtatacggcggactagcaaaatgaacagcttcaatttccactccccgcttcatggcaaagtaccctgctacaggagaatcaatccccccagaaagcataagcattccttttccgcttgttcctacgggcaatcctccagctcccttgatcgtttcatacgatagataagcgccatcacgccgaatctctacacgtaatggaatatctggttgacgcatttgaacttggatatgcgggaaaatatcaaaaacagcattacctaatgtttgattcaattcattacttgtcaattcaaattggtgatcgcttcttttagcgataattttaaatgtttctttcccagtataaatttctttcatgatgtcttgaacagcttgtttcaaaacttcgacatctttttctacacgaatacttggagagaaattttggatcccaaatatttttgctagttttggaataactagctgcccgtctgcgccattcaataaaagatgcatccggtcccgatcagcatggattttgatttctggaaagtctttcaaagcttgtctgacattttgtgctagttgcatgataaagctttttcgattctttccttttgtcgaaagttccccataacggaccataatttcactgtatttcacaagaacactcctcttttaattgattgcagaaaatttcttataaagctgcttgaaaataatcataaattgctcgacttctgcaagcgaattgttttcatctaagctgattcgaacagcagatgtagccagatcatttggtacatgcattgcgtgcaatgtactgcttgccatatgtttacgtgaggagcaggcactagtagtagaaacaaatatttgtttttcttctaaggcatggacgagaacttcgccgcgaattccttttagagcaaaacataaaatatgcggtgcatagtcagttccttctgaaaaaatcgtcactttctcatacgtcttcaacgcattgattagagctacttttaagcgttgtgtctgctcaggtttttgttcctttatctctaatgataaacgtaaagctttaaccatagccacaatacctggaacattttctgtcccacttcgctgatttctttcttgccctccacctgtcagtaatggtgctaaacgacgaccctttttccaataaatgaaaccagttccccgtgggccatggaatttatgagctgaaaatgttgcaaaatcaactctttctgtcaaccattgcgagaatggtacttttccaatcgcctgaacagcatctacatggaaatgaattttaggaaaatcatccaaaagatcactgatttcctggatgggctgaatcgatcctacttcattattcacagccataacagagactaatactgtctcttttcttattaattctttcaattcgtcgacacgtacaaatccgcgtttatccactggggcgatacttacttcgattcctaattcttttaattgttctgctgtctcgctgacggccggatgttcgactcctgaaatgatcatatgattcccatattctcttttttcgatcatcgttccttttaatacccagttatctccttctgttccgcctgaagtaaaatagatttcttctggttctacatggatcaaatcagcgatctgctttcttgcttgctgcaacaaccggttagcttgattgcctaaatcatgcaagcttgatggattcccaataatccgctgactggtttttacatatgcatctaagctttgcggaaagattggggttgttgcactgttatcaaaatatatcataagaaaccctcttttttgaaattcttttctattataacggttgtccaaggtgctttcaagagcaggtgaaattttcacttgtttcaattttcaaatatacaaaaaaagacaagaacaagacaataatccgtcttgctcttgctggtttactaacttttttgctttatactaagtctggatgattaaaataaaaatcttcgatgcgtttgaaagcaccaggttctactcgctctaatgctgtaccgatttcgtctaatgcttcttgatagtgatattctttattgaataaatagtagcttttatcaattgcttctctcacttcttcgtgtgtatgacgataacgatttgcatattggagcatttgctccgttaatgctgctgcatctactaaatcatgtgtcttcttatctaataattctagatcttcttcacatagagcaactaaacgattgacctcttccatgtttactcgaattttattcaagacaacacttagttcttcaatacggtcagtagcaacaaaaaagaattctaggtaatcattcggcaagccaggcaaacgttgtttttctacaaaacgtttcaaactgcgcaatttgaattcgaatgtatcgatcttttcttgcgcttctttttcgccttttctcaattcatgtaatgagtcgtcgatctctacttgttgcttttcgatatcttctaagactttgaagactgttttatagaacgtgcgcacttctgaataaggaatttcgtgttgacggatctgtggaatcatctgttcattttgacgttccatttcttccacttcggtttggaaacctcgtacacggccaatttcattgtggttcaatgtatagctttgagatgtgtgatccagctcaatcaataattgacggttattctttgttgtatgtttgatatactctgcaatcgttgattggttagtttttacatatctctgagcttccatttcccgttctaagatatcatataacgaatcaatcaaatcagctgtttcacggttttcaaattcgaccgtttcaacttctgttttttcaagattggctaatgaattttcaattcttcgacttacttttgcgatatcttcagcaagatcttcttctgggaatacatattgttcttccatcaatttctcgtaagtatcactgatttcttcaagttgttcagggaaagtggtatggagctcctcatacagcggtggaatttttttcatcagagcttccacttcatacgtatgtttttctgctttatccaaaacctcgcgggcttcaacagggtctccagaagtgtttaaagtcacaaactgcgtaaattctttttcgatcactttgatctgtttttgcaattcaaaaagagctggtccgtattcatgctcgtcttctctgactttttctttcagttcttcatagacgtcaagtgcctgctgaacagctagtgagttgcgttcttccgtttcccgcaattcctttagaccttcacggatttccgtcacttgtttctccatttggtccattgtagcttctgcttcaacaactgctttttttccttttaagaaccgaaaactttcattgaggttttccacttcgaaaatttgactttctagttcagcgaacgaggaagtagatatgtcattccatttttgactccattcacgaaaggtattttggctttgcccaaccagatgcatttttttaacatcatcgacttcttcaatcactggcaagtcaaataattcttccttgcgtttttctaaggcatccaatcgatcttggttttttttcttcatcaagtaactaaccaaaaagacgacaatggcgactataatgattgcaatgacgattccgatgataacattatttcccatttatggttcctccgttttcagtatgcatcttttatgcaacagatggcgttctgcttggcataaatccaaataatacgtctctcgtgcaaaagacatctattctagattatagcatactattttcatgcattcactaacttaaacgaaaatcttttgtttttccatcgtataaagataacaaaaatagtgaaactctgatcactctttttcatttgtgcacatgcctatatcagcggatttcttcttagcaatcgcttcttgaatctgacgttggatttctgccgcgattttaggttctggagcatattccatctgccagttttcaggtttcaacactttatttgttacagggtcataatgaggttttccatctggaaataatttccccatatttgcctgatggacgatttcgaatattcgatcaggcactattcctagtaatgaaaaagaaccataagtaaagtaaaggatatctgtcagtgcatctacttgttcaaccagcggatcacttccccactgtgttttaccaagtattttttcttctgctttatctaatgcttcgtgcagcagcataacagcttcatgcagttgttctttattaggtgaagtagctgcaacaaattcaacaagttcttctattttgaacgcagcacgtgtatgagcttcattttctgtaaaagccgtgggtatctctggtcttcttggatcaaaagttttgtggaatgtttctactttttgaaaaggtgtctctgcttccatactgattttttccttctttcattgactaataaatcagaccgaagtgtttcagtccttcgtatatcccatcttcttcatttgattgagtcacaaagtctgcagcatgttttacttcgatctgagcattccccatggccactccaattcctacacctttcagcatctcgatatcattgtaatgatcgccgaatgccataatttcttccatttcaatttcgacagcatttgcgaaagcttggatgcctagtaattttgaaccaccttttgggatgatatctacagtatacgtatttgaacgctgaaacgtacactcgggaaagcgatgttctaactttttctgttctgactccggactgagcaatatacattgataaattggttcttttaatatctctaacgtttcataacgatccttttgtcggtgagggctaaaaacctggaggatttttttcatcagacgtaccgggaatttacgcggtaaaaagctgactagtcgcttgataaaaatcgattgtcctaatagcatcgtcgttgatccatctaaccgatttctcgcaccaaaaacgatttgtcgatggttctcatctgcaaattcaacaatatgttccaatactttttgttcaaaagggtggtcgataatcgtgcgatctgcagtaaaaaccagttgaccattatacacgacatacatatctaattccaattcatcaatgatttctttgatctttactgggctgcgccccgttgctacaccgcataaaatgccgtttttccgagcatattcaattgcttgttttgttgattccaacgcttttgaacgattggtgaccaatgttccgtcaatatcaaaaaaaatagctttgatcatagacttcgcccctttcttgaataaaataagcccttaaaacagatccatttgggttggattgagtccatctggcttgatatttaatattttttgcagtgctaatgcattttcagccgcatcaccaccagaattattattaaaaatcacacctacctcttttgtcttagaatcaactactttgacttcatgtgctagttcttgcagttctttttctgaataacgatataacgttctttttttacgccactctttatcatttgcttgccatccttgcgcattcctaccatggaatcgaaaaagagcaaagttcggattggtgacaaatggatcaaaaggaatcgttgtattcagcaactgtggctcatcgatgatggctaaagaaaaagcggctctagacataaagtttcttgtacgttcaagaaattcatcgctgtaccaagaataatcccgcaattctatagaaacaggataaccctcaaaccactttctaagtttgcgcaagtactggacattttctttcgtacatttgaatgatgaggggaattggactaaaaagcaaaacatctttccagcatctaccattggcgacataacatctaaaaaatgcgcaatcatctcttcttcggtctgataataaggcttccagtctccttgaccgctgattccttgatagactttgactacaaagcgaaatgattcaggtacttcacttatccaattctcaactgaggactttcggggaattccataataggcagtatctaattccactaagggtagaaaccctgcatattcataaagagtgttattctttttaccagttaatttgtcatgttctttaaacgatgttaatccgattctgatcatttccggccaccttcgtgattgatttccttggctgctttcttgtaaaagaaactcaaccagatactccattgtattaggaggtcaaggttgagtcttttccattttaataaggtcagcttttttatgataagttaggctattcgttattcttcactgatagcaaaactcttttatatagtatacaataagatttaacggctatgcaaaattattcgtaaggaagtctgtaaaatgaaaaaaatacttgtactacacaccggcggaacgatcgccatgaaagaaaacatgctcacgggcggtgttagtcctgatgtggcaaacccattattagatgcagaaatcacaatccccaagcatgtagaattattagttgaagatatcttcaatcttccctcaccacacatcatgccttctcacatgttggtattaaaagaacgtatcttgtccgcttatgcatcaggtatatccggagtggtgatcacacacggtacagatacattagaagaaactgctttttttcttgatacaacgattggcaacaaattaccaattgttttgactggggcaatgcgttcaagtaatgaacttggaagtgacggcctttataattttgaaagtgcgattcgtgtcgcaagttgtgaagaagcgctagataagggggttttggtggtcatgaacgatgagatccattctgcacgctacgtgacaaagacccataccacaaatgttgctactttccgaacacctacattgggtcccatcggcttagtaactaagaatcgaattttattcttgcaggaacttttagaaacaaagcgactggacatttccgctgtagatgggactatcccgatcgttaaagcatatgctgggatgcaaggggacttattggaagccatcgcccatacgaaagtagacggtttggtaatcgaagctttaggtgcggggaatctccctccacaagccttagctgctttggaaaagcttcttgtccaaaaaatccctgtagtacttgtttctcgttgtttcaatggaatcgcagagcctgtttatgattatgaaggcgggggaaaagaactagaaaaaatggggattattttctgtaacagtattaatagtcaaaaagcacgtttaaaactattgattgctgtaaactatggtttgtcgggtgaagaattgatttcgtttatccaaaactaaacatcattatctaatagctaaacttaaaaagagaggctgtgacaaaaatagcttcttcgaaaactaagtcgaaaatttacaaaaatttgagaaacaattttcgtaaatttcttcttatttcttgaagttgcccccttctgtcacaacctcttttttatttatttttccatataatatttgcttcacaatacagctgttcttgcattcggatttcatgttttgttttgacaccattttcgatagggatttgttcaaaatggctttcgatctcattcccgtactctacttctttatcaaatcgaataattactttttctggaacatgcgtagtcaaaaagtcatatcctaatacgtcaatgatccaattaaaatacatcgcattattaacatgctgattactatcgatatcataaaaacgaacacgatatggcaacatgaagcccgaatcaatcttttcaattttttcctgacgcttgattttcttgatcttctcactctcaaaaggagcaatgatctcttcattaacactgctcatttttcgattcacaaaatccatcaatacgaaaacagattctattttgactaattctttcccatcttcatcatggatccagaagttccgataacagaaaaacttattgtactccatggcttgagtcgttactgagattacttcaccgactctagggagacgattaatctccatggaataattcgtgatgacccaagtaagtccaaagctattgacgaattcactgcctcttcccaactggtcgctttgatcttcagacgttttgataactactcctaacatcgaaggaaatgtcatcgtttggttgatgtcacactcataatatgaaacttcatgctttttggtatatttttttgccaaaaacacgccctcctcttaaaaattttctagtaattgatctacttgggaaccgtaactttctccaaacatattcaaatgtgccaaaagataatataactggtaaatcggcagtcggtctttccatcccttttctaatggaaatatagtttgataagcatctaaaaattccggtcggaaaccaccgaataactggctcattgcaatatcttgttcccgattcccataagaaacagctgggtcgacaaaaactggatgcccttgctggtcaaagaacacattaccactccacaggtctccgtgcaagaggcgtggagtgatcttttttggttcaaccgatttcaatacacgttctttaaatcgcagatacttttcttgacgctgtacattccatcgattcgtttcttctgccaaagaaatctgggattcaagccgatctttaaagaaaaaagtccaccaatcttcttcaaaagaatttttctgaacaagtgtacccaaatagttatctttacgaaaaccaaattgtggcgctgtttgctgatggagattagctaaagctgcagcaagatctcgttgatccccttttcccggctcgatccattccattaacaaataagcgccttcacttgtttcacctagcatatacgtatccggtacacgtacgaatgctgacagttcttttaatccgtctacttctgcttcaaaaaatcctttttttacattcggatggatttttaaaaaataagcacgatgttcggtttttatacgataggtctgattaacatcgccaccaacaactggaatcactttaccatttaatttcagatcagataaaacagtttggatatccatgactttcccccctactcccaattttattctacttcgtcatcatatttttaatgataaaaggattatttccaatccttatcctttatttagaattatagcacagggaccataaaaaacagggaatggactttaaagataaaaagagctggcttaagccagctctttttatctttactacatactcttcattgaaatactcgtctatgctaaagcacccattggatcccacggagatagaacaattggttcttcattgaacgcatttaattgctctttcgtcaataaatcttttcttacaacgatttggtacgtatattcgtccatccaggcatcactcataacaaagaagccattctttccaactttttcgccccagctattttcgactttccattttgttgattgcccgtctactaagtcaacaccggtcaataccatcgcatgggtcatcagactttctccaaaatctaaacgttcagctttagtcattgtaaaatccgtatcaaatagatcatccattgaataagcatctaaggccatgatgccactagttctagtagaagattgacctacatcacaaccaaaccaaacagattctccttcttcaagctgagcaatcgctaattttttgaaagtttccatatcaacattcagatatttgacttctttcccgccaacgacatttcctagcatctctactgtataagaacgattgaatggtttgtcttttgttggtgcattgatcacgctaacataatcatctaattttacaccgatgtatttatcataaaaaatttgtggtgtcagtcctcggtcaagatgatagttcttttcttcatcgcggtactcaaaatcgaattcttttggaggtgttcctaatgagatagctaagaagttataaatgctttctagcatttcttctttcttttcttcaatagcgtctaatgtttctccttgagcaaccattttccgtaacactactgcatctttacgcagtaatttgttcaagtagttattcaaatctcgagaatttgaactattcgcactttccggcatcaccgatttaggcacaacgccatattttttgaataatgaaacgatcatatcccattggccgccatcttgttgaggagtagcgagtaagaaagctactttccggctatcgattgcctcttttcctgttgcaatgatgttttcatagaaataatttgccttttcatatttatcccagaaaaaagtgtaattttgtgataattcaaactcttttaaatggaattgattcagcatcttatgacggaatgtgttcagtgcagcaaacatccagcaacgccccgattgcatttgattagccactttccccgtagccaaatctatagaaaataccggtgtattctccacatgtgctgaaacattttcagcagaagcagtaattccgttcttcacaactgcccgctgcaatgcctgctgtttgatatttgcttgaaactgtttgttaaattttgttgtcatatcaggcgtaatagctttcatccaatcatccttccaaatccaagttatacttcgtattttactcttaagaatttagaaatacaatctcttctatgatgaaattttcatttgaatgagaatatacttacaacttcatgaagaaaaatgtcatacggtatacaatagttttcagataaaaaggaatatttctatgagataacgaaaatggcctgtataataaagaagaggcctagaagaacatcatacaataagatagctttcaaaatactcattgaaagaaggaaatactataacgtaagaaaggagatgaataaaatgaaaaacctgattgctggcggctttttgtttgtgggtggtggcatacttatgaatacagataactttgggaatgtcatcccttttcttggtgcagcttgtgctttgattggtgtaggaatgctgatttatttcgtatttagcgatgatgggaagtatggttgattatgagtagccaactctactctttcgtaaagattacaacatacgtgacaaaaacagaaagcttgattcatcataataataaaagaaaaagaaacccaagtgattggatttctttttctttgcataagctttatttactccggcagtaggactcgaacctacgacatcatgattaacagtcatgcgctactaccaactgagctatgccggaatcaagtacatgaatataatatcaatttcttctaaataacgcaatactttttttgaatttttttattatattatcaaagaaaccgttcgcattttttgttatttttattttttctaaaatctgttttcctattagagaaacacattttttcgaaaaaattctgttgacaaatacattaatattcgttatcctattatttgtattaatgataatgccgctttagctcagctggtagagcgcttccatggtaaggaagaggtcgccggttcaagcccggcaagtggcttccttaaacagtgcaacatgttggtttaacaatgtgtctgcgctgtttttttattttatgacgtaagaaatgaatgtttatattttaatagtacaaagaaagtctatatgataactataaaaaggagagcaatatgaaaattgtttttttgcatggtctaggccaagacgaacaatcatggaaagatgtaatctcttatctacccaatagttattcttgcaaaagtctttcattgttcaatcatttaaacagcacagacactgctactttagacgacttaaccaaatacatcgaagtacaattgaatcagataaaggaaccttttattttatgtggattatctttaggcgctgttattgctttaaactatcttgcaactccttctccatatttaaaaaaggttgttttagtcgctccacaatttgagtctcctaatcgcttattgcttactttccagaatatttatttttactgcgtaccttctaagatatttgaaaaattaggtctatctaaaaaacaaacccttaccctacttcgttcacttgaaacattagactgcaaaaaacagcttcgtacatcacgacttcctaaattgattttatgcggtaccaaagatcatgcgaataaaccagcagcaaaacgtttatataaactttcaacgaatggccggctactctttattaaaaacggaaaacatgaattgaatagagaaaagccagaaataatggcacaagctatgcgatcttttatcgaaaatagttaatttaaaaaaagacgacaaaatgtgtcgtctttttatttaccatggtaagaatgttgtcttgttttttcaatacagcttgattgagactagttttatggacaatagagagaaagttattgttttattccagagaatttttctggtcgtagatctactaattgaacatgactgtctaaagaaccacttgggctttcaagagtaaatacacctagacgtggatctaaagaaagggtcatatgttcatccatgtacatttttgaataatcttttatataaacatccccaatatcactatctaattggagtttataatcattttttctctgttctttatcaagaagaagtaaacgaaaactagtatctaaagagcaaacacccattttagaatattccccaacgccatcatctaaatccaatataactgttgcgccttcatcaatatatttttgtaatctttcttgtgcttgttccgtaattttaagatacataactaatacgccctctttctttttcttacaaaagcatgctagcatatattaataaaattatctaaagtcctgctcaaaacaaaaagatgtaagaaatatcttatgatatttcttacatctcagagtgtagacttggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccaatgagaaaaagcatggaatgcgctgcatcaggtatcgaggcttagaaaaaaatcaggtgcatacgatgcttgtttttgccgaaatgagtctgaaaaaattggtcacttagcagtgggagcatatgtcttcatattttttattatacaaaaatagacaaaagtatcagtctacactcttagtaaagaggaaactgatacttttgtctacagtatgatatttcttacatctacttttactccggcagtaggactcgaacctacgacatcatgattaacagtcatgcgctactaccaactgagctatgccggaataacatcagcgtggcgacgtcctactctcacaaggggcaacccctcactacaatcggcgctaagaagcttaacttctgtgttcggcatggttacaggtgtatccttctcgctatcgccaccacactgtggtgttatcttttattgagtaaattttgttcactcaaaactggatttgaagtcacataagtttttttccgagttcttttcttttaacctattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgattagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctgtcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcaacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaactaccatattggagtcctacaaccccaacaagcaagcttgctggtttgggcttttcccgtttcgctcgccgctactcagggaatcgaattttctttctcttcctgcaggtacttagatgttttcagttctctgcgtctacctcgaatgtgctatgtattcacacaatcgtaacatcctattaaagatgttgggttcccccattcggaaatctctggatcatagcttacgtacagctccccaaagcatatcggtgttagtcccgtccttcatcggctcctagtgccaaggcatccaccgtgcgcccttattcacttaaccttatcaaccttacggttggattttgatccttcttctagcgatagaagttagatcaagaaaataagcaattgaacttattaaaaaactctatccagctcacaaatcagcctgtacggcaaaaagatcgatcgtctcataaaatcaaagattttatggccgtccgcctattttgcttcaggctaaacaatttgttcagctttcaaattcaacgcggtgttctcggtttgtattacttacatttacttcaaatatccagttttcaatgaacaaaagtgtttgagagtaaacctctcaaaactgaacaaagtaaaaacaaattgtgtagtctccgtaatattccttagaaaggaggtgatccagccgcaccttccgatacggctaccttgttacgacttcaccccaatcatctatcccaccttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaacctttttcattcaggcggcgttgctcggtcagaattttgtccattgccgaagattccctactgctccctcccgtaggagttgggccgtgtctcagtcccaatgtggccgatcacccgctcaggtcggctatgcatcgtggccttggtgagccgttacctcaccaactagctaatgcaccgcgggtccatccatcagcgacacccgaaagcgcctttcaaatcaaaaccatgcggtttcgattgttatacggtattagcacctgtttccaagtgttatccccttctgatgggcaggttacccacgtgttactcacccgttcgccactcctctttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaaaaatgtttgttgtcttgaattgaatcaagacgccctacacatttggtttgtcttactttgttcagttttcaaaggtctacttcatcgggagtgtttcccgattcgtttttggctgccgtagcaacttttatatcatatcagagagacaagcgattgtcaactcttttttaaaagtttttttcgatttcgtttttcgaaatctttcagcaactcatttatcataacttatcgtttgttatttgtcaagaacttttttgaagtttttttcgatagaatcaagcttcgcaagtggttcttttttaacgactcagttatcttatcatgtcgttagtaacatgtcaataactattttttaaattttttagaaatgtgatataacatccacttcagaatcaacgctgttaaatttatcatgtatttcttccttggtcaactataaattaagcattactttgtgaaatgatttttcgatcaattattattattcgttatacaaccgttttcaacatattttgaaaataaaatgcactaaaaaactatctttagcagaacatttcattgtattttttggaccaaacaataaaaaaagaagtttgaaaaaaattcaaacttctttgttcgcttaatctgtattttagaagaaaggcactccctctacttcgtaagttccaagaacagagcgcatttgacctggttcttcccaaatatatccttcgcctaattcttctctttgattcttttgttcagtttcaaagacaaacaacggaacattttcctctttaatatgtgtatttgtcaattccatcaaactaatcttgctaacatcgatatgaactatttcttttaagaaattaagtatattcgctaaaccagtctttccttcagaaagttccgctaacgcaaattccaacttgtcatcaattgaatggaccaaaaattttttagtaccatcctccaaatgcaacataattgtaccagcaactcttttgcttgccaaaatttccacctcgatcaacttgttctatggcttacataaaaattctagcacattttcagaaaaaatacactttttatttcttattttctttccgttctagttcagataatgcttcttctatccaaataggtaactgctccgcaatagtggtaaatccgatcttacgatttttattcgtgaaatacctttttctgcgatatggaacagctggatttgttttttctaacgttcttaaagataaactgatttttttggaatattcatcaatgtcgatgatctgaactgttactggctgtccgacttttaacaatgaatggatatttttcgtataaccggattgtacttctgaaacatgaataagtccttgcgtctcgttatcaagagaaacgaatgcgccataaggctgtatccctgtcacttttccttcaattatttgtccaattttataagtcatctacttccctctcttcgcatttatcattatactgtaaatagctcaaaaaaagaagcgacgaaaatgactggaggtcttaagatgatcgaatttgataaacagatttcaagaaaagatacagaaagtgtaaaatgggacgcaattgctgagacatatcaaatggatgacttacttcctttgtgggtagcagatatggacttcttgtctcccggtggggtagctaaagcgtttagtgaatacatcaaacatggaatctttggttatgccactctgtctgataaactatatcaggctatcattcattgggaacgccaacaccatgctgtggagttgacgaaagaaaatatcgtttttacaagtggtgtgttaaccagtttagctgcagcagtacaaacttttacaaaaccaggcgattctattttgattcatgacccagtttatcctccattttcctctattatagaaacaaatcaacgtcacatcgttcgaagctctttgctagaaaaaaataatcatttcatcatggacttgtctgacatggagaaaaaaatcgaagaaaacaatgtaaaagcaatgattttatgcaatcctcacaatcctggagggcgtgtttggagcaaagaagaattgaaacagttaagcgaattgtgtttaaaacatcaagtgattctgtttagtgacgagatccatcaagatttaactttattcgatcatacatttacttccatgctaacgattgatcctaatttagatgatctactagttgcttttacttccgcaaccaagactttcaatctagctgcaatcaaaaattcaatggtatttatcaaaaatccagagatgaaagctgattttgaaaaacatttagtgatgaaccaacagcacgaaatcaacacttttggactgattggaacccaagcggcttatgagacgggtggagaatggttaagccaactgattccttatctagaaaaaaatgttcaaacagttaatcagttttttgaacagtatcttccgaaagtgagaataatgaaccctgaaggaacttacttaatgtggttagattttaccgcctatatttcagacgaccaagaattggagaacactcttgttcggaaaggaaaagtcgtattaaatcctggcatcacgtttggtccttccggtcatgggcatatgcgcttgaatattgcttgtccagaagaaactttactggaaggacttaatcgaatcaagtatgctttagagacaatcgattaaatcatttattcaaaataaaaggacgagaccttactaggtttcgtcctttttcataattactccgtaccataccaaactattctgaaatttcaattgtttcaatcactacatcatgtacaggtcggtcttgtggaccacgttgtacatttgcgatttcatctactgtgtccatcccttctagtacatgtccaaagactgtatgtcggaaatctagccaaggagttccgccacctttatacgcttcaatgatttctgatgggaatccagcaccttctagttgtccaagcatattagctggcacatttgtgttatttacaataaagaattggcttccgtttgtgtttggacctgaatttgccatagataaagctccgcgaaggttgaacagttcacgactgaattcatcttcaaaactttcgccataaatactttcgccacccattcctgttccagttggatcgccgccttggatcatgaaatcaggaataacgcggtgaaaaatcacgccatcataataaccttttttggaaagttcaatgaaattttgaaccgtcttcggtgctagttcagggaataattgaacagtaatgtcaccacggtttgttttgataacagcttttggtcctttttcactttttaaatctagttgtgggaatgccatattgtttcctcctaatatttgcatacttcataataataataacataatacctaacctctcgtaaaaatactagatttgttttcttttatttttcatcactagatacattctataacttaccgtttcgatttcgaattcaaacatttttgagaagcattctcaattaaattctgctatagtgtgaaaagggaggaatttttatggaaatctatgacattacaatcatcggtgcaggtcctgtagggatgtttgccgctttttacgcaggaatgcgccaagctaaaacaaaaatcattgacagtctacctcaacttggtggtcaattagcaactttgtatcccgaaaaatatatttacgatattcctgggtatccagcaataaaagcaagtgaattaatcgatcaattagaaaaacaattaactacttttaaccatacattccatttaaaagaagaagttctctcgcttactcgtgaagacgaagttatcgagattactacaaataaaggcatccattattccaaagcagtcattttagctttaggaaatggttcattccagccaagaaaattgaatttagataatgctgaatcatttgaaaaccacggattggattatttcgtgaatgatttgatgaagtatgctggaaaaaaagtcgctattgctggaggtggtgattctgctatcgattggacgttgatgttagagcctattgcaagcgaagtttacttgattcatcgtcgcccggaatttcgtgcgcacgaacatagtgtatcacgcttgaaatcttcatctgtcaacttgcttactccctatctcatcgatggattatcaggcaataatggggaactgacagatatccggttaaaaaaagtgaaaagtgacgagacgattgatttgatgattgattctctgatcgtcaattatggattctcttctaatttagaacatctttcttcttggggacttgatagtaccagaaatgccattactgtaaaatcagatatgtctacttctattccaggcgtttatgcagctggtgacatctgtacctatgaaggaaaagtgaaactgattgctactgggctcggtgaagcacctactgcagtgaacaacgctttacactatattaatccaaaggaacgaactcagcctggtcacagcacaagcttatacgataaaaatcttcgtcctagttgattttttatatctctttgcatttcaagttaaacccgaaagcagtttcttgcatttttttcatgttccgttaacatgaaatagagaaagaaaaaataaagggggagcaataatatggtcgtcaaaactgagactttagaagaaaaggcaagagaactattgaaggaacgtggcgtaactgtagaagatatcgcacaacttgtcatgtttttacaaaaagactatatttctgatttgactttggcggattgtactgaaagtgtcaacagcgtgctaacaaagcgtgaagtacataacgccattatcactggaatccaattagatatattagcagaaaagaaaaaattgatgagtccgttgcaacatattatcgaagatgacgaaggcctttacggtatcgatgagatcctagccttgtcaatcgtgaatgtttacggtacgatcggctttacgaattatggttatatcgacaaggtgaaacctggtattttaaaagaactaaacagccacgatggcgttcatgtccataccttcttagatgatatcgtcggagcgatcgccgctgctgctgccagtcgattagcacacaaagaaccagaaaaaagaagtcgccttactcaataattcaacaaaaaaagaaagaaaacgtctatttagacgagttctttcttttttgtttgtttcaagctattttttcctaagaaaagaaaaacagcaaaaaataattctaataatacaaaaaataagataaagctatgcatgaaaaattcttctggaagtacattgatgattggatcagtaacgggatcgaataaccagtcatcgttgttgaaaaacgtttcatgaaaaaggataaaaaagcgatcaaatcctatcatcatgaaaaaaccgaaaacaactggcagtaacatgccgatttgaaacggacgaatcaaccgccaaagccgatcattcttttgcaaatatttgataaacaaaatactcgggatcaaagtgatgaaaaacacagcataatccactaaaaacaaaattttcacttcataaaagtgatgggctccgctagcagaaactgggaaatctggcaagctgaggatggttttgaagggattattgagataattcattaggtgatcaaaatttttcagtaacgtctcttgatctaaagaagtataatccaaaatttgcaaatgtccgatatcaaatacgtatagtggtcgaaagttgatcgtcacaccaactgccagactgatcagtgtcagaaataggctgaacaatccagcatattccatccactgccatctcgaatttttcatattagaagctccattcatccagtgattgtttcacataggtagctgggataggcaacccaggtacatcttcttcttttgtaaaacctgataaaacgagcaaagtatctatattattgcgtatcccagcttggatatctgtttcatagttatctccaaccatgattacttcttctttttgcagccctaatacttcaacggctttatccataatgatggcttctggttttccgatgtagatcggcggcgtttgggttgctgtctctacaaaagagatgactgaccctgctccaggaagaaggccgcgttcagtaggtatattcttatctgggttcgttccaatgaaagtagcacctttttgaatagcaagtgttgctttaactactttttcataggtcagataattatctaagcctaccactacatagtcaggagcctcttcttcccatgtaaatccggcagctaaaatcaagtcaatcaatcctgcttctccgataacatagacttttttcccttttccatctgctttcataaaatcgattgttgccaaagtagctgtgtagactgtctctggagctacatgaatgtcaaactcatctgctagacgattagctactgtttctggtgacttagtcgtgttattggtaacaaacaagaaaggtaattttcttttttgcaattcttccacaaatcgtttaccggccggtatgggttgtgtcccacgataaatcgttccgtctaaatcaattaaatatcctttatagtccattcatccactactcttccctttttctgatcgtaaatgctgtttttgttttttctacttgtttaggttgttcttgtttttttactttttcagaggtttttgctgactctgtttttcgatttttaataaccggttttttgcgattagatgcgactggtccttttttctcatcgatatacgcacgattatggttttttttcttttttcggcgctgagttgtcttttcttttttaccgccgattctctcgatgacaaaatacgcacaaccaaaattgcaatattcgtaaagatagtcttccaaggaatcgattcgctgatctggatgcgcccgtcgattatccgcttggaaaaatccttttaggcgtagttgttcataaccccaatctcctacgatataatcatatcgggctagtacatcactgtaacgttctccaagcttttctgcattaaatccttcacgataatcggacacaagccgataatgtctttcacctatcaaaaaattactgtcatctaacagtgtcactagctcgcctttgactttttctgctttaggctcctcaacgatttcttccaaagcagctgtcagttcttcggtgactgttgtttcctgttcagctgatgattttttcttagcaatttctgttttatgctcaacgttctgctgttcattttgttttgcagacatgcgttcaccacctatcttttttattataccttgtttttatttgattgggtagtgagctttcaagtaatctcctaccacacttcggataaattcagggaacaaaaattcattttttccagcaatctcaatcgttggaaaaaatggaacaaacatcaaatgatctacggtagtaaaagtataatttttattcagatcgattggcttgttcttccaaaagacttgatggttaatagaatcatatgtgattccattatagaccatctgcccaaaaatcttaccgcgaaatcccattcccttcataggatagttacgtaaaaagttacgatttttttctatttctaaaactaagcggatcagatcatttccacccaatgtgacatttaacaagtgcatcggatgcggcaacgcagtgtgaagctgatcctgattgacccgcccttttggaatttcagttaaaaacagaccactgtttaatattgctgcttccgtctttcctcgttctttcaccgcctcaaaggctacttggataaacgaatgctcattgaagatatctagactcagagaaaatggcaaatctgctacttctttttcttttaataattcatgcccacgttctagataactatttatttcttgttcatcttctgtaaaagctgtcattgtttcggtagggatggctttggctgaatgcttaaggatttttttctcttcatcgatggttaaatggacttcaccgacatactgcccgtactttccagcggctgctatttggacatcattgattacgtgaccttctctgaataaatgatgggtgtgcgatcctaaaataacatcaattgctggtatttcttttgcaatttggaaatcatcctgaatcccgagatgactcatcaaaactaaaacatccacttgtgaacgtaaatcttcgactaattctggcaaaatatcataaggattccgtatgtcccagccattcggattataagtaagcggaaatggagcagtaaatgcaattagtccgattttcgtctggtgtttcgttgtaatgattttatatggtttcgtccatgccggtggctggagcgtatttttatcgaataagttatccaggatgatatcaaactcagcatgatcgtataaatgattcaactcttctttggaatttcctacgccttcattgtttcctatcgtcgctgcatcataaccaacttcattcatcagcaagatattttcctgtccattcgttgcttctgacaatggatgccaacgatccacaaaatcacctagatctactgcaatcgttgtcgttttttctttcttttcgttttctcgtttacgttgatccaaaaaccttctgatccttggccaattttctaaatgagaatgcagatcattcgtatgtaaaatcactattttttccatgtaccctctcgcctctctttatctttatcataccataggcagctttttcttccattgaaacaagctctatttcagagtttttcctgccttgaagcaaattgtataagtacaatattcgataaatcagtctggctaaaaaatcaggaacattcatttttacagtactataaaaataaaaaaaacagacccgaaagtctgttgtcgtttcattataatcagacacatggcggaacctgcttagtgctgcttccttccagacctgacacgcttcacaagcccaccattgtcctagcctttcggcaaagaatagtataccttatttttcattcgttgaccagtctttttttaatttcttttttcgctggcggagctttcggaaaaagtcagtcaaaatcatcccacattcgtcttctaaaatgccaccttctacatatgcttggtggttaaaccgctcgtcctccaaaagattcatcaaggtaccggctgttccgccttttggatcatacgcgccgaaataaacttctgctacacgagacaaaatcatcgcgccgctgcacataggacaaggctctaaggtaacaaaaagtgcagcatcttccaagcgccagcttcccactttttcacaggcttccttgattgcaagcatttctgcatgtgtagtagcatcttgcgtggtttctctaaggttatatcctcttccaatcacttttccatccaatacaaccactgctccaatcggaacttcatgaagcatttctgctttctttgcttctgccaatgcaaggcgcatccatttttctttttctactgcatcaagatttgtatttaccaattacccttccctgcctttgttttttcttgttttactttagcatatgataaaaaggctgtaactaacttttttttctatggtaaaataaatacaagaggtgaacaagatgaaaatggataaattacttgctctttacccacaagcacagaaaaaaaactctccagcatcagaagcggatatcctttcttttgcaattgatgatgcttttatctggatcaaacaagattcattatctcaacaagaaaccagccttttgaaagcgttattccctgtaatcaacgatcaaaaaaaacacccatggtatcactatctttttaaagatgcttcttgtgttcaagaaaaaagctttcgtttgatccagcttcacgtcgaatcaaaaggagaattcttaaaaaaagaatggcaagatactattttggaattatttcgctattctgctgatttctttttttatacagacacagatgcgctcttagtcgaacaaataaaccgtgattatcttgatgctactgaaatcaacggtatttttctatctttagatgctgattttgatacgacaacgtctgtattcgttggttctttccattcacctggcaccgacctcgtccctttgtttgctgaagaaagaaaaatttttttaacagagcaaaacaatctttatactcacagccgtactttttctatgcaagatgtggctttacattactatacaaaagatactgtaaaagatagtaagttgatcaaaagttacatagaactgatcaaacaaaatgaaatggaagtgatcattcaagaattatggaatgaattaggcaatgtcagctctgctgcaaaaacactgtttcttcatcgtaatactctaaaatatcgaatcgaaaaatttcaagaacagtctggtttcaatctaaaaaaagccaacgatttactgttttgctatcttttattgcttcatgaacataattaaagatagattaaaggggttgtgacaataattttgtcacaaccccttatttcgaatgaatagtgttcaaaagctagtttctcttacatcattttttcaacaaaatgcattagccggtcttttacatcttcggttgaatctttgattgaatcaccataaacagagattttcttttttcctgatttgatttttgctaacattcccatcaaagaatccaagtcactatctgaaagaccatctacgatttctagtaatttttcatttccatcaaatttgtcatagacgaatttttttactttcgtccgagtagtcatatgatggatcttttccattacttttcccgatacaacgactgctgtcgctacactggcagcggctgctacgcttaatccgattgttacttttgttgatgttttcataagtatcagctcctttttatctatctccatcatagcatagacaaaaaaataaacgaactaatccactcagtgaaatctcaatcctttagggaaaaagttctttactgttccttttacttgtttcccaaatccgacaggtatcttatctaatactagcaaaacccatccttgattcccatcacgttgaaatgtttctcctgctgtgtaagattgccattccttttgagtgatcggcaagcaaggtatattctctatcttttttgtagcaagcgctaatgcatagctaggttcaaatcgattctttttgaaatctcctaaatgcaaacctgtacgtacgacttttaaaccatcgagagaaggggctaactcaggaacttcccaaagatggtcgttgaacactaaaagtcttccagtagcttcataatgaaaatcatttgaaaactccgtccagagtttttcctgctcttttgtcatttgcactttacttttttttcgtgtcttcttttctttatgcatctgattttgtccatgaaaagtcagctttgcaacaaaatgtccttcaccctgatctttatgaggccatatacgtattgttttttccaaaccagctacgcttccccattcagaacgtcctgaactaacggattgagtcaaaggaatctcctcaatcgttactggataattttctacaagccagctaatgatctcttcattttcttctggtgcaaacgtacaagtcgaataaatcagttgtcctttattttttagcatttttattgctgaagacaaaatctcttgctgacgtttttgacagtatagcggagattcttctgtccactcttttattgcatttggatcttttcggaacattccttctcctgaacaaggagcatcaaccacgatccgatcaaaaaagcccgaaaaatgagggacaagttctgcgggtgcatgatttgtcactattgcgttcgaaactccccatcgttctatattttctgataaaatcttcgcacgtttcggaaagatctcattcgtcactaataaccctttccccttcatttgagcagctaattgggttgatttaccaccgggagccgcacacaaatccaaaactttttcaccgggttttgctgcagcagctgttccaacgatcattgcacttggttcttggctatattcatacccagcttgatggaggaaagactttccattgacagtgccaagaaatccctcattgctgtagggagcgggttgtaattcttcgctatggtaagtttggaccatgtccaatcctgccggttttagtggattccaccgaaatccttttttcacgcttccttgttcaagcgcagaaaaaaaatcggatgcttcttcgcctaaaagaagacgatattttttgataaattgctgtggtaacgttgtcgcttcctccttcattccaatgtttcgttagacattttacaatcttttttacgaaaaataaaggtggctgatctactttttcatgttgctgcctaaggtgactgttcctttaagatattttccaagtattcatccgtcacctcgtttttatcccaaacagcgttcatcatttcaagaaaatcttgagaagaatcatctgagcgcaaacttcccaatgcattaagccataccaattcaagcgacttttcttctttgatcttcgtgtgacctttgacatatgagaaaaatggccgcttaaatagcgaatccatgtctaaatcagattttgcaatgatttcacgaatactttcatggatagaaaaaaaatctttcaataagtagacaatgcttaaaacatcatcggaactgcattcagctaagtagttttcaaaataaacagtgatttcttctaatatcttctcttttaacccgctgattgatttgaaatgtgtataaatcgggtatgtagaacaaccgcagaactctgctaactctcttgcagtaattgacttcattccatattcttccacgtataccatacttttgaacagcaaatattctttactataatttgttactctccccatcattcttacctccgtctcttttcatctacccataaataaataacataaataattctaaaaatattattgataattatcaaaacatatttagttatatccattaaaaatcaatttttccgccttaaaaacaagaatatcttgacaaaataccctaggaaataaacaatagaataaacaaggtaacaaaaaaattaaataacgttatataaaaaagaaggcgacactctgtgagaataacacagactgaaatgactttccactcacagtttttgtctaactatatacaaaaacagaataaaaaggaggtatttatgctaattgaagcaagaaaaaaagagttacttgttctacaaatggtcattcaaaaaaataattgttctttacaagaattatccaatgacttacatattccaaaacggacaatcaaagaactgatccgaaaaataaatgtatcactcaagcaatttttattgattgatgaatttatttattctaatcataaaggagagatccaaaccaaagaaaccgatcaaactaaaaagttagctgttttttctaagttaaaattatgctacctaaaagaatccaatcgttttaactatttgatgttactaatcaattatccacaaactgctgtaccaaaaaaatatttacttgaacaactttatatatcgccctcctatctcgaaaaactgacaaaacagctcaatcattccttaaaaaaattccatttacggatcctatctgtaaaaaattgctgtactcttgaaggaaatgagttatctatccgtctctatctttacttttttctttcagatacatttggaggtaacgattggccattttcctcacttgaattaaatgcactaaaaatgaacagtacagatgagcaaatagaaaaaatttcaaaacaagaaaaaaatatctacttgctgttaactttattcatattacgaaacaaacaacaggcatattttccaaaaacttcttctgaaatcactgaattgatggacttattgcagcatacacatgattattcagaatactttacttctttttcagtgagtcgcccttgtgaagagacagaaacagagagagcctactttaattattttttctattgtttttttccaaatcaaatctcttttcgacaaaaacaggagattggttttttattttccacaagcaaaaaccttatttgtcgacaagtcggtcaattgatgacttacttaactcaacagtttcctctcaaccatttagaaaataaaataccaatttatttttattttcttgtgttggcagttgtttttttcgaactgttgggtgaatccagcagtagtttttctacactttgctttccagaagccacgtccaatcattctagttcttttatacaggaaaagaaattaagagaaaaaatcgatacaattttttcaaaaaatggggaaagaaaccaaatcagtcaataccttagtcaattgatccaacacttactacaaacagaaacgaaagagcagttactcatccatttgcagataaccaaacagtttacaggaaattatcatcttcaaagccatttgcagcagttatttcgcaaagatgctgttaaaattaccgcatattcagaacatgctgatttgatcattacagatcagcatgagaaaatttcagatgaaacggagactttctatctggatacaacgcacaatacagtgttatttggcaagttaataaaagcggttcatgaactgtatatgaaaaaaggttatgagaacaaaacaaagaggatgtgacaaaattcttgtcacatcctcttattccaaataaatggtattcaatcagctaactctcggtattagctcagatcaaagcgctgatttcacaacttctttattttaatctcttcggttgccgccgaacaataagatcaagcgcaacagctgcaggaatgtcgaaagcgctgctgcaacataagtcagtgctgctgcaaataatacgtgtcttgccatcggtacttcttcttccgtcagtagtccgccttcactcaaaatttggattgctcgccgagacgcgttaaattcgactggtaatgtcaccaattggaaaagtaatgctaaagaaaaagcgaaaatcccgatattgattaacgtagagttccagctaagcaatacacctaccataatcaaggggaacgaaatcatcgaaccaaagttagctgctggaacaagtgctgcacgaatcttcaatgggacataacccgaagcatcttgtaccgcatgtccgcattcatgagctgctacacctatcgcagcaactgaagtagactgtgcagttgcttgagacaaactcaacatcttattacctgaattgtagttatctgtgagatctccggcaatttgttgaacaccgacattatttatctgttgactttgtaatatatattgtgctgcttgtgtaccagtcacattgtttttgcttctcacttgatcgtattttcggaaagtactattgacgtacgctgacgcaattccggaaataactaatccaagaatgaccaaaagaaatgtcggatctaaaaaaccatacattccataaccatacattttcgtttcactccttttcgtttactttattttatcattagtagtaggaaaagaatgtgaaaagaccttgaatattctttaattctttttcacaaattccgatttcagtttcatcggtccaaatccttctaccttgcaatcgatattatgatcgccttctactaaacggatgttcttgacttttgttccttgtttaatggcacctgacgcaccttttactttcaagtctttaatcactgtcacgctatcgccctctaacagacggtttccatttgcatctaataccactaatccgtcttctatgacagtttcttgttcttctttgttccattcgttcccgcattctgggcaaatcaacaagcctcgatcttcatatgtgtactctgagccacattctgggcaatttggtaatgtcatcttctttctcctttaaaatctttagtgagcactattgtaacggaaaaagaagatcttgaaaagatacatttgtgatttttactacaaaaggcacgttttcgaacgaagtatcattctgtttttctgctcttatacgattggcatatatcttggatctctttatagatttcctctacttctgctaaatcttttgcattcgcaccacttgctaatggatggcctcctccatgatggcgtttagccaattcattgatgatcggccccttagaacgtaaacgtacgcggtaataccctgaaggctgctgaacaaaaatcccccaagccagcacttcgtcaatcactccaggaagtgaaacgatcgaagctgtctctgaatcatcgattccatatttatcaagaatttcttgcggaaggattattcttcctgcaccattttcatccacctggatattttgataaagataaccggaaagtttagcgactttcatcggcatttgttcaatctctctgttcaaagcacttgcatcaaatggataatttctcaatatcgaagcaatctctaatgtacgggacgtcgtggagggatacaaaaagcgccctgtatctccgacgattcctgcataaagtaaccgtgcagccttaacgttcatctttaaagattcaggaaacatcaaagcaaattctgcaatcatctcactacagctacttgcttttgtatttacccacacaagatctccataagggtcatcattgggatgatggtcgattttgatcagtttttctgccaactgatatctttgatcactgattctgggtgaattagctgtatcagtcacgatgactagcgctccttggtagaagacatcttcaacttcttgcatttctgctaaaaagcgaagcccttcaatcgtttcacctacttgacgtatttctttttctgggaaactttcccgtaatagttcggctaatcctacttgtgatcctaatgcatcaggatcagggcgcaaatgcctgtggataatgattttatcgtatttttttattgtatctactatttcttgctgtactgtcatttcactcctgctttctaagaacgttccattacttgacaaacaacgattgctttggaaacgatggtgttttcaataaacacttcgatatccagtttagcggaacgtctgccgatttccaatacacgtggacgaatgtctaattcgctttccaattggatcagccgcaaataatgtaggttcacttgttcaatcaagatatttcgtttttggttcatcaccattgttttttgtgcgacatcagaaatgatttcgctaagtacgccaaaagaaatggttccaacgccattgaccatttgtggtgctactacgaatttgaacttagggttttccaaacgatttccttcacggtcagtatcaatcgtatggatatttccagatatctgatccgaaatcgtatctgcaatctgcggttgtcgctggacaagctgcatcgctttcattacatcttgccgggtaatcaagccttccaatgtcaagtcatcggaaacgaccggcatgacttctagcccatcccagatcatttgatggctaacagaggcaatactcattgttttctttacactgattggttctttcgtcatcacccgatcgatgatctggtttggcgatttccctaaaacatcttttgccgtaacaatccccatcaaacgatgatggcggttgacgactggaaaacgcgaatgctgcgtttcttctgacaaacgctgataatcagaaatcgtatctgtctgctgcaaataatgagtcttttcagctggcatatagatatcactgacaagcatgatatcttttttgatcaattggtcgcttaacgctcggttgatcatggttgcgactgtaaatgtatcataagaggtgcgtaagatcggcatttcaagatcatcagctagctttgcaatctcagcagtcgtattgaatcctcctgtgatcaatactgcggcgccatcttccaatgctaatttttggacttccgcccggttgccgacgatcattagtgatcctggcgtaatatagcgttccatggcatgtttagtcatcgcgccgatgacgaatttattcaagaccttgtctaatcctgccgccccgcctaaaacgtccccttcaatgatcctgacgacctcgccaaatgtcaaacgttcaatatgtttttttaatttgcgttcgatacggatggtccctactcgttgaattgttgaaactagtccgacattttctgcatctttgattgcacggtacgctgttccttcactgacattcaattcttttgcgatgcttcttacagaaattcgattgccaacaggtaaactttcaatatattctaaaatcaaatcatgttttgtcgccattttctgcctacacttccagcgtttccgagacgctcattatttttccttcactatcttccagtaactctacaaaagattcgggatcttgttcaatgacagggaaagtattgtaatggattggaactactttcttggcacgaattgtttgcgcagcctttgctgcatcttctggccccatcgtatagttatcgccaatcggcaagaaagcgacatcaatatcgaattcttctgcaagcaatcctagatcactgaaataagcagtatcccctgcatgataaatcgtttttccttctgcttgaataataattccgctaggctcgcccatatactgaacgataccgtctacttcatagcttgaactatgctgtgcatgtacgaattttaccacgccgaatggaaacgcatgttttccaccgatattcataccgaatgaatctactcctctgctgttcgcataatcagcaatctcaacaatactgataattgtggcttgattttcttttgcaataggaatcatatctcctatgtggtcactatgaccatgagtaatcagcaaccaatctgtctttacttcttctgcagttaagtctgtcaatggatttcctgtaataaacgggtcaatcatcacgcgttggccattttccatttcaattgttaaacaggaatgtccatgatacgtaattttcatattttacacctcgcgttttctctgtatcttttttattaaaaacgatttcatcacttgcacatcaatgaaaaaatatagctgctaaatatattttcattggattgatagtacagtatgtacaaagcaattgtaacagataatacaggatgcaccaagtaccaagcagatataatctcaagtttgaggtctctgctctgcttagcttctcttctcgtcccttaactaattaaatcagcgtaaataggatggacgatcttttctaaatcggctacttttatccgaaggcttctcccgatttcaccgcttgacacaattacttcttctttttcttttaaagaactgtctgctaaaaaacaataatcaggatgtgcgagttttattccaataggggtgtttgctccgtggggatatcctgtatgcattaatacaaaatccattccaggaaaaccaactttacgatctttcgtcacttgtctcgtttttttgtaatctaagtgatcgttcaaaggaatcaatgcgatgatcaccccagttttgtttcctttcactacgagagttttacatatcaaagctggatcaatccctcttttttgtagttcttctgtgaaagattcttctaccacatgactaaaatcaagtggttgatagctgatcttttgttcttctaaataacgttcgacttttgtttgactcatcattgattcactccctttattctatcgtttattataaagcgagggatgctgtattcaaaaattatttgtttttcgcaaaaaaagagcaagacgagcactctatagagaggttcatcttactctttttgtttattttttatttcgacgttgagtagcttccataatgactggcaagatcactgggcggcgttttgtttgttcaaataagtaacggcctaattgatctcggatgtcttgctttaatttgctccactcaaaatcattgctttctaaatgtttctcaacgattgtttcaatcatattgctgctttctttcatcagatcacggctagcttttacgtaaacgaatccccgtgaagtaatttgaggttttgaaatgattttcttttctcgccgactgatagtgacaaccgctacgaaaatcccgtcttctgacaagatttttcgatcacgtaaaacaatgtttccgatatcacctatgcctaatccatcaatcattacattttctgcacttgtagttcctgcaacactcatacgcttgttcttatattccagcacgtctccgcgtccagtaatatagatatttttgtatggcatccctactgcatgagccaaatctgcatgagcagctaattcacgatactctccttgaactggcacaaaatatgttggtttcatcaaattgatcattaattgcaagtcattaggattggcatggccagaaacgcgcatattctcagagatcaacttcactgttccaccagctcgataaatgatatcttccgttttcgccacgatggtttccatcgcgatgcttggcgtagtagtgatataaaccaaatctccttcttcaatcttgacattacggtgtgtaccgtttgccattttttgcagagacttgatgggttcacccattcggccagtttctaaaatgatcagttcttctggatcatagtttttcatgtctttcaacgtaacaagcagatcttcacttggtaattgaagtttttctaaacgcatcgctgtgcgaataattcgttcgaaatcttgaccagtcaagacaacttttcgttgtgctttttctgctgcatccaatacttgttgcactcgttgcaaattacttgctacacaagcgacgatgatacgcccttcccaatatttgatcgtatcaaatacttcatctgctatttgggcttcagaagctacaggctgaggattttctgcatttgccgattcacttagtaaggctaagactccttctttgccgatttccgccaatcgtgcataatctgtttgatacattgggatagccgtttggtcaaatttaaaatctcccgtataaacgatactaccttcttttgttttcagattgatccccactgaatctggtatcgtatgagtggtacggaaaaagctcactactgtttcaccaaagtctatttctgtatgctcatctaccacatggaaatccttaaatcctttggctgcttcattacgactgacattcaattttgctaactcgatcgtcaactctgtcccgaatactggtacagaaatttttgacaacaagtaaggaagtgccccgatcgcatctgcatgtccatgtgttaaaaagacaccagctacacgatcaatgttttcttctaaatacgtaaaatcagggattacgacgtcgatccccaacaactcattttcaggatattttagcccacaatctaaaataaaaatatcctcgcccacttctgcgacatacatgttttttccattttcacgaacgccgcctaatgggataattttaatggtactcacaaacttcacctcttcttatgacatccaagtttaaagatgtcgattttcttctttatctaaatatatgagccattccaatgaagcatatgcaaaatcactatttctcaacttatggagaatcagcaggaaaattaccagcacatccgcgttctgacagttggatgggcattttattttggatatacttcattaacaaaatggatcttttgcgaaacgctatagccagaatacttatataagtattcagctgttccccattattatacaacaaataaactaaatcgctagtatcagcaattgttagaacaactatgcacgtaaaaatccctctgtagcatctaggatttcttttgctattcctctttcatttcttcttcgtcggtttgaaacatacttttttcattttaccacattttttgcaataactatagtgactttttatatatacagaacctcatgttgatggtgtgcaaacagcataagatttaagctagctttaagataggttgtctattatcaaatgcatctactaggagggatgcaaaatatgaattttatgaaacgtgcatggaaaagtacaaaagtaaaatggggacgttcattgttattgtttgccgtgttcacagccattcttatttttgtgctagctggcctcacgattcgaagcgctgcagaagaagcagcgaatcaagcacaaaaagaagttggagcaacagtgactttaagtgccaatcgagaagcttcatttaaaaaacaggaacaaacttcttcaagcggttctaccactgaagaacgtccagatccaggcagtttttctcttacaccagtttccttaacggacgcggaaaaaatagctgaattagataatgtaaagagttattcctttgaaagttccgcctcagctatggcaaaagatggaataactgccatcactagttctgattcaagtgaagacagttcagaaactactgatgcaggcggtgaacctgctggaggaatgggcgggaatccgcaaatgactcaagcagactttcaaatcagtggtgtgtcagcaactgcacaaaatagtaatttttctgatggaacagcaaaaatcacggatggtgaaggaatagatgacagcgacaaaggcacaaacaatgtagtcattgattctactctagcagaaacaaatgacctggcagtcggagatactttcacaatcacgagtactgaagatgaagataccacttatgaaatgacgatcaaaggaatttatgaatccagcgaaacaagcggcagtatgggtatgaaattcaacttcatgaatccgtcgaatacactttacacttcttacacttttgcaaatgaactaaatgggacatctgacgataacacgatagattctgctatttacactctatctgatccagataaaatggatgagtttctcaaagaagctgagaagctgatcgacacagatacatttagcttacaatcaaatgattccatgtatcagtcaatgttggaacctttaaacaacgtggcaagtttttctaaaaatgttgttttactagtggctgtagccggtattatcatacttactctgatcattatgattaccattcgggagcgtcggcatgagttaggcgtcttgctatctttaggagaatccagaagtaaaatcattctccaattgtttaccgaagtggctatttgtatgattcttgcattaggagttgcttcgcttagcggaaacgtcgtcgcgaatgccgtgggacagcagctacttgaccaacagacagaaaccacgacacaaaaccagcaagctcctggcggtggacaaatgccaggtaacagacaagaacaaggcggtcaacgcgatggtcaacaaggaaccacgaataatccatttgctgtttctgatcaagtcagcgaattggaaatcaatgtcaaacctgcacaattgggactattagccggagtagcatttggaatcagtctgttttctgtctttttagcttctatagggatattaagattaaacccaagaaaaatcctattaaactaaaggaggaatttgatgttacggacagaacaattgggattttggtatcaagatccgcaagatgcgctttataaagatgtagaactgaatttcgaagctggaaaaatgtacgctattttaggagcaagtggttctggaaaaacgacttttctttcgcttatttctggactagatgcaccaaaagaaggaaaggtatactatcaagatcgttcactgaacaaaatcgggttaagaagttatcgtaaaaatgatgtctcgattattttccaagcttacaacttgcttccttatttatcggctctagacaacgtcatagcagcaatggaaatcactaagaccaagcaagagaattatcgacaagttgctttagatcgactggctcgtgtaggaattgatgaaatattagcaaaaaaacaggtgaccaaactttcgggaggtcagcagcagcgagtcgctatcgttcgtgctatctgctgtgaacatcaactaatcgtagcggatgagcctactggaaatctagatgaaacaacttcacaagatatcgtcaaacttttccaagaaatcgcccatgaacaaaatcgctgtattatcatcgtgactcatgagattgaagtagcaaaaagctgtgatgaagtctttgaactaaaaaataaaaaatttcaaaaaatcgaagtttaaaaaacaggataatgatcaaataaaaaatccgaaccatatctgtctcgcagatatggttcggattttttatttgcttgattcaattagtaataagtggtttttattttttttcgtcttttcgagaaaacttgtctttgacttcgtcgcctaaatttcgagctttttctttgatgtcagcacctagtgattgtgctttcccttctgtttctttgctcttgtcgtctgttgctttgccgtatgcttcttttccttcaccgactactttatctttcatatctttagaacgtccttttaaatctgccattgtgcttcctcctcttagtttgtttattgatctaccttcagggtaacatcaacaacagatacagacaaacagaacgctcgttttctaaaaaagatagttagagctgttgattaaaaacttttttcgaaagtcccccatactttgacttctttttcttggaccattatttctcctttagcgataactgtatcaatatcaagcgtttctttatccaagatacacagatctgcatcagcaccaatttcgatttttccttttttatccaatttcaatatacgtgctggattactggttatagctcgtaaggcgatttccaaagggatactttctttttgcacagcttctttgatccctactagcaatgccttggcacttcctactcctaaccctaggaaatgattgttttcatcaaaataaggcaagcttccttgtccatctgaggtcatcgtgaaattatctaaagaaacatcttcctcgatcaatcgtttcagtgctttgctgaagcgaacttcaccatctgtcttctcccaaaaatcaggatcttcgctagcagtgaagtcaatcgtgccaccacgtttggcaaatgccacgcaagcttcaaataattctggtgtgcgatttgcatgagtaggcaaaaattgtgtgatcggaatttctgtttcttctacgattcgtgtcaatagctctagctttctttttcctccgcctaagtggacattgatgatcccagcttttccggataacatgcctcctacacgagcatctgctactgcacgagcgaactcttcaaaacttggctgagaagaacggtgatcggatactgcgatttctccgattccgataattttatcaattgtcaaaaagtctttgatgatagaatctgttactgtttttaccggcaatcggtacgaaccttcgtatacataagtggagattccttctgcttccagacctttcgctttgctgatcaacgcagtcatatctctaccttctccgtctgttcccaaacaaccgacaactgtcgttacaccagctgtagtcaattggctcaatgtgacttctggcgttcgattttgataaccgccttctcctcctccacctaaaatatggaaatgacagtcaatgaaacccggggttagtacttttccctcacctgaaagttcttctacttccactccttcgtagccgccttctagctgttcttctacagccaaaatcttcccaccggcaatcagtacatccatttttcctaagtaatctggtgcaaacacttcaatttgtcgaatgattttcatacatttttcctctttctttaagtataactgatgataggatcttaaaaaataatccaaacgataggatctttactcctttgattttaccgtaaaatgacggttcttggagtccttatctactgtttggattacttttttatttacaggtctccagtactactgcagacctattgcaatggcaatcatgatgaaaatagttcctaaaacaaacaggaatccttgcatcttgatttggaatcttgcccattttgcccattcgatccgtgcaacacctagcacaccaatcaagctggctgatacgggtgtaaaagcgtccataaaacctgaaccaagctgataagcaagaactgctacttgtctggatacacctactaaatctgccagtggagccatgattggcatagtcaaagctgcttgtcctgaatttgatgtaacaaccaagttgaacaaactttggaagatgtacatcgcccaagcaccaatgacagctggaacaccggtcaacgccgtcccgatcccatgcaaaatcgtattcaaagctgaaggaacagatgcatcagatcctcccaagacaagaagaatccctttggccatacctactacgattgctgtaccagctaaatcagctgcaccagattggaaagaagaagcgatgtcattgactttcattccatctaatttgaaaagaacagcaatgattccagcaactaatcccatcacaaagaattgagaagcgatttctggaatgtaatagcctttttgagtcacgccccaaacgatccagacaaggacaactaacatctctaataagatcaatttatgcccaagcatgaattttttattttcatcagatgtctttttgatatgagaacggaaataatcatctgatttgtaagtcaacgaactttctggttttttacggattttttctgcatatatcatcatataaccagcggctaatgcagtaacaactacccacataatcaatcggaatgtcgcaccagacaacacggggattccagcaatcccttgagccaccgctacgctaaacgggctcatccaagaggtcgcatttccgacttgagatgcgacataagtcacggttactgctacgatcgagtcatatcctaacgcaatgacaaatggaaccatcaccattgagaatggaattacctcttctgccatcccgaatgtagcgccaccgaatgaaaaagcaaagaataatagcggtaaagctaaacgctccagtcccttagttttactgataaacgcatagatacctgcgtcgatcgctccggtacgcataataataccaaaagcacctccaacaacaaggatcaatgcagcgatccctacagcagatccatacttatctccagatactagtccttcaaaaacaaaatttaagaaaccaaagccgccaaaatcatctgttccccatattttggctgttttatgcaattttttagaagtatcatagatattttcgccgtactgatcgtaaagcacatcatctgtcaaggagatttcatctagtttttcctgcgtaagatttttttctccgtcagcaatgactttttccaatcctttttccggaacatccagtttttcacgttctgctggatgatcttgcagttcttctaattgatcaaacacatacgacttatccagctcgtaagcataacggaaggaatcttgacgtaaaacagtacgagtacttgtttcgccatttgcatctttgtattcaatatcttgcgtgctgaactttcctgctggaacgacaaaagtcagtatccatgcaaagatgactacaccaaaaataatgacatacgtatggggtgtcgataatttagtgaagtcgcgtttcggttttcctgaagaatttgttttcttcaaatttatttcttcctttcttttttcagtaattttgatgaataaaaaatggataatcaaatgaattatacagtaaaaatgacatttccacatgaataatttattagaaaatcacttttttctattttgttttttttctcctatgtatgattatttttttctctttccatttatattaagtattttatttctctgtttttccttaaaattctttttttatttttagattagagaaaatctcgtcctgtttttttcattttacaatcattgaaaaattgaatttcattgcaaaaaaaataataaacacttataaatatccattatctatccttcaatttttgtgtattttatttctattagaaaaaggtatcctgttggacaattttgttatatcaggtaaacttcattgcaataatgataacaaatgtactataattactttgtaaagagttttggggaagactctttcatcaacgtgtattaagagacaagaaagaatccatatggattctttcttgtctctttttccactactttttatttttctgacactacatattcttataactcatttctcataactgtgaaacaacttataaaaataacaaactttaaacaaaacaagcttaaaatcaaagatgatccatcttaaaataactaaaacaaaaaaagtagtcgttgttaatcctcattaataatcgttttctttttttcaaacgctccatttttatgtggaacattatttttttaaggaactttgtcaacatgtggataactattttccacttgtgtcctggactagctgttttgctgtaaaatacaaaacttgctgcagcaaaaagatcgttgcaagagaggctgttccgcagatcgctggatctagatttggcaaagtcaagactgcatcatgtaaattggcgtggttgtccaaaaccaaatcagcaaattcaaataatcgcaaaccactgctatgttgcgatttgatacttcgtgacaaatcaaatccagtaacaatgattaatggatgaccattttctttgatccactgagctagttcgatgattgccgggtttcttccttcattcgaaagaagaagaaaaatgtcttctgatttgacagaaagctgatcaataattgcctgtcctgcaccttctagcgtttcatagacacctccggctggattttcaatcaatatacttggtacaagatccggggtttgatcccaaaattcaaatgctacaccacttagtgtgcggctagcatatatctgcaatctaccaccttgattaatttgtttcgcgatccaagtgccagcttgaagcatcagcggctcttctatccttaatttctcttccaattggtgataatagtcaaaataacataaactcatttatctctcccgcctagctatacttgacatgaatagaaacagctgcctaatctaaggaagtacataaaaaaacagtagttagacagtaacacatgtggtctttgctgtttcaaacacaaaaaaggcattgaacgaatacgcccaataccttgacatagcaaataaaacaacgtgcagaccatggaaaatatctacataggggtagaattttcaccctagattaggtacaataaattaggtcgatgcactgcattgactatggcaaaatgatcggtcagggtgtatgtgtgtgactggtcattccctgattcttagcgccaactaagggtcagggagcctttttttattcagctgtttctatctgaatttattgtaagtaatctcttatccaagtgcaagcaagaaaatacaaaaaaacattggtatgatttatatatatataaataacataaaaaaaggaatggcttatcccgatacaacaagcattcctttaaaaaagattcttttatataagtgaaaaaagcttttttccaccaattaaataaatctctcatctcaatagtttatccattattttatctttttttgcgtatacctactaaatattaccgtcttcttctcgttcttctactttgttcgagagaatctgtactagaaaaagtagttgtatgtctaccttttctgcctatccgagactttcttttcatatatgggatataaatgattagatacagtacagcaaaaaataaagcaaatacgcaagcttcccaactacctaacgccaattcaaccatcaaggtagcaaccccaacggatgctgcataccagataaaaatcagaaacgtttctttttttctgaccatgcgaaacatgataaatagactaataagcaatagtggcaacacaaatatccaattgcttccttccatcagccacttgagtatatcaagcagcgactgtgcaacagcgactaattttcccatagtgaacacacacctttttttataattaaaaaattcgcctttttattctactatgaatcttctggcttggctttcatttctcttatgtaatcattttcttttatacaacttaaaaaaattaaaccattagcataatattttctgaatctattcacgaaagtctttttctatctttcgttttccacgactcaactgatctagagtcaaaaaactaaaacgacagttgcgcaaatgacgcacaagctgccgctttaataacaaatagcctttcattctcagcaggccacttatttccagttaactttctgttcttagctttttactcaactggataatatatgcacttaatgaagtcccaatttccgaatgttgaagtccatattcaatatttgtcttcatatatcctaacttatcgcctacgtcgtatctttttcctttaaactctctcgcatagaccgcctctgtctggttaagagtctgaagtgcatccgttagctgtatctcgtttcctgctcctggttcttgagtttctaatatctcaaatattttaggagtcagtagataacgtccgataatggctaaattacttggtgcttttcccatttcaggtttttctacaaacccttttactctgcaacgacccttttcgctatctgttttaggatcaataattccgtatttagatgtttcattttctggtacacgcatgacggcaacagcggaagcttgtgtttcttcataatccatcatcaattgttgagtcaatgggatatcatctttcatcaaatcatcccccagcatgacgacaaacggttcatttcctataaatgcttttgcttgaagcacggcatcccccagtcctcttggatgagattgacggatgaagtgaagattgacttgagtcgtttcttcaactaaagcgagtaattctgttttttccttttcccgcaaattgttttccaattcgatatttgcatcaaagtgatcttcaatgggtcttttttcttttcccgttacgatcaagatgtcttcgattcccgaatccaatgcttcttccacaataaactggatcgttggtttatccacgattggaagcatttcttttgccatggcttttgttgccggcaaaaaacgtgttcctagcccagcggcaggaatgactgcttttttgaccttcacttgctgttcctcctaaacgacgattaactattgatcatctatttaacgaagagaaaattcattctccatttttccgtcacgtaacatgatttcttttgctgcttttttgatatcttctccattatacaaaacattatagattgtttgagtaattggcatctcaacacctagctgttgagctagctctactgctgcttttgtcgttgccacaccctcaacgaccattcccatgttttctagaacttcttccagcttatgtccctgtcctaacaagttaccggcacgccaattgcgagaatgaacacttgtacaagtaacgatcaagtcccccacaccactcaaaccgataaatgtcagaggattggcacccatcgcgacaccaagacggctgatttctgccaatcctcgagtcatgattgctgcttttgcatcatctccgaatcctaatccatggatagcgccggcaccaattgcaatgatatttttcagtgctgcaccagtttctacgccaatcacatcattatttgtataaatcctgaaataatcattcatgaacagtttttgtacataggctgctgctttttgatcaatacttgcagctgtaattgttgtgatatcatgtactgccacttcctcagcatggctaggaccagataatacaacaattgcctgtcttttttcttctggaatttcttcagccaaaacttctgagattcgtttatgcgtatcttgttctagtcctttacttgcatgtataatgattggcttagtattcattttaccaataagttcctgtgcgactgaacgaatcgcttttgttggaacaacaaataaaatagcatctgcgttatccactgcttctgccaattctttatatccgataatcgattctgggatcgtcaaatcaggtaaaaaatgctgatttgtatgatacttattgatttcatcaatctgttcaggtacatttccccaaatacggacatcatgcccgttttctgccaatgtttgtgctaaagcagtgccccaagatccaggaccaagaactgcgattttttgtttcatggatattcctccaaataaataattgataatttccattatagtatacatttcttaaagttgggactaatttccattgtttttaagtgtttgtttacttcttttatcgtttttacttgaaataatcaatgatatgttacaatagtctacattttatttttacactcgttatgctttgcttgttcctaagaggaagcagttttgacaatgttactaccagcattactattaggaggttaggaaacttctcctagtgagtattgatttaaaatacataagagacagattgaacatttctaaatctgtcaggtcctgcaacggacagattgtctctgttgacggttgacataggaacttttgttttagtcaacattctggatacaaaacgctatgtaaactggcgcaactcgttgtacttggacttttactacggatccatgcaacaactaaatagtactattgcataacaaaaaatggttggcacccacatgtcccattaaacagattataagttgaactgtagataatgcaaaaaatgtgttttataacgtaattgatgccaatattttaaaaaaataaagggagcagttatcgctgctctctttattttttatattctttttatccagtctatcctaataatcaaactgacgatagtagcggcgtatctctaatggatggcagttcaactgctccacatgagcatcgatgcgttgtgtcactacatgcatcaataagaaagacaaaacacgtccgcgatatttttcactgataccttctactggatagtcttttgtgtctatcaatgtataattgctgcaaatttttggcaaaagtttagccacacgttcagataacactctctgttcatcttcgcctaaaaataatgtgactggggttgtttcttctacgatctctaacgtcccgtgaagaaactcggcagcatggatagatttcgatggaagccagctttgttcttcccagtaacacatggcatatgaataaacagctccccattgattccctgctccaataaaataatgcatactatcacgtcgatgtttttctgcaaatgataagccaaatgcatctgcttttttctctgcttccactaaccctgttggtaaataacgttcgagctgttcatagtattctgaataagcttcgaattctccattcaaatacatcaatcgatctgctgccataaaaaatttgatttgttctgttccaggagctggataagtgaccacaaaatcgcatagctgagacaacttactgttcgctttatcgataaatccaatcagtgtcgctcctactttcttgatttgttctactgctttcactacttcttgagttgtaccggtaacagaggacaaaataacgatagaatcttttgttaatcttttgtttccagtagtgtaatattctgcagcatgctgtacaaagacaggcaagttgcttttcccattcatataagtgacagcttgcatcgaggaagcatacgttccaccgattcctagataatagacagcgtcaaatttttccgcataaagtttatcgatgatttcttctacttgcggacgtaaagctagtgcgccttttattgctttgatttgttcttcttcattgaatttcagcatgatttccacctcttataatttacttttcaagactgtatcaaagtcttcaaaaatctttttgttcaagtcaatacctttagctactgcggttttataagcgaatagttgaaacggaacgacaagcgctaatacagacagatattcatcacattctattgctaatccaagtgttttctcgtttcttgctttttttgtggtaatggtgagagtctctccaacgtaccgactcatatatctttgcaacttttgcgaacgttccttatttacactttccccttcaataaagaatagcaaatgcgaagcatctgcctccaggtatgggccgtgcatataagcttctaactcaaatccttgtgacggaacgcggattgtttcagtcaatttcgtctctgcttctttagctgttccccagtttggaccatatccaatggtgacgaaacgctgtgctaaacgaaataaactttgatatccatcaaaaaattcttccgttttttgaataatcgctggtaaatggttgattattttgcgcaactgttgcatgtagtcttgttctatttttttgctgattttatttttacttattccaattcctatccctaagagtagtaactgtaaaacagtcgcagaatagccttttgtaacgaagcctactgattctaccccggcacctaaatcaataatttgtgcagcttctaaagcaagtggactttgcacgtcatttgtgatagcaacaacaggtaacccttgtttttgtatcatttttactgcttcaacagtagaagcacttttcccgctttgtgacacagcaatcacagtatcgattgaaggagaaagttttccataattgaaaaaataaaaaggttcttgaatatcgacagtaagatcaccataagattccaatgctggcttcgctgctaaacaagcgttataagatgaacccgttgctaagatcagtaaattcactgtttttttcatatgttctcttgtcgaaaaatcattctttttcaagatcgtacttagtacttccttttcttcatagatataatcttgcatcgtaaacattttctctgctccttttttaaaaaatccctatccacgaaccaaaaattccaaagaaagctagtccgatcaagatcgttaatggtttcacttctttcttcaatagataaaacactatgccaaatgctccaagacataagatatttggaacgatatcatcaaaaatactttgaacagtcacagcattttctcctgaaccgatttttaaaggaatattgatggtgatcatcgtggcagtcattgctccaacgaccatcagtccaataatagacgcgcctaatgtcaaactttccatcataccgtttgcctggatctttttcaaaaaacccgttcctaagcgatatccccaacctgttgctagatagcgaaacagaatgtgcggaatattgaaaatcaaaatgaacaagatagggcctaaaatatttccttgcatggctaaagaggtacccacacctgtggcaatcaatcgcaaagttccccaaaagaaagaatctcctaaccctgcaagaggtcccatcaaagatgttttgatactatcgatcgcagtcacatcaaattcaggatcatccttattttcttcctccattgcagccgtgattcctaaaatcagtgtaacgatatgtggggtcgtgttaaaaaactctagatgccgtttcaaagctgctgccatttcttctttcgactgatataactttttcaaaatcggaatcattgcataaacataagccatattcatctgacgttcataattccaagaaaactccatttgaaaagaacgccaaaatacgtgatttagctcttttttcgttattttgctgtttttgatctcagaattcttcatcttcttctacctcccctgcagttgtttgaagtggtagttgacggacattcataatattgactaccacaactgctaaaatcgcaccaaaaatagctactccggtcacaggaatctctaagtaagaagctatagcaaaacctaagaaaaaatatggtgcaacttgtttgttgatcagcaaacgagcaagcatcgcaaaaccaagagctggaatcaaccctgtagctactgacaaccccttttgaacgaagtcaggaatcatatttaatagatttccgatcgtattgcttcccaccatataagaaaccattaccacaacaccaagcatcaaggaaagaccgataccggcaagcaagtgcatatgctcgactcctttataatttccttcttctgcataattgtctgctttatggttcataattggaatcaaaagccctaagtaaatatttttcaatatcaatgtcaacgtagcaatcggcaaacctagtaaaagcgcggtttctgtaccggctccagctgtaatagcaaaagccgtccctaaaatcccaccggtcacaacatcaggtggaatcgaagcacctactgagaacgatccgataaatgctaactctaaagttgcgcccataatgatcccagtttttacatcacctaacacgattcctgtaaacagccccgtcacaatcggacgagaaagcaacgatgtccctagtgcatattctgattgtgcgacaaatgcaacaattcctaataagactgcttgtacaatcattgaggttcttcctttcttacaaaacttctcttacatccacttttttatctgctggtacttgacggatttctacttctatttgtttgtcaattaatcgtttcaagcgttcctcctcttctggtaaaatatttaccgcttttccgatgctgcgagtaccaggttttgccttgatccctcctaagttgatggttttgatttctggatacgcttctgccagcttatatgcatcctcgatcgattccactacgatgaataacttatatttatctgtcaccccgcttttcaacgcggcaatcgagtcatcaattgatttgatcactagtttgactccttgtggcttggctaatttgatcgttgtctttcgtatctcattcgtaggtacatcatcattagcaatcaaaatacagtctgcgcctattgtttgtgtccatgaaaaagctacttgtccgtgtaataaccgatggtcgactcttgtcaatacaatcatttttcttcctcctaaaattcgtcttcttctattttctgattgagccgctcgttacaaaactggatcattttttttgaatcagttagcacctgctggatcaaaacagttgtctctacttcagcgtccaaccgagatactagctcaatcaatagtggcaaattcaatccggcaacgagatagacatgatcccgattgatatattgtaagaattcgttgttgacacttccgccaaaaagatccgtcagaacaatgatttctttatctttgtacctcataaaaagctgccttactgtttccgctaaatcaaaattctcatcagtatagcaatcgaatacagtaatagaatgatttttcccatagatcagctctaatgaatctaatatccctgaagcaaattttccatgggaagctaagataatttctctatccactttttcatctcctcttttcacttacacatactaaaaaagcaagttgcatgccaaaattagtggcaacaacttgcttatgttcaaaattcttcttctatcgagagaaactctgtatcttcactcaaaatatcatagatataggcaatctcagaattggggatcatgacactataatgctcttcaatgacactaaacgcagatttaatagcagataacccttctttttgacactgcttccatttctctaatccttgataggtttcgattggcatttgtcggatcaatcgttcaatgagacagctcacatggacatacaacgctaattttttgggattgctgatgcttcgattcaactgcacctctaattctctcataaaatgatcgatttctcccatcaccttctctgtatctagaatagtcacggaatccagtactttttccaatgaaaaattacgaatgatgcgctgattgaatatttccttctctgaagcattcatagtagtgtccaaccattcagctagtacagacatcttttcccccgagatgaggtcttctaatgaaagatagtcgatattggtgatatcaggatctgtggtgccaatcattcctacgacttcgtatatggaaaataatgggtcactgtttttcttatcttttaattgctgatattcatatgggatgattttcaactgacaagccgtaggtaagcttttttctagcagttcacttaagtggaccgccgtaccgattccagtgaagcaagtagtaatgagtgctttgggtttgttttcctctggatagagcagtcgccattctggctggatctgtcgaacagtctcttctgctatctcttctaatgatacatttttttgcaggcattcccctactgtgattgctaaaggtgtcgtcacattattcaaaatcaaaagcggtacggataactgttttttaaaaaactgatggatttctttcagagatcccatgtctactaatatgatcaatccatttgaaacatcgctgttttcgcaataatcaaggatttctgaagcaatctgctgtggtgtgacatctagtggcatatcaaatgattcaaatagatcctcttgtaataaacgatttactacatttgccatactgctagcagttgcataaccgtgagcagcaatcatcgcttttggcagtcgtttttcttttgaccatttcgctttttttagatagatcgtcagtaaaatccgatccatacttgtgtcttcaatatctaatttgatcttacttaattccagaattcgttggacatagtgataactagatggataagactgagaaacttgttgttctaattctttgattagttggataatatcatgttcttccggtaaccatttgatagtgcttcgctgatagagatagtaactcaaggcatagacactgtttccatcgaatttgatttgataggcagtttccatttgtcgaaaggtctctcggatagattgtgtccaataaaccagcagctcgtgtttttcttgtctactggtctcaaacagcaaaaaatcaaataattgaatcacttcttgctttaattttccttcgcaagaatatagcagacagttatttttcttgaaatcaattaggatttgctcaaaacttttaacgattcgctgctgttcgggctgttgcttctccattaattgctctaaggtctggtcttgcgtaatatagattccttgctgtgctgtatttttagtaataggctgcgcaagtagttctttttgcaaatgatggatcgtgacatggatttcaggctgttcacgctgttcagcatatgcttttgctgctgaaactttgacgatatttttcagctctcctatgtttccggataatttctgacttgttaaaagtgacaaagctggtccactgactgacaaagggctccccatttttctttgttcttcgagaaaaaaagagtaaatcagttctagccgttcattacgactacgctgattaagtgcaggtagttcgattcggataggtattcttcgaatgaaagttgttaagaaatgactagtaatctcttcagtcgtagcaaaaaagagacgtgttttgatccggcgtgacaaattaggttctcccatacgataaatcacaccttgatcaagataggtgaacagtttttcctgaccttctggtgttaagcgatgtacctcgtctaaaaacaagatcccaccatctgctgcttcaaaagccccttttttattttcttctgcaccagtgtacgctcccttaacatgtccaaacaaattgctagtcaaaagttcaggattatctgcatattgtgcacaattaaaagtgatgaatggtgcagaatcttctagcagatcatgaagcagacaatactgatagaccaaattaactaaataacttttacctgtgccactttcgcctgtaatcaaaagtggtaatccgccatctggatagtaaagagctgttttgatttgttcgatactttctttcaaactggcgtcgtatccgatcataaaagagaataagtcttttggttgcgcgaaaaaaggctgttcctctttgagatcatcgatagaaaaataaaaattcgtgcgtaacttaaaaaattgtttttcaaaagcttctttgtggaaataaatcactggtcgagaattgattttgactagtagttgctcatcatttaactggttcaaataatgactgactgtgtttctttttaccccaaaatgatcagctaacctttgtgctgtaaagacctcgttcatatgttctaaatcgaaaaaggctgtctggttctctaagtaacataaaatttccttcttcaacaacttattcacccctcctccatcatagaaaacggattcattttgtcaataaaatctttaataaagaattgaaaaatatatcttattatagacagcagcctacttatcccttataatttttattctaaaaaacgtacagttccttccagtttttatactggaatttcaacatatgaaagaataaggaggctatgactattcaatgaaatcggataaatataaaaacaggaaacatacttcctggaaaacttttcgagaaatcatcggatcttatctcgctgtagttgtatttttgcctttgctttatatggctatgacagaacaaactcgttttattggcgtagatacgcaatatatagccgaaacaggatttttattcatctttatcttgatttttgcgttctataaatccttccatacaaaataagattcacagatttcaactttcctgtctgtttttagctattacaaatccttatatgtggtataacaacaatttattggcataatgaggaaaaacgagttatgatgctttcagagagtaaagaggtactgttgtcaccatcctttttattgattacgtacaccactcttagttttttcccattgattacgaaaacaaggtagaaacattgatgttcctaccttgttttctttttttattttcagatcaaaatctcaagtagcttttgacttgatgtcgggaggttgtcttcgttccatcaaacctgatagaatctgcgccaaaccatagttttctccactattatttattcctctaagatagtacccacaataaacgaataaatatttttctcattttcatactccttctttgaaaatcaattagatttctctcaacccacttttttacaaaaattacgtagcaaaaaagattgcaagaacaaattaaaaaagaagtaaatagagtttcatctataaacatttacttgatatattttttatgcagaattcatttatagaaaaattaagtaaaatagacgttcctatgaatgaagagactggcatgttttctcattttcttttttttaaaaaaaatagtctattcaatttctaaagcttcttcataataaaactttcatttatgaaaaggcttgttctcttttcattctaaatttcctaagctacaatgtggtagtacttgttttttcaattgtggacaaataaataataggaggaatcatatgattcagttattacgttatgcaaaagactatcgtaagcaaatcattttgggcccgttcttcaaatttcttgaagctgtcttcgaacttgtcctgcctttaatgatggcttccttgatcgataatggactaaaaatgaatgaccgaggaaaaatcattgaaatgggcttatggatggtcgctatgtctgtgattggtctgatttgtgctatcatttgccaatactatgcttcagtagcttcacaaggatttggtacagagttacgtaatcagctaatcaaaaaaatcaatactttctctcacaacgagttgaatcattttggaacagataccttgatcacccgaatgacaaacgacatcaatcagcttcagctagctttagcaatggtcattcgtttattgatcagagcaccgtttttaagtatcgggtcagtggtcatggcttttgtgatcgactgggaagtaggtctgtttttcttagcattattgcctattttctcaatcattttattttttatcatcaaaaaaaccgttcctctctaccaaaaagtgcaagaaaaactagatcagctcaatgaacacgttagtcagaatcttagcggtgttcgtgtcatccgcgcatttgcgcagacaaaaaaagaaacagagaagttcgataaaagcacaaatgatctagcgaacaattatttacgtgtttccaatatctctgccctattatcacctgctacaaccttgatcatgaatgtcgggatcatctgtttgctgacagttggcgggatcaaagtaaatattggtagcttgcaacaaggacaagttcttgctttgatcaattatatgaatcaaatgcttttggcactgatcgttgtttcaaacctcgtcgtgatcttcacacgtgccgaagcttcaggaaatcgggtgaaagaggtgctagacacagaaaattcgattcttgaagctgaggtcagtactactcccgatttttcttctgaagcaattatcgcttttgaccatgttgacttccgttatactcctgattctggtctttctctccaaaatattacatttcagctgaagcgaaatacagtccttggaatcattggtccaaccggaagcgggaaaacgactttgacacaattgattccgcgtttctatgatgtcagttccggtacagttataatggacggaatggatgttcgttcttggcagctggatcatctccgtcagcaaattgctcttgttccccaaacttctgtactatttaccgggactattcgtgaaaaccttcaatggggtaagaaagacgccacagaaaaagaatgttgggaagctctgaaaatcgctcaggcagaagaatttgtccgtcagcttccaaatggtttagatacaaaagtcatggaaaatgggaaaaatttctctggcggacaaaaacagcgactgacgattgcaagagctttgattgccaagccagcattactgattttagatgactctttaagtgcgttggattatcaaacagacttggatttgcgtaaggcgctacagacttatcttggcagtacagtgattattatctcccaacgtgtccgctctattcaagaagcacatcatatcttagtgatggatcaaggtaagattgctgctcagggtacccatgaagaattacttgctcaatcagcagaatatcaggaaatcgtcgcatcacaggaggaagaatagttatgaaagtaaaaaaattatccttgcagacgctccgccgattcattccttaccttactgcctatgcaaaagacatttggctagctgtgatactaggaatcatcaatgggattgcaacagttgtgatgacgttacaaattggtcaaagtatcgatcaaatgattggagaaggacaggtccgcttcaatcgactgttccatttacttattctattcggtggtatcgttttaatcaacgtagtcagtcaatggctcatccaagtgttaagcaatcggttagcttacttatccgttgcaaaattaagaaaagatgcatttgctcatctgaatcgattgccacttcgttattatgatcaaaactcccacggaaatatcgtcagtcgatttacaaatgatatggacaatatttccattgcaatttctgcggccttcaatcaattattttctggagtggcaatcatcattctttcgtttatttttatgatgcgtctaagtccacttctgacattggtcgttctttgttctacaccaattattttccttgtgagttggatcgttgctcgtgcttcacaaacaaatttcgatagacagcaaaggattattggggatatctcgggctttgtgaccgaacgaatcggtaaccagaaaatcgtgaaagcttttcagcaagaagaagctagtcaacagcaatttgaactgctaaatgctgatctatatgaaaaaggacaacgggcacaattttcttcttccttgacaaacccgtcttctcgttttgtagatcaccttgcttatttatcgattggtttagttggcggcctattggcattgaagagtggttcgtcaatcactgttggtgtgatttccagctttacgatctactcaagtcagttttctaaaccatttatcgaactttctggaatcacgacacaactgcaaaccgctttttctggtctagaacgagcatttgatttgatcgatcagccagaagaaaagcctgatttgccagatgcctatgccttggaacccaaaaatatcaaaggaaaagtctcttttgatcatgtttctttttcttatgaccccaagcagcgtttgatcgaagatttcaattttactgcttatccaggtcaaaccattgctatagtaggaaaaacaggggccggaaaatccacacttgttaatttgctgatgcgtttttatgacacaacaaaaggaacaattacagtcgatgaccatgacatccgctctatccaacgtgatacattacgtaaaagttttggaatggtgttacaagatacttggctatttgacagtacattgcgagaaaatcttcgttttgggaatccggaagcaagtgacgcagaaatcaatgatgccctaaaagcctcttatatgtatgaatttgtagaacgtttgccggaaaaattagatactaagattggcggtcaagggttaaagatatcagatggacaacgccaactgttgacgattgctcgaacgatgatcagtaatccccctatgttgatcttagatgaagctaccagctcagtcgatacattgacagagaaaaaaatccaacaagccttcttagcaatgatggaaggaaaaaccagttttgtgattgcccatcgcctgtccacaatcaaaaatgcggaccagatattagtgatggatcagggagctattgtcgaaatgggcacccatgatgagctgcttcaaaaagatggttattaccgacggctctatcaagcacaattcacagcacaataaaaacaagcagtcttctgggatgggaagactgcttgttttttatttagcgtggatcgctaaacttcttaaaatttttttgtaaggaatactacgtcctacgtaataaatggcaattgattgaatcggtaaccatattactgtttttaacaggcggggcgcccaaacgacccagctgaacaatggcacatggtacatcaacgcaagccataatggtgtcaaaaataagttgatgatcagcgtgacactaagcgtagccagaatggcatttttccaagtgatctcttttcgatagaaaaagaatccgtagattgctccttcaataaatgcattcaatgtaaatccaataaagaatgcagatttcgagaagagggccattcctactaaatcagctaaaactgcgcctatccctgaccaaaaaggaccaaaaagaatgcccatgatcacttgtggaataaatgtgacactgattttaataaatggggtctcgattgctaccagtcgggacaaagtgaccatcaatgcaatcaataagcccataatagcaatcatacgtgcgtctaaccggtgtttcttcatttttagcatctcctttaagagctgctacatcgtatcatgcagcgaatgcgaaaataaaaccgcgaacattacgtccttcgtccaagaggcaacatcccatcctcttagcacttaacgctttattttctactctgtattatttttgggatcttttcccacagaaactatagcatattttcacatttactgcaaatacgaaaaactaatattattgtttatattatccaatacgttcgtattatatcgcatattatcagtttgtttagcttttatagctacatataggcgaacattaaacgttatttttccatacgcttatccatcaaaatgaaagtggatgcttgtctatttcatggacgattcttcgaaaatctaggaagccggcttccagtcctcttagtagcacctcagctgttccgatattcgtagctaacggaatctcatagacatcagataaacggataagtgctgttacatctggttcatggggctgtgcagccagcgggtctcgaagaaaaatcaccaaatctaactgatcctccgaaatcatggctccaatttgctgatccccgcctaacggtccggatttaaaccgatggatcggcaagccggttgcttccgtgatcctctgcccagtcgtcccggtagcaaaaagttcatgtttttccaatattgttttatacgctgttgctaatttcaccatcataggtttttttcggtcatgagcgatcaaagcgattttcataagagacactccttttgatattgttaacatacttatttactccagtgtatcagtttttatttcttatggatatttattaaagcttaaaactagcacattgacaaaaaaagaaaaaattcttgttcaacatgacattgaagttagttaacgctttcatttatactttaaatagttaataaaactaaaaaagaaagtgtggaacgtattatggtagaaatggctctgaaaaacgtatataaaaaatatgacaatgcagaaaattattctgtaactgattttaatctatcaatcaaagaccgtgaatttatcgtttttgttggtccttccggttgtggaaagtcaactactttgcgaatgatcgcgggactggaagatatctctgaaggagaactaaatatcggcggaaaagtcatgaatgacgtggcacctaaagaccgtgatattgccatggttttccaaaactacgcattgtatcctcatatgactgtttttgataatatggcttttggcttgaaattacgtaaatatgataaagcagacatcaaaaaacgtgtggacaatgcagcagagatcttaggtctgacagaatacttgaaacgaaaaccagctgctttatctggtggacaacgccaacgtgtggcattgggacgggcaatcgttcgggatgcaaaagtcttcttaatggatgagccattatcaaatttagatgctaaattacgtgtagccatgcgtgctgagattgccaaacttcaccagcgtcttgaaacaacgaccatctatgttactcacgatcagacagaagcaatgactatggctgaccgaatcgttatcatgaaagacggatttatccaacaaatcggtacaccgaaagaagtttatgatacacccgtcaatatgttcgttgccggctttattggatctcctgccatgaacttctttaatgtgacattgaaaaatggtgttatcacagatggacatgggcttaagcttcgtattcctgaaggaaaaaacaaagtattagttgaaaaaggttatgaaggaaaagaagttatcttcggtattcgtccagaagacatccacagtgaacaagtagcccttgaagcttcacctgaagccgtagtgaaatcagaagttgtcgtttccgaattacttggagctgaaacgatgctttacacaaaaactggttctactgagttcatctcaaaagtagatgcaagagatttccataaaccaggcgaaatagtcgaccttgccttcaacatcagcaaaggccacttctttgataaagaaacagaacaagtcatcaaacttccataaattgccccctgttagagctgtgccagaagatgttggtgcagctctttttaggacaaaaaactctcatcttagaggatttattatccattactagatgagagttttttttttgagagatcatgtctaatatgtcgttttcttcgcgtacccttgaatcgactctttccgattttctttttttgctgccgtaaatacggggatatcaaaatatttgctgagtgttcctgctataaaataagcaatattataatcaactaaactgtggataagcccaccaatccccatcaagatgaatactgtataaaaatatccttgagaataatatgtttcaggcatattaccaataaagtaaaagatgctgactactagcatttctgctaaagaatgaatcacaccgatcacaaaattgaacccttggaaacgccaattagcaaaagtaaactgtccattttttaaaacgatactcggatgcttttgcaagtaccaagccccaatcaacgcaaacacaagatgtgacaatgctcgcaatgcgatgataaccggcgttgttaaaaagaaaccaaatgtcgtacctagcgcaacagccactgcaactcctggtgtaaaaaacatcgcaataaataatggcacatgagacgccaaagtaaaggaagctggtggaatcatgattttaggcatgaccattgggataatgacccccatcccaatcaataaagcagaaatcgttagttttcgaactgatttttttctcattttttctctctcctaatatgtcttgacacataaatgtcgacttagtataactcacttactaataactgtcaagacacatattcttttctaaatccatacaaaatgagtgtgagtatcaagtataagaattttttgatcaagaaacaaaaataggagatgtgacaaaatttgtgtcacatctccttgttcggcataatagtggtcaaaagcttgcatcaagtaataagaccaactaactcaaaaacatgagaagctgttttttgaaattgttccttgtgacttagagttaaacggcaggcccacaacctctttcttaaacggtgttcaaaagcttgcatctgcggtaataagcccaaacaaacgaaaaacatgaggaactatttttgtttggctgttcttattacttgatgcaggacagctttttcacaacttctgtcacaacctctttttttactgcatattttctgacatcgcattgcttaatgcggcgaattcttgtaatgacaaagtctccccacgacgttttggatcgattccagctgtttccaagctttttgctaaccatgcttttgtctggtcatctttgccatacgaatgctgcaagttattccaaagcgtttttcttctttgctgaaatgccgcttttgtcaatcggaaaaatgctttttcgtctgtcacttcgactgccggtatatctcttcttgtcagtttcaaaatcgctgaatctacatttggctgagggacaaatactgtttttggtacgatgaatgctaaactggcttccatataatattgaacagcaatcgataatgaaccataagctttcgttcctggttcagcagagatacgatcagctacttctttttgcatcatgacgactagttcatccacaaccaaatctgattcaagaaaatgcatcatgatcggtgtcgtaatatagtaaggtaaattcgctacgacttttaacggaagctcctcatgaaatgtttctctaacagctgttgacaaatcggtctttaaaatatcttgatgtacaatagtcacattgtcatagggttgcatcgtatcagccaatacagggatcaaacgatcatcgatctcaaatgctacgacttgttttgcatgcttggctaattgttccgtcaatgcaccgattcctggtccaacttcgatcacgttcgtatgttcatctatttgcgcagtttctacgattttccttaaaatatttggttcagtcagaaaattttgtcctaaactttttttaaatgaaaaaccatgtttcaataaaatctcttttgttctagagggtgtcgcaatttcacgatattcactcatgttgttcctccactattttcattgcttgggcgagttctttcggcgtaatacgaaacatcttcaaacgtttttccaattgtttgccgttcgtgtaaccgatgcgcaactcgtcacctagtttttctcgtttttcttttgcttgtgccccagctattaaaccatagtctaaaaggtcttgtctagtgatttcagaaacagccgtttgggaaatgtctggcgtcacgacctttttcaatgcttctaaaatagcagcatcacttgcatgctcgacaccaaggcttccctttttctttggtttagcttgtgtgcgcggcaaaaaagcatgttttgcctgaggaacagcttccataatgatttttcttattttttctcctgaaaaatcaggatcggtaaaaacgatcactccacgagtctcttgggcatgttcaatttgcatcaggatctcttcattgattgcagaccctattgtttctatcgtatctgcatcaactacttcccgcagccttcttgtatcgtcttttccttcaacgactataatctcttggatcttcatcttatccatgttcgcttagaccaaataatcggtgcgcatttgtccatgtttgggcagccacttcttctgtcggaagattccgaagttcagcaatcttttctactgtataacgagtatagcctggttcatttcgctttcctctaaaaggaactggtgccagataaggggcatctgtttccacaagtaatcgttcgattggtacatttgctgcagcctcttggacgtctaatgcttttttgaaagtgacgacaccgctaaatgaaatatgcatccctaagtcaagaaatcgttttgcccattcataatcaccactgaaactatgcatgattccaccgatatctcgaacatcttcttcttttaggatttgatacgtgtcttcaagtgcttctctagtatgaatactgattggtaggttcatttcttttgcgatagcaatctgtctgcgaaatactttatcttggacttctttcgggtcttccatccaatgataatccaagccaatttcccctaatgctacaacctttggtaaagtcaattgttcttgtaatttattttcgatttctttcgtataactgccagcctctgtcggatgccagccgataatactgtatatatttggatagtcatggcttaattgcaaagacttttcaatcgttggcgtatcgaagcccacgaccgccattttcgttacccccatttcttgtgctcgctgaatcgtttctggaatatcttcattgaactgttcagcatttaaatgggtatgagaatcaaatatcatgtttatctctccttttcattcttactttagcacataagcactacttgcagaagtagcaaaaatcaaaatagaagaacttgttttattgaaatagaaaaagcacgaagatctagaggacctagttcgtactttttctgtctgttgttgaaatattttactcttctgagcgttttttctttttttgataatagactgggatacctatcaaggtaacacctataccgatcaatgctaatttcgtttgcgtcatcatcgtcatacctaaaatgaaaatagcaccgagaatcgcaataatcggaacgattggataaagtggtactttatatggacgtggcaattccggcgctttttttcttaaaataaagacaccgataaaaatcagtaaactgaatagccacatcacaaaaatcaacatgtctgttaaaaagtcgaaagaaccaaggctcatcataatacaagctactgctaactggaaaaccgcaggaacataaggaaccgtaaacttctttgaaagctttgtcagctgtttactgaaaggtagctcgtcttctaaagccatcgcataaggcacgcggatcccagttagtgtataaccgttcaatgcaccgtataccgagatcaagatcccaatagtgaccagctttccaccgattcctccaaaaatgacgtctgatgcttcagaagctgcattcaaattaccggcaagatgatcaatcggcaaagttttcaaaaaaacaaaattgatcaatagataaacgactgttacaaaactcaaaccaagaataattgctttaggcaaatctttttccggccgtttcatttcccctgccattgcaccgacacctaaccagccgtcataagcaaacaacgttgctaacaacgcactgctcaatccttcgacaaaagtaacatcttttccagcttcgattggaaataactggacagttccttgtcctggggtcaataatccccatatgacaatcacagcaattggtattaatttaacaatcaacgtcactgattgtacagaagcaccgacttttgtccctaacaaattcaaccctgtcacagaaacagcggtgatcactgcaatcaacaaaagataatcggtagataattgtaataagttcgtcaattgtgtcgcaaagataatcgataatgcagcaatattagcaggaaagtaaatcaagctttgcgcccatcctaataaaaagctgggcaattttccatacgcagcttcaatatattttacagctccaccagtttccgggattgctgtagctaattcagccactgtcaatccagcacagatcgttaagaaaccacccaaaagccaagctagcaatgtcaaacttgtagactgagtactagcagtaacagcagcagttttgaagaagacgcctgcaccgatcacggttcccataacggtagctaatgcgccaaacagattgatttctcgttttagtttgcctttcattcccatcctctttcttctttgaaatttggtataattttcagtataactgagaatattttaatttaccattcttttttctccactttcagtgaaaaactccctcttaagacggatgtatttcttttttatttttcgtatactaaacctaccttttccacgaaggaggaacagtttatggattttaagcgttcttatccgaaattagcagattatttatccaaccgggtcgatttttcccgtaaagaacaacagcagtcccattggcatggttcacattaattttatttggattaatgactgttgcaacgttatcacaaaaactaatattgctgactttgttcatcgcaatcgttgcattgatcaaaggtcctgtgatgatcttgtgggggatgttgtattcctttttggttgggctttttccgcctatcggtattttgctttcagcgattttctttttattgaatatcggaacatttacaaagaactggcggatgaccttagtcgggatctatttttatttctatccttttggagtgatggcacttagtgaagtcatgcattgggataatcattggtttatagctggctccttgcttttagggttgatcttgttacacgtgatgttgacaaagctctatcaacattatggtatcggacgtacgattttctggtatgtcttttcgatcccatttgcactgcttactgctctcttaccaagccgtttgaagacaaaaataaaaggttaccataaaatcaagtgataggatttttacaaaataaagaaaacaatcatcgaagtcaaagccgatgattgtttttttatctatattttcaatcacacatataagagcacaaactaattgaacataaagtgatagaacttataattaacacatcaacgctactgttagatataaatatagatgtaataaagtcattgcattcaaactttatgaatgtaaggacaataaaaaagagtaccagatgaatcaattaaaatctgcccgaccctttatcattatgctttttttctgtttttacgattcctattagtattattctaaattaacaaaaatcagcgaagctcgtacttctttttctaggatttattttggatagttctctgtttctgtattatatgattggcttcaagtaataagaaggaatttacgaaaattgcttctcaaatttcggaaaaagggggtatgacacaactagtgtcataccccctttgaatttctatgcgatttctgagccatttggcatggattttggtgcttcgattacttgtaaagagccatctggtgcttctgcagaaaggatcattccttgactgatttgtccacgcatctttcgtggtttcagatttgctacaatgacgacttttttcccgatcaattcgcttggatcaggataaaattcagcgattcctgacaagatttgacggtcttggctgtctccagcatctagtcggaattgcagcaacttatctgccccttctactttttgacagttgatgacttctgctacttttagttctactttttcaaatacatcaaatttgatttgtttttctttcgttgaaacaagttctgtttcttctggatcccatttgactgtatcttcgtttgtttgagtaccttcagacattttttcttgaataaaagcaacttcttcttccatatctaaacgtgggaagattggtgtaccttttgcaactacttttgttcctgaaggaaattcgccaaagtgtaatccttcaagattcattgtttcagagtccaatcctagttgattgaagatcttctctggcgtttctgtcatgattggctgaagtaatatcgctgcgatacgcaaagattcagctaaatggatcatgacactattcaattcagctttcttttcttcgtcttttgctaatacccatggttctgtttcatcaatgtatttgtttgcacgagaaatcagcacccagatttcagccaatgctgtattgaattccattttttccattgcatcatggtaacgtccgacaacgttagcagccgtcgtagacagttcactatcaaatggagtgacaagtgaggcatagtcaggaacgagtccatcacaatatttgttgatcatagcaatcgttcgattcaataagttccctagatcatttgccagatcataattgacacgggaaacaaaatcttctggcgtaaagacaccatctgacccaaacggaacagcacgaagcaaataataacggagtgcatctaaaccataacgttccacaagcatttcaggataaacgacatttccttttgatttagacatttttccgtctttcatcaatagccagccatgcccaaatacttttttaggtagaggcaaatcaagggccatcagcatgattggccaatagatcgtatgaaagcgaacgatttctttaccgaccatctgaacatctgcaggccagtatttttcgaatagactttcatcttcggagccatatcctagtgcagtaatataattggataatgcatcgatccatacatacaccacatgtttcggatcactcttgactggtactccccaagtaaaagttgttcgtgaaactgcaagatcctctaatcctggtttgataaagttgttgatcatttcgtttttacgagattctggctggatgaattcgggatgttcttcatagtattccaatagacggtctgcgtatttgctcatgcggaagaagtatgattcttcttttaccaattctacttcgtgtccacttggcgctttaccaccgatcacgttaccttcgtcatctttgtacacttctgcaagttgtgtttctgtaaagaattcttcgtcagaaacagagtaccagccttcatattcacctaagtaaatatctccctgttctaataaacgatcaaatattttttgaacagctgctttatggtaatcatctgtcgtgcgaatgaatttatcataactgatatcaagcgttttccataatttcttgacatcagccgccattttatctacatattcttgcggttttacacctagttcttctgcttttgtttcgattttttgaccatgttcatccactccagtgagataaaacacatcaaagcccatcaaccgtttataacgagcaattgcgtcacatgcaatcgtagtatacgagttgccgatatgaagtttgccgcttggataatagattggcgtagtgatataaaaagtttccttttctgccacggggctcttcctcctttatcgcatgatgcgaattcgtttccttgctagtataccataaaaaaagcatgctgttagctttttttcaaaatgaaaaagactggataaacgacttctatctacgttcaatctatcctttaaaaggatgaataggttgaataaatgcgggtttttgttttgtttcatatctactaaaaaacggctttttatttctcccctcacacgtggtataataaagactatctatcttagtaagggactggaacaatcatgcagaagaaacatcttttttttacacttagtattgcttttctttcattagcacatttaatattcagctatttttatattcgtatgtatggttattttaacctccatgggcatttgaacagttttatgacagcagcttggattttgcgttttatcattgacgtatatatcgttatttgtggcttctttgccattcgtgaagagcggtataaagtattgccgttttatctgcttttctttttattcaatctcatacttccatttatttttcatatttaaatgataacctagatttttcaagtaaatccttggttttttttcagagtctgctacaataaggtaaaaagtacttttactgtcaatggaggtggtcagatgaaccgttttgcttctaaagaagaagaaaaattatattatgaacataaagcaagtgaagaagaatttcttaactggtatcaaaaacaggaacgtccagaatatgacaagccctctttgactgtcgatatcgtactgatgtgctataacaaagaagaagatcagctgaaagttttgttgatccaaagaaaagggcatccttatcgaaattcatgggcattgcctggtggctttgtccaaaaggatgagtcaactggagaaagcgtcttaagagaaacaaaggaagaaactggtgtggttatttcaaaagaaaatattgagcaactgcatacattcagtacgcctaatcgagatccgcgaggctgggtcgtcacagtcagctacttagcctttattggagaagaaccgctaatcgccggagatgatgccaaggaagtacgctggttcacactagaacgtcatagtaacaagatccatttatctagcggagaagtggctatctcgcttgatttagtcactggagagtcttctggcaaagatactttggcttttgaccatagtcaaatcatcttgaaagcattcaaccgtgtagtcaataaaatggaacacgagccgcaagttctacaagttttaggtaaagatttcacgattacggaagctcgaaaagtatttgctaaattcttagggatcgattataaaacgatcgatcattccaattttaagaaagctatgctccaatatttcgatgagatcggtgaacgtcctgtaggaatcggccgtccttcaaaaatctatcagctcaagccggggcaccatgaataaggttgtgagcaaaagattcagacctaatcattcaagaaaaaacgcaaaaacaactctttgtgagttacgttttttgtttcagaattttgatgtattcgtaaactttctgaataaaaaattaacaatagcagaaaaagctcgtacgaactttttctgctattgttttattggtttgtcataattagtgagcttttcttcaaaagaaaaattcctagaaacaaaagtcattaagactttttattaacaaggctaaccctaacgctcctatcagtttcattcattttttatcccttgataaccgaatgtctgcccattttttctactacttggctctttcttacggaattgctttcttctgctccgtcggtattgatcaaaagaaattttttattataccattgggacttataacgcaattttgttattaatttatgccagtcgtgaatagaaaaatcagcatgtgcctcttcttttggaaaagattctacaaataagtagtcatattgtttgaccaatttcccagataattgttcaagataatcttctcgctggttcttttgtttcagataaagatccattacttttctcttttgtttctgataattgcttgcctgatctaacctgatctttctatggtgagcggagcggactttcacattcaatttccgctgtgcatgttgcagcttttcttctgtctggtgaaattttggtaaagttacttctagaggtcgagatgtttggatcaatgtcttcggatgataggcgatcccgatccatttagctaaagattctttttttactggcgaaacatcacaaagtagtgcgacataaaattcttcattatatcgagcagaaatcgtagcggagcgaatcgatccttcaactggccgatgctgatttatcttgattagttctttttgttttggtaactttaagtagccattttccagatagatcgtacgggtttggttgttggtcgtataagattgccacatactttttttcgttttaagctttgggaagctggcacgtcccttgaaataattgcgaaaagcccgatccaaattaagctgtgcatttgctaaagcaagactgtctacttcttttaagaatgggtattctttttttaatgtagcgggtgtgagcgaaaaattggctactcctgtttgttgccaacttttctgccgctttttcagcaaatggttataggtaaatcgagcacatccaaaagtacgaatcaattgctgtttttgttcttctgtcggatacatacggaatttaaaagcttttagcatctatgtccctcctagttagcaaccagaagagattccttttgtcgttttagtttttttgcgtaatatgggacttcctgctcagttgcatagacaaaatgttctggtgcgatttcacgaagttgacgtacttgtccgtcatctggttcaggttgatatttgattcttctgcgttttctctcatggtctggatctggtagaggaatagcagataacaaactttctgtataaggatgaacaccgtgattatagatttcatcacttgttcccatctctaataacaagccgttatgcattacaccgattcggtcactaatatgtttaaccatcgacaaatcatgtgcaataaatagataggtcaattgatgttctttttggagatcttgcaacaaattgaccacttgggcttggatcgacacatctagtgcagaaattggttcatcacaaatgataaaacgcggttttactgccaatgctcgtgcaataccaatacgctggcgttgcccacctgaaaattcatgaggataacgagtaccgtggcttggattcaatccaacagttctcaatagatcatcgactttttttgcacgctcttcagatgatttagctagtccattaacatcaattccttcggcaatgatatctctgactttcatacgaggattcaacgaagcgtatggatcttgaaagatcatctgaacatcatgccggaatttcgtcaaaccttttttatctttgatcttcgttatatcttgaccgtcgaataatatctcaccatcagtaggttcattcaagcgaatgatcgtacggccagtagtggattttccgcttccagattctccaactaaaccgaatgtttctccttcataaatgtgaaagctgatgtcatttacagcatgtacttcattcttttttcctacattgaaatactgtttcaatcctttaacttcaagtagtttatttggcatcagcaattcctccttgaccgtaagtatgtttttgtttctctttaaagatagcccagcgacgttggatttcttctggcggtgtcactttgggtgcctgcggagcaagtagccaagttgctgccttgtgtgtttttgatagttcaaaaaatggtggttcttgttctgcatcgattttcatcgcgaattcatttcttggatagaatgcgtctccttttggcgggttcaataaatccggtggagaaccaggaatagcatacaatcgatcgttcgcactatctaatgtcggcattgaaccaagcagtccccaagtatagggatgttgcgggttgtagaaaatttcttccgatgttccaacttcaacgattcttcctccatacatgacagcgacacgatcagcgacattcgctactacaccaaggtcatgagtgataaagataattgatgtatcgatttttgtctgaatttctttcagcagctccaaaatctgtgcttgaatagtcacatcaagcgctgttgtaggttcatcagcaatcaggatttccggataacataccagtgcaatcgcgatcacgatccgttgacgctgacctcctgagaactgatgcggataactgttgatacgtttctcagcttcgggtattccaactaatttaagcaattctaatgcagctttttgtccctctttttttgaaactttattatgctttctaagggactcagcgacttgcttcccaatgggcatcgtcggatctaaagaggtcattggatcttggaaaatcatcgctatttctttaccacggattttttgcatctctctttctgattttccaacgatatcgttacctttaaagaggatttgaccagcatctatattggcgttgcttgacagcaagcgcatgatgcttctggtcgtcactgattttccacttccagattccccaacgatcgccaatgtttctcctttattcaaatgaaaattgacaccgcgaatcgctcgtacctttccagcatacgtatcaaaagagatttctaagtctttcacttctaaaattttcgtcatcgtcttcactctttcattttaggatcaaaggcatcacgcaatccatcagcaagtaagttaaagccaatcatgataaccgataaagttactgccggaatccataatagataaggcagatacaggaatgtcttgtacccttcgctcaacatcgttcctaatgaagctgacggaggcgtaagacctaaaccgataaagcttaaaaaggcttcgaagaaaatagcagatggaatactaaacatcatttgaataataatgacactagagatattcggcaaaatatgtttgaatgcaattttcattcttgattcacctaatgtcaatccagctaaaacatattcttgatcttttaatttcattgtttgtgcacgaacgatacgtgccattggtatccagtttgtgatggccatagcagccacgattgaaaaaattcctggttcaaaaacgaccaacatcaaaatcatgacaacgaggtttggaattcctgataagatttccaaaaaacgttgcatcacgttatcgacacgtccgcctaacaaaccagaaaccaacccgtaagctacaccaatcgttacatctagtaatgcagcaataaatgcgatcagcaacgagattctcattcccataaataagcggcttaatacatcacgtcccaaaccgtctgttcctaaaaagaaatttacgtttgaagggacgtttgcttgagcatatttatcaacaagttcaccaccaaccattgcttttccattcaatccatcgatattgattcccggaatacgaggaggcaaattgatataagccacgttttgggcagttggatcatgaggagaaacaaagattgtgatcacagagatcaaaatgatgaccaatagtaaaaccattgaaataacggcagctttgtttttctttaaacggcgccatgaatcttggataaaattcaaagaaggtgcagtaatctgttcacgttcttcttcggtatttttttgtaatggaagaaattcatccgcagggatatctgcaactgtttcataacgctttggtatcatttccatttatcctcggctcccttctgaaacacgaattcttggatcaactagaccgtacaatagatccacgatcaaaataacaaaaatcagcataaatgagtaaaggatcgttacagccatgatcgtaggataatcatttgttgtgattgacttaacgaattgttccccgataccaggaatagcaaagatattttctaccaccagtgatccggtcatcaatgctacagctaacggtcctaataaagtcatcaatggaatcaaactatttcgaagaccatgtttaaaggcgatttcccaacggctcaatccttttgcttttgctaattccacataatcactatgcagtacttccaccatttccgtacggataaaccgagcagagtcagcaagcggcgacatggccaacgcaattgttggtaagattgtgtacacaaagccatcccattttgcgattggcaaaacttgtaatttgattgcaaagatatattgtaataaaacagcaaatacaaagtttggaatggaacgacctaatatcgctacgagtgtagaagatgtatctgcccatgtattttgcttcatggcagagatcgttcctaaaatcgtccctaggactgttccaaagataattgcctgtaaccctaactgcaaggatggtccgattcttccagctaacaaatgtgcgactggctggtttttaaattggaaggaaattccaaaatctccttgaagcaaattagaaagataaatcccatattgtacgataactggtttatccaaaccgacttgtttatttagcatctcgattgtttcaggactcaaacgttcctgattcgtatatggcgtgcccggcagcaattgcatcaagaaaaaggtgattgttgcaattaaccaaagcgtgatgatcatgaaaaagacacgttttaatacatatttgatataactattcactaatgtttccccctagcttttgacttccgacagatgtttcgctacattattagataatgaaccaaaaataaaggagcaatcaaatgaaaaaaaaatctatcccctacgcagtagcttttctactgattctggttattttaataaaaaatctcatcaaccattcctttacactcattcaattatctaatgatctattcttatggtcattgccgtttctgattatcggcggttttttatgggtcttttcttcgggtttcttcgatcattttcagcgatcggtccatcttgcacgaacaaggaaccgaaagaaaaaaccagaattttcctcgctctcgtctgccagctacggtatgtacagcttttggctgatcattgccggaatactaattgctctttctgctattttcatgcttttttctttgttaggataagtgaatatgagaacgaggttgcgacatttgccgcagcctcgttttttctcatgctcacggtattaacgattattcttcaacgtatgtccatttgtaatcccatgaagcgcctgccgcatggtgaacgatacctttgattttttcattcactaggtgaccttctgctttttggtacaccggaacgacacccatatcatcagagatgatcttgattgctttttggaaatcatcccaacgggcttgttcatcgccagcgtctgttgatgaagctgctttaactgcttcgtcatattctgcattgctccagcgaccacggttgtatgaattacctgtgacaaacaaatcagtaaagctgcttgggtctgcatagtcagcagcccatccgcctagtactgcgtcaaaatcacccgaagttgagcggtcaagacgtacagagaatggaacaggtgttggtttgactgttacgccatccaagttttcttggattgagttttgaacatattcgattacttttttcgatgaatcatcatcagaagccatcaaatcaaattctaaagaatcaacgcccaattcttttttcgctttttcccaatattcttttgctttatctttgtcataagaaactaattttccagcttcttttgcaaagtcttcgttcgttgttggactttttaccatatctgatgggatcaatcctgtagagacaactgatccgtcacctagtacttgttttactaaagcttcacgatcgatagaataagaaatagcttttcttaggttcacattgttgaatggtgaattcttttcacgttgattgaattcgatatagcttgtccgcgcttctttaacagaagtataagctggatcgtttgcgttttgctgtgctaactcaccagacaagatcacgtcatctgcttggccatctttgaataagttcaatgcagtagaagattcttttactacactgactttgatttcagaaagttttactgtatctttgtcccagtaatgatcatttttcttataagtccattctgtatctgttcctggtccatcaaaatcttctaatgtgaatggtccattataaacagctttatcacttgcagatgcataggcatccccattttcttccactacggattgtttttgtgggaaaaatgatgggaaagcaagcagatattggaaatatggtgtttgtttcgtcaatttgatttctaattcatagtcaccaactgctttgatccctagttctgatttatctttctttccagctgtaatgtcttctgcattttcaactggcgcatacaggtaagcatattcagaagctgtagctgggtctactgttcgttgccagccataaacgtaatccgctgctgtaacaggatcaccatttgaccattttgcgtcttctcgtaatttgattttgtaagttaatccgtcttcactgacttctgccaactcgctagctcctgccggctgtggtttgctgtcttcatcaagacggtaaattccttcataaacgttattcaatgctgtaaaactgattgtatctgttgcaactgataagtcagctgtaggcatttcttgaggcacgactaagttaaatacgcctcctccatctgctgaaccgctttttgctgaactactgcttgtggctgaactgccgccataacatccagcaagtacaaggccgcataccgcaaccaaaccaaatgtaaatttctttttcattttacgtacccctttattggaattttcagaataattaatattttctgaagttgtttaagagtttaatgaataattattaaaaaatcaacacttttttttgtctttttcataaaataatgattttttcgtgaggtttcaaggaatttttcagaaaaaatagctttgtacaaggttttccatggtcttccaaaagccattaaataattttcgttatattgtctattattgccatacaaagataaaaaagaataaacaaaaagaaactgtgacaaaagtcttgtcacagtcccttatctgaataaacggtgttcaaaagccagtttctcggtattaagccaaatttatgcaaaaatgtagaaagccattttcacaaaatttttcttactactcgaaactaagcgactttttcacaacctctggtacacggtgttccaaaagtagcttcttcggaaataagttggaatttcacaaaaattcaagaagtaattttcgtaaattccttcttatttcttgaagctgattacttctgtcacaacctctttttattattgagaatttggtcgaggaataatcgtttttgccatccaaatatccggtttgtcccagccatttgcatttggtaagacacctacgattttataacctaatttttcatagaattcatacggatgttcacgaaggttctggatggaagccactttatcaaatgtatgctcatacaggtccgtttgacttaacgttgttccatggtctaaatcatccgtacctaaataaatcgtgattcctcctctggaagctacttctttttctaagtaattgactaatcgagtacctatttggttctttcgtcgggagctttctacaactaatggatgcaattcccaacctgtgataccgtattgagggattgcaccaataaatcctactaactcatcttggtctaccgctgctaccgcgattcgttctggattcatcatttcttctacttcttctgccgagctgtctccatattcttccggccaagtcagtctcagtaaatcagaaagctgatctttcaatactggattattacggtcaaattcactgattatcatacgtcttcccccttgttcttgcttattctaacagtccttttgaaaaaacgaaatgttctcgctcaaaaatctttagctaccaatcagtatctctattctttcattatttatcttacttataaaataaaaaaattatacagaaacactttattcaaaataggaaagatcaggaaagccatcaattggaggaaaaaactctgtttgttcatcatgatatagattatcttttgctttaaaaaaaaccaattatgaattgacaaataaaacctgttttcatataataatcttaatttttagaatttttagataattacaaaaaagcaaagggaatcggtagaaatactaagaggaacaaaaattcattattgtcgttttcaatgtttttgtacttgttcgtttttaggatacttattgatgatttcaaggtgttcatgccaccttattcatcacttatcctgtcttaggttcacctctactccatctacagccgcagtcagatcgatcactctttaaaattttaacccgtttcaacgaagaaagaaggaaatgaatatgagtcaaagtgttttcttaccaaattataccattggaacagatgcgtatgaaaaagcaaatggaatcgtcaaagaatatgggacaaaagtagtgctgattggagggaagactgcactttcaaaggcagaaaacaaaataaaagtagctttgacacaggaaatagaggttgtcgccagtctctggtacgggggtaattcaacttatggaaatattgaacagttgatccagcatgaaagtgtccaaaaagcagacgtcctgtttgcagtcggtggtggccgtgcttgcgatactgtaaaagtcattggtgaaaaactagctaaaccagtcttcacctttcccactattggttcgaactgttcgcccgtcactgcggtatgtgtcatctataacgaagaaggcgtaatggacggactcttctttccttcaaaaccacctgtacacaccttcattgatacagcaattattgccgaagcacctgataaatacttatgggcaggtattggcgatgctttatccaaagaagtcgaatctactttttctgctcgtggcgatgatctaggctacacggatagattaggaatccaaatcggaaaaatgtgcattgatcgtctcttgacttatggtacgcaagcattgaaagatagtgccgacgatcgtccctcatatgcaattgaacaagtcgtttcggatatcattgttactaccggattggtttctgttttagttaacaataactataattctgctatggcacactcattctattacggtacgactgttctagaaaaaatggagggataccttcacggagcatctgtcagttatggtgtactgaccttattgatgatggatcagcagttcgatttgtttgataaaatctatgtgtttatgaaaaagaaccaacttccagtatcgttaaccgacatgaatctcaatgtcacgaccgatttagaagcaatcttagataaagccatggcaacaaatgatattaaacatgtgccttatgaaatcacccgagaaaaatttaaacaggccattcttgacgtagaaacttatcatgctacacaagaaagccagcaaggatataagaaaatcagttaaataattgctaaaacccccatcaagcaggctgtcatcaaattgaggacatttctttgcttgatgagggtttttcttgtcaaaaaaagctttatagctttcgctatagaatcttttctcttatttaagttgaacagttccttaattaagaaaactgctccttttatggtaattgaaaaaacgagtaggatacgattatttggcaactgtttttttcatttgcttgcttcgcaattgtccgcaagctgcatcaatatctgtaccatgttctttacgtatcacacagtttacgccgtttttcttcaatacatcataaaatctcaatacatcagcttttggactgcgagaatattgatcatgttcactgactggattatatggaatcaagttgacatatgctaattttttcttatcttttaatagatctgctaattgttgcgcatgctctggtctatcatttacttgattcaacatgatatattcaaacgtgattcgacggtttgttttctctaaatactcatccacagcttccatcaatttctcaattgggaaacttcggttgatccgcatgatcgatgttcgcacctcattattcggcgcgtgcaaggaaatagccagattgacttgcaagccgttattagcgaattccttgattttgtgtgctaatccactagtggaaactgtaatgtgccgagcaccaattgccaatcctttggcatcattgatgatatgcaaaaagtccattacattgtcgtaattatcaaatggctcaccgatccccattacaacgacatgtgaaacgcgttcgccaagattgcgctcatcaaaataatgttggaccatcatgatctgtgcaacaatttctccagcagtcagatcacggttctttttgagcagcccgcttgcacaaaacgtacagccgatattacatcctacttgtgtcgtcacacaaactgacaagccatattcttgtctcatcagtacagtctcaatcatgtttttatcagggagttcaaacaaatattttactgtaccatccgaagcttcttggacgaccatctgttttagaggattgatgataaaatgctccgataatttttcgatcaattgtttcgatagattcgtcatttctgtgaaattacttacacgtttttgatacaaccattcccaaacttgggcagctcggaattttttctcgccgttttctataaaccaattgattaattcttcattcgtcaagccataaatggactgtttttccaaagtattttccctctttttctcaaagtttcgctacatactatacatgattcatttccttaatgcaatacttcacaaataaatcgaatagaactttaatctcacaaaaactaaaaagacaagacatcataccgtattagaaaagatggaaaaaaccatttttcttttggtatcatcatgccttgtctttttattggttattcgtttttcaacccttcatcacacaagttttacatgtcattatcgtccggcaacgtttctgatgtttcttcctgctcaatgaatactttccgaggcttgcttccttctgacgggccaacaactccatgagcttccagttcatctactaaacgtgctgctcggttgtaaccgatccgaaatcttctttggagaagggaaatacttgccgtttgcatttcaacgacaagtgcttttgcttcttcaaacagctcatcttgtggctgttctggagcacctgtcgtttcaacttcatctgtcggcatcattttctcttcataatgagcttcttgctgatctgtaacaaattgaacgacccgttctacttcgtggtcagaaatgaatgctccttgcacacggatcggtttattctcacccattggcaagaatagcatatctcctcgccctaagagcttttctgccccattagaatcaatgatcgtccgagaatctgtaccgcttgataccgcaaatgccattctggaaggtacatttgctttgatgattcctgtgataacatccacacttggacgttgagtagctaggatcatatgaatccccgctgcccgagccatttgcgctaaacgaataatcgcatcttcaacttcattgctggctaccatcatcaaatcagctaattcatctacgatcactacgatgaatggtaaggttggatgtttcgttccgttttccaagtttttctgttgaacaaattcattgtaaccagaaatatttcttactccggttgccgcgaatttttcatatcgttcttccatttcttgtactactttttgtaaggcttgcgctgcttttctagggttcgtcacgaccggcgtcaacagatgaggtatgccgttgtacatattcaattcaaccattttcggatcgatcatcatcagttttacttcatggggcttagcacgcattaatatacttgtgataatcccattaattgctactgacttcccactaccagtcgaaccagccacgagtaagtgaggcatcttcgaaagatcagccgtttgtacccgtccagaaacatcacgtcctaaaggtacttctagtaatttatctgggtggtttggttgtgcttcgatgatttctctaaaggaaaccatactgatctttccatttggtacttcaataccaatcagtgatttacctggaatcggtgcttccatccggacatctttcgccgctaaagcaagcgcgatatcatctgttaagttcacaattttacttacttttacccctacagccggctggacttcgaattttgtgacggatggtcctaagctggctttgacgaccttggcatcgacaccgaaactttggaaagtttgttctaatacgccgatatttttttcaatttttttatactcatcactttgatccacagttggtatagaatcaagcaaatcaactgtcggtaattcatagtcttgattttcctgttctgcttcaatctcaaattctaatgaggtaccgtcatcctctggcaactcatctgaaaaaccttctgctgtattggtctgttttggtgtatctggtactggtttctctagattcgcaggatggatattttcttgaaaactgtcgattggaacaaaacttagctgctccggctctgtattttctggttcctgccattcatcagcagtattttccctttgctggctcaccgcttttttcttctcatattctgcagcttctttttctgcagcttcttttgcagctaagcgccttgcttctttcgcttctgcgcgctgtttcattctctcttcctttgccgcttgctttcgagcttgcttggcaggatcaccttccaataattcctgtactcgttctccaattgattggataccatttaacagctgatagccttccagattactgaacaggaatgctcctcctgccagtaatagcactgctgctaaataacttccaggctgtgcaatcaagaagtaagtaaaatgataaaggattgctccaatcatcccaccaccaacgttattgtctacttgactttgttttatatcactggctaacaaatcccatgtcgtccccatgatatttggttccccagtatggagtttgccaaataaatgggcatgtaacaataataagataccgaaataaaagagtatgccgccaaaccagcgtcggtttttaccaattgaaaactctgtattcttaatgacaatccaaaatcctaatacggctaataaaagacagaggatttggtaagtatttcctgcaatgatccgaaagccgtttgcaatcaatattcctaaaaaacctaattttaaaaagccgaagacagcaaataaaatcaaggcaaacccaacaccaatcgtcagcatttgttcctgctgctgtttttgctttttcgtttttttcgtctttttcctttttttagtaggccgtttcttttgtgccatttattatccctcatttcatcaagtttcattatacaaaaaaaagtaagggaactaaagttttgtttgaaagaactgacgctttctttcatttttcagcttattttacagtttttcttaatttctaaatgattttatcaagaaaaggcacggccatatccagccgtaccttcttgttttaagtatgtgaactaaaggttctctccattttcttcaatcagtttttggtaccagtaataactgtctttcttatatcgttccaaagatccttcttgtgtttcgtcttgatcaacatatacaaatccatatcgcttttgataaccgttcagccagctaagcaaatctgtataagaccaggtgcaatagcctaggacttctgctccatccgaaattgcttctttgatggctttgacgtggctttgtaagtaattgattcgatagtcgtcatggatttgtttatcttctgtcaacttgtcatactctcctaagccattttccgtaatcagtaccggcatgcggtaacggcttgtgatacgacgcagtccgatccttaatccttctgggtcaatctcccagtcccaatttgttcgttcgacaaatggattctcaacttttttatacattccaggaactccagtttcttctgatgaacctttttttcctgtcgtattcatttttccagcaccaactccgtttaatggattgaatgcattcgtcgccgtttgatagtaattgatcccaagaaaatctggtttagcagattctagcaattctgcatcgccagcttcaatcgttggtgcccatcctttttcttctaagaacctcatggcagcaatcggatattttccccacatatagacatccatccaataattggccatcaggtcttctgcattttcagcagccagaacattttcaggattactgtcaattggataatttggcgtatacgcaaagcttggtccgatttttccaggcatttctaactcgtgaaatttattgatgacagatgcatttgctaaattagcaatatggttaacttcatacattcgtttcgggtctgtcacacctggcggatgtgctgctaacaaataacctaatgaagtgaagatattttgttcattcaaactaatccagtaatggactttcccgcggaatgcctcaaataatgtttctgcataatgagtgaaatcttcaatgatctgacgtgattcccaaccattatattcatcttgcaatgcttgtggaagatcccaatgatataaagtcaacataggttcaatatcgttttcaatcaattcgtcgatcaatctctcataaaaagcgagcccagcttgattgacttctcctcgtccattaggaaaaatccgtgtccaagctacagagaagcggtaagctttcagaccttgttctttcattaaagcaatatcttctttataacgatgatagtggtctactgccaaatcaccgttcgttcctttaaatgtctttccaggtatccgtacaaatcgatcccagactgattctcctttcccatcttcttgccaagctccttctacttgatacgctgcagaagcagagccccacagaaaatcttttggaaatgaggtaagttctttgtgttccattcatctcttcctttcctataaccttcaatcgttcctcttttagaataacacgaaaccccttccacaacaaaataaaattatgtaaaggaggttgtgaaaaagtcgcttagtttcgagtagtaagaaaaattttgtgaaaatggctttctacatttttgcataaatttggcttaataccgaaaaactggcttttgaacaccgtttaccaagaggttgtgagcctgccattcagctccgagtcacaaggagttggcaggagaacactgtttattcggaaaaagggactgtgacacgtcttttgtcacagtcccctatttgttaatttctcggcgtaacatcttcgccaaaccatttatcggatattttttggaattcacctgttttctctagttgatctagggcttcattgatttttttcactaatgtactatctgacttgcgtgcaccaactgcaaaatcctcactctcataagaaccttttgttatgttgaagtcttctagttcgtttctttgtttcaaataatagtctgcgtatactttatccatcagcagaccatcgacccgtctgcttttcagatcgatcaatgcttcattaaaactatcatacaaaacagcatcttggtttttgactatctcttttaatacttctggttgtttcgtaaatacatcataaccagatgacccattttgcgcacctaatctcttattattcatttgtccaaagtttgtgattcctgattctttaggtgtgatcagcacttgatcgttttccatataaggttttgtaaattgcactttcttttctcttgccggcgttttggaatagccgttccatatcaaatcgatcgttccattgttcagttcaaattccttcattgaccagtcaatgggctgaaagtctaccgtaatcccatattgttcaaagactgctttggctaaatcaatatcaaatcctgtgagcttcccgtctttatctctaaatcccataggaacaaatgtatcgtctaaacctataacgatttttttctcttcgttgatagtcgcccaattatctgctgaagtttttttgttcgaacagcctgcaaaaagaagaagacctgcgatcaaagcgaatagaaaactggtttttttcatctctatcttctcctttcttaatgaattggggaaacttttagtaattgatcaccgacattttctgcaaatactaaatcatgggtgacaataatttgggttaccccatcttctttcaatgataggatcaaacgctcgacttgctggcgtaattcaggatctaaagcacttgttggttcatcataagccaatacccgtggattcatagccaatgctctggcaatcgctacccgctgtttttgtccgccagaaagctgataaggatagatattcaataaatcactaatccctaatgaagccgctaattcttctgcttttttggtgtattcttcttttgtctgtttcaataccatttttggtgctaaggtaatgttttcaaaaatattcagatgtggaaatagctggaagtcttggaatacgactcctacaacttgttctttcattttaagctcgaatgggttgaacggtacaccgtctaaataaaattctccgctgtcagaactttctaagccagccaagatacgtaaaagcgtggttttaccgccaccggaaggacctacgatagctaatgttttcccatctggaatgattagattcaaatctttgattatttttttttcaccaaatgctttgttcactttcttcaattcaatcatatttcttcctcctatcagttagcggtaataatttaattttccttcaacttgtttcattacgattgttagaataccagtcaatgtaagatagatgattgccacgcctagcaaaggcagtaaagtcgcgtcgcgttccatcgcgattttcccagcacgcattacgtcacctaaacctaatatatagatcaaggaagaatctttgaccaagttgataacttcattccctacagaaggtaaaacaatctttgtcacttgtgggatgacgattttcgtcaccgtttgaaagggacttaattgcaaaacttgcgctgcttcatattgaccttgaggaatcgattgtatccctccacgaaagatctctgcaaaataagctgcatagtttaagataaaggcaatgagtgctgcttcgaaacgatcaaaaacgatcccaatcgtcggcaacccataaaaaataaaaatcagttgcaacaacagcggtgttccccgcataacccatacatatgtttgaagcaagtagcgtagcggcttaaaatgcaaagacaatcctaatgctaaaacaatccctaatggtaatgagccaatcaaggtaaataaaaataatttcaatgttgtgagtgctcctactaataattgcggcataacttcaatcaaatactccatcttcttttcctcctttaaaataaaaaaatcctcttggcaaatgccaagaggacgtattatacgtggttccacctctgtttattttttccttgcagaaaaaacctcacacagtcgttgccgttcagatgaaaacaaaaagtcctttgatccgaagatcaaaggacgttaatcacgtggttccacctttttttaccgactcctcacggaaaagccagccttatctggtcatctagcaacgaccgcagctgtaacgggctccccggattttcctactatacgcttcagaaaatcgactccaagatgtgtttcacggttaactgctgcctctttccaccaaccagagactctctaaaaacacctaacggctactcttcttttcgatgtcatttgttttaactttacgtgtaatttacatgattatttttcatttgtcaactcttttttatgatacactaataaaaaaaggagggtgatgcgcgatgagtcgtgcaaccgaacaagaagcttatgaactactaaaaaaactgggtatctcttttcaaaaagtcgatcatcctgcgattacgtcagtcaaaaatgtccctttttccctacctggtccgcaagtaaaaaatctattattgaaatcaagaaaaggaaaacaaatctatcttgtcatcttgcctgatgaaaagcacgccgatttaaaacaactagctgaacaattaaaagaaaagcgcttatcttttgtttctgaagaacagcttcctgacctcctaggcgttccagcaggtacagtgactccattagcattgatgcacgacaaagagaaaaaaatccaagtcgtgatcgatgctgctattgatcgtcaagataccgtaggctttcatccaaatatcaataccactacgttgattatggatttttccgactttgaaaagatacttgtttacttagaacatctgccagtttatgaaaatttgtaatgatagagtagttttcttatttcccaattcaagcgtctttttctttatttagcacaaaatatatcagaaattcttttggccaatcaaacaatgtaacaactagtatgaacgctgaaaactaatacgagtattcttccatagttagccaaatccatatttattgattctacgaaaaaagaagcatatataaaaatgcttcttttttcgattataaatcggaattttattcttttgatttcagtcatatttaacaaaaaatattatattctaactaaacttttttatatttttgtaagaatatcccagcacagatagttactatcaataaaccaatgattacagcaaaactagattttttactacttgttttaggaagaatgctttttgatttatttgttatctgtttaggtacagctctcttactaatataattgcttctttgttcgctggattctcctgtatgagcaaatatttgcaatttttgagagaatagatttctaattttctctctctctgtcttctctggaaaatttttccacggtgttatatggctacctggtatagatatatttgttttttccggtgtataactgtttttgatgttatacccgtcaatcgtcgtactgtattcgggcacgttgtcttccgttacagtatagatgatttcttgcccgtctctgtattttggcagatttgtgaaacgatagcgccaatcatctttttcacttacttctttgtgttggatcggttgaccgtcggctaatagatttactgtgatcgtcgtcggtcgtttgccgtcttggttctcattgtcttcccatgttttttgtcctgagactgaaatgacttctttattctcatttgtaacgactagcccgttttcaattttttgataacctgaagggacataatcatttccgttttgatctacttcttgcactttaaacgtatattcgtttccactatcatcatactgttggatatcttcccaagtcactgaagttattccattgtctaatcgttttgtttctgcatcaggaactggttcccaattgtttgtacttgctctgaataatttaaaataaatactcggtcttggagtggttccaccgttccaaattttagttgctgtgatgttcgtaacctttttcttgttataaataggtaaactgactccctctgtatcattttcgtttatggagaatttgagttcatttgaacttagtggatcaaaatcaatccaattgggtgcttctttttcttttacaacatagtctcctacttgcaggcctttgatactagcttctccctgttcattcgaagtcaacaggatactagactgtccttgaataggctgttcatctgctcgtcttaattcgaaagtcacatttgggataccaatctctgtgtcattgatatatttgaaaatcttcaattcgcctctaactgtaccgttgactccaccagaagctgaaatatttttaactgtatgattgaaactttctccatcaacagcaggtttattaaattctttaaaccaagcttccgaatgattctcaaaatttatttgttctgggttttctatgatcgtcttataactcaccattattttcctaagattgacaaagttttttggtatagttatttcaatgtaattatcagttactgaaaaattaaatgtagcgctggggaaatcttgtaaaaattgttggattccctcttctcctctataaaccttctgttcacctaagtgtatttgattaatttcaaacgtacttggatctaatctttgtccactttggatttcatcactgattttaactggttgttcaacataagtgccgttattgttaatattcaaaaaccatcgaatgtgcttagtatcttcaggtagcatgtctcctgttttataataaaaaacgctagaagaagaaccagaagctggctttgtcacatttacagtagctgttttatcaccgctcgtcacggtgaatggtcccgtattttcttcaccggtatcggttacgtttctggcctgtatctcaaattgcccccaaccttctactgagtctaggtttttaatattttcattaaacacaacctgcgcagaatcttttctgaccgttaaagttccaacatttttattttcaatcattaatgggatttctttttggaatccttcaccgcgaatatttccttcacttggccaattgatccaaagataatcacctggttggatattttgttttttttcgtcaaacgagaattttacttttatgtttcctccatctgtaatattcgttgggtccacggtcaacgaagtgacattactgctgatatctctgcctgcatccgcatagacatgaacaggaatcagtgatgttatattagtaataataaataacattgataaaataatatttctacactttttcattttttctatctcccctattttaactaaaaataaaacctactatatcatctctcaaaaatcctttcttcaattcctcccccactcatttccaatcttttaactaaaaaattgatagttattttacaaatatttataaaaaataaatatgccaaaaaactgtttttacaaggtttttcctaatgtaaattattttttcgcatatattcattttattttacttattgctttcattttttcaatctatatttccaatttttaacttacaaaaatgcaacattaataaataacgatagtttcataaaatacacttttaattaacattattagtttatactagctgtttttgtgttaattaaaggataaaatacaatataaagaaacatctgtttctttatttagaataaaaaaatacagactctgttcaaataaatgaacctagcctgcattatgagattgactatactttttaattcattgagatgaataactcgtttttataaatgcccaaaagtaatcggtgccgaagccattcctcgacctaattctttttcaaattttcctattgttgatatctccatataaaacggtgatactggtttagacaattctcccctgattgctaacggacgtaaactacgttccaaattatttatgactttaggataatactgacctttttctaagcctgtctttgcgtctatcaaaagtatacgttccttttctttgatctctggatttaaaacgagatcatataattttagtaccatgttttctatttcttcacttttagacatcacgatttcctcccaaaaatatatttcttcccactacattctataaacaaagtatacgctacatctagatttttttaaatcattactggattgttaaaacctttcaatacactgttatggcaacgatttttattttaaaaacattctaaattaaatcagtaaaaatttttattctaagatttttattagaattacgcctaatttgtgtctctcagggcaattctaagaacgtttcaagagatagcgacactatcgttatcgaaaaaggcgaaaacctatctcattttctgctaatgtaagttggtttagcttttgttaatatgactttatgaaaatggaggtaattaaatatgatttttcctaaagttaatgaagcaagcttgaataaaggatccttttttcatatctatgaaaacgaagattttgaactgtataatatcctttcacaaaaagaggtcatcgaaaaccaaataatctgccatccaattatttacaaatctattttcaagtatgcattttttgcttccaatgattttcaaagaatggagattaccgactgtatattcgaaaactgtgatttttcaggctgtatattgacaaaaagcatgttgcatcgcgtgaaatttgtcaattgtaaattaacaggtactaaattgatggaaagttatattgggaacacgttattcgagaattgtaaaatggactatgtaaatttatctggttcaaacataaaagaaagtacctttgagcactctgtcttatcaagcgcagattttgtagactgttccctcactaaaataatgttttctactaatgatttagaaaatgctagcttttttgatactgatttaaaaaatatcgatttaagtagcaactcctttgaaatgattgaagtacgctcggaacatctaaaaaattgtacgcttaatcagttgcaagcacttggttttgctagaaaatttttacaaataaaagtagtataatcaaaatgaatatataagataaatttttagcaatacaaatatccataaaaaaacattgcctattttaactcttcatgtatactgactctatcttcaaaaactgaatagtaggagttattatcatgaataacattttaggaaaaaaaatagaacttaaaaaagggatattgggcactattgtcgttgtactcggtttgttagggttgctatttgcgccatccattattagcattttttctttaactatcactggatttatagcatttacacttgtttttggtaaaaaagatacgaaaaaaatgttctcgaaacctgtcgctcctgtcaaaaatatagccaaatatttttttatcaatgtagtaatcagtgccgcagtctcggtatttttgcaacaaattttgaaatggggtttaacaggcaatccaataaatgaggctttcagcccgttattatttattattttgcctatcatgatacttggagaagaattgttctcagtgtattttctcgctattttttctagtaagttcagcattcctgtcgctagtttcttgtcagcaatcatctttggatttatccattacagtacttatgataatggaaatattttacacactgtagcacacatccttttgatacaaggggtggcaagattgttattcaaccaagctgccattaaaagcaactcgatcattacaagttgggcagttcatgtgatatttgatttcacagctatattgctagtcgttttattctcctaaatttttatagaaataatacatgctctattgctaagaaagcatactttatttcctttaaacaaaaagacagatgtatcaatggattaaaaatccttgatatatctgtcttctcttttaatgccagctatagggatcgaacctacgacctacgcgttacgagtgcgttgctctaccaactgagctaagctggccttatccaaaagaaattatatactctatttggctgattgtaaagagtccgatggaaaattagtttaatttcatgatatttttcataaaacgtggtataattgatgtgaaaggcaggttttatgaaaatggcaacttttggaaaatttgatacaactatcgtaccatcggaaattggtgaaaaattcaagatcaatactcacgtaatgttcacaattcacggcaagtcgcaaactggaacgatttcaaagcaattgaaaaattccgctgttgttgagattgatgaaactgcagaaaatgcgaacttgatgacgcaaagtaagggtgtagtaatcgttaactacaaagaactaaaaaagatttgaatttgaccatctctgcatttttgggatggtttttttatatgcaaacgaaagctgtgaaaaagctgttctgcatcaaacgttaaaaatgaccaaaaaaggatgtgacaaaagttgtgtcacaccctttttcgtatttacttattttgtaccaaacaaacggtcacccgcatcccctagtccaggaacgatataaccatgttcattcaatttttcatctagagaagctgtatagatgtcaatatcaggatgcgcttcttgcaaagcttttactccctcaggtgctgctaccaaacaaacaaatttaatgttcgacgcgccacgttctttcaatgcatcgattgccatgattgctgatccgcctgttgccaacattggatctactacaaacaactgacgtgcatcaatgtcttctggaagtttgacgaaatattcatgtggttccaatgtttcttcatctcgataaagaccgatatgtcccactttagcagctggaatcaattccaagataccgtcaaccattccaatacctgcgcgcaagattggaataatcgctacttttttaccagacaacgttttttgtgttgtttcagtgatcggtgtttcgatcacgatgtcttccaatggcatatcccgtgatacttcatatgccatcaacatagcgatttcatcgactacttcacgaaaaacctttgttccgcagtttttgtcccgaataatagttagtttgtgttgaatcaatggatgatcgatcacttgaaatttgcccattttttaagctctcctttgttctgtcgtttctttttaattgtaaaacaaaatcaagtgattgactagtcaaactcgccatttttcctaagaaaatccgtttttgaaaagaagttttcctgcggacaagcaaagcttattcttttttcttgatccaagaagtagataatgccattgctgcacgcgttgcctttgtctgatccatagcatttaccatgacaaaatcatggatgattccttggaagcgtacttgtgtaacaggaacccctgcatcacgaagtttgcgcgcataagcctcaccttcatctcttaatacatccgcttctcccgttaaaatcattgctgaaggaagatcatttagttcatttatatttgctctcaaaggcgaagctgtgatttcagcacgctcttcttcattcgtcgtatattggtcccaaaaccacatcattccttctcttgtcaaaaaatagttttctccgaattcatgataggaatctgtatcaaaatcagcgtttgtgactggataatacagcaattgcttggatattgggaggccctttcgttcttttgttaagatcgtcatgactgtagccatgttaccacctactgaatctcctgcaacgattagattctcgagatccagattttttgacttggctaatttattcagctgttgcaacacagcataattttgttcaattgctgttggatattttgcttctggtgatcgactatattctggaaagacaacgacggaattcgtacgaaccgcaagttctctgatcaatttatcatgggtttgagcactgccaaaaacccagcctgctccatgaatataaaaaataactggtaatttatccatattcccttctggtcgtacgagacgaatattgagttttccccattcgccagtatccaccatcaagtcttcaatatcgacggaatatttgttcacaggtgattcttgtacttcttctagtaaaactcttccttcttccggtgctagttcatagatacgcggatgaggcgcatttgcatcactgaatgctactgcttccttttctaacgagatacgatcagtcatgacttttcctccctgagatttagtgtgaagactaaaattacacctcatatactagagagcatcaccgatattgtcaaagaatccgttttcccaaaaaataaacagaaaagcccaacattgaacttttctgtttactaatggaatttaaatttttattttttatgcaacggaaatttttcagttaattcgcgtacacctgttttgacttcgtctagttgagcgttatcatcttttgcttgtaatgctttgacaactagttcagccacttttacagcatcttcttctttgaacccgcgagtagtgattgctggcgtgccgattcgaataccgcttgttttgaatggacttagtgtttcaaaaggaatcgagtttttatttacagtgatattcacactgtccaaaatgctctctgcttcttttccatttatacctaactcgcgaacatcgatcaacatcagatgattatctgtcgcccctgaaatgactctggttccaattgcttgattgaaaactttgaccattgcttttgcattggcgatgatttgttcactatattctttaaatgcaggatctaatgcttctttgaatgctactgctttacccgcaatcacatgctctagagggccgccttgaataccaggaaataccgcactatttattttttttgctaatgcttcatcgtttgtcaaaatcatgccgcctcgagggccacgcaatgttttatgagtggtagtcgttgtgatatctgcataaggaactggattaggatgaagtcctgctgctactaatcctgcgatatgtgccatatctaccatcagttttgcgcctacttcatctgcgatttctctgaatttcgcaaagtcgatcgttcgtccgtaagcactggcacctgctacgatcaattttggttgatgttttctagctaaaatacgtaccacattataatcaataacttctgttgtcggatcaacaccgtaagcaacaaagtgataggttttgccactgaagttgactggtgatccatgtgttagatgtccgcctgcggaaagatccattcctaagatcgtgtcccctggttctaccaaagcgagataagcagccgtgttggcttgagagccggagtgaggctggacgttcgcaaatttcgctccgaataattcttttgcacggtcaatcgctaaattttcaacgatatcgacaaattcacacccaccataatagcgatgccctggataaccttctgcgtatttatttgtcaagatacttccttgtgcagccatcactgcttcggagacaaagttttcagaggcaatcagctccaaattatgttcttgtctttcttcttctttggcgatcgcagcccaaagatcagggtcaaacgttttgtaatctaccacaaacaacagctcctttttattttcctacaattttatttttcccatcaaaaacaaattgccaaatattcgtatctcttctattacgattagttacgcttagtttttcgttcactgatagaagatttacttgatagcattgtatcatactaaaagaatgcgacaataaccaattgatcatttttcaaaataattttgtcctgctgcttttttcaagcgattcatgtaagcattccccaatccagtttctggatacacttgtacaaaaatcaaatctaatccaagtgttggttcatctaatcctcttagacctgcaaacaatcctttagccgccgcttctactgagttgtcgttatacatataaacagctgcagtatctgtccgcacttgatccgcaatttcggggcttgctatgacacctgcacggatcttcttattttttgcccattgaactgcagttgaccaatcgccatctctgaccatcagaacacgtgtatcgggtgagtagtgtttgtatttcatcccaggggcttttggtgtttcattttcttttacaagatgctgatcaatagcaacaggagattcgatgactgcttcgatttgttctttcgttactgcacctggtcgtaaaatcataggcatggctgttggatcacttaaatcaagaacagtggattctacaccaattcgcgtagctccatcatcaataatcccggtaatttttccttgtagatcatgatatacatgatctgcagtcgttggacttggttttcccgacgtatttgcacttggaccgacaagcggaacaccggaaagttcgattacttctagtgtttttttgttatccggtatacgaaatgcagctgtggataatcctcccgtcacaactgagggcaaagtgtctttttttgatcttaaatatcaaagttaatggtccaggccagaagttcttcacaatcttctctgctgccggatgaaagttgtccacatactcttttacttgttcaaaagaggcgacatggacgattaatggattatcttgcggtctcccttttacagaaaacactttcttgacagcgtttggtaaaagagcgttggcgcccaatccgtatactgtttcggtaggaaaagcaacaagttctccttctttcagtgcttcggctgcctcttgcaattctgtttcatcatatcgtttcgtttccacagtttatccacaacccctttttcatacattcttattttgtctgagtttatcctcaagttttccactgtttgtggataatctatttgtcaatagtggataaacttgttgataaaccaaaaagtcgtttacatccttgtcaaataagtgtttttttataataaaaaaacaaataaaaaatttttcatccacaacttcaaccataaacttggatcattcgttcattgccaaaaagatccttttttatcgccacttttttatctggaaatgcttgctgaaatattttttttactgcttcaccttggcgaaatccgatttctaaaaaaatctttccatttgattttagtacgcttggtgcttcaactgctattttttcataaatagctaatccatcgttctcagcaaaaagggccattttaggttcgaatgaccggacactttcatccatcagttcccattcattccgactgatgtacggcggattagaaataatcacatcaaattgctgatccattactggtcctaatgtatctccatgataaaaactgattttcgttccttctttctgagcattttctttcgctacttctaatgcttcttctgaaagatccacagcagatatatgccaattttttcttgctgctttcaaactaatagcaattgctccagtccctgtcccaatatctatcacttctaacggtacaccaggcgtctcgtctaaacaccattcgactaactcctctgtttctggtcgagggatcagtgttgcttcagttacctttaaccgatgatcataaaaatctgcatatcctagcaaatactgaggtggatgatctgcaagcagaagtcgcagatcggtttcgatcaaccgctgttcttcttctgaaatctcttcgttcatatgaaggagccaatcaagttttttccattgttttcgttccaaaaataaaaattggatactatatgcttctttcccatgatcctctaaaaaagaagaagcccgtgacaggacttctcgataggtcattttacccattttgcatagcttccagttttgatgtttgatcatacatgatcaatgcatcaacgatctcatctaatttccctgctaaaatctgatctaatttttggatagttaatccgatacgatgatcagtcacacgattttgcgggaaattatacgtccggatccgttctgaacgatccccagttccgactgctgattttcgattggcatcatactcgctttgtgcttcttgctggatcttatcgtacacacgagcacgcaagattttcattgctttttcacggttcttgatttgagaacgttcatcttgcatagcaacaacgatccctgttggtaagtgagtcaaacgtacagcagatgctgttttattgacgtgctgtccgccagcacctgaagcatgatagatatctgtacggatatctttgtcttcaatatcgatctctacttcttcagcttctggcatcacgacaactgttgcggtggaagtatggatacgcccttgcgattcagttgaaggaacacgctggacgcggtgcgcaccactttcatattttaatttcgaatatacgttgtctccggtgatcatcatgatcacttctttatatccaccgattccggtaacgttagcttccatcacttctgttttccagccttgtgcttcagcatacttttggtacatattgaaaagatcgccagcgaataatgctgcttcgtctccgcctgctgctccacggatttccatgatgatatttttatcgtcatttggatcttttggtaaaagcaagatcttgattttttcttctaagacttctttttctttttttaattcagataattcttcttttgctagttcagccatttcatcatccagtttttcaccaagcagttcttctgtatcggtgattccttgtactacttctttataacgacgataaacttcgactgtttcgcgcgtgtttgcttcttcttttgaaagctgcataaaacgctttgtatcagaaatcacttctgggtcacttaaaagttctccaagctcttcataacggtcttcaattgcttgtaattgatcgtacatgcttattctccttctgtaatcattgatgggtgaaagtaatgttttcgacaaacggggtaataagcttcatttccgccaatttgcacttgatcgccttcataaacagggtttccatcaatataatgtaaattcatgattgcttttttgtggcagaaccaacagattgttttcatttcttcgattttgtctgcataaagcaataaatattttgatccttcaaataactcgtttcgaaaatcatttttcaaaccaaatgccataaccggaatatccaattcgtccacaattctcgtaaaagcaatgacatgtttcttttttaagaattgcgcttcatcgatcagcacacaatagggtttgctttccattttctgaattacgtcaaatacgtctgtttcttcaaatatcggcatcgcattacgtttcagtccgattcggcttgaaacaacgcctaaaccatctcttgtatcaataccgcttgtcattaagacaactggcttattttgttcttcataattatgtgcgacttttaggatctctatcgtcttgccgctattcattgcgccatacttaaaaaatagttgtgccatgctctttttcaccttccagtttgttcctatggtattatacttgattttcagcattttttacagtgagaattttcatcaagcacagattagtattaaatctattgctcacttttgttccaattttttgacaagaactaaacatgggttccattcatcccataaatttggaaaaacttccaaccttgaaaatcctaatgattcgtagaaacaaatagtttgatcatatatagagtagtgcccctcgtctacagtcttcacttgcaaatatttgtaatgttttgctgcgtaaccttctgcttctttaaaaagttttgttcctaatccttggtgatgatagtctttttttattcccatacaatagaatagatttcggcagtatcttcacttgtctgtgaaagagtgataaagcctaaatattcttcttttcttttttcacaccataaaggtagtttacttgattcctcgatatatttttccgttgattcaggaagcccaaaccactcaggcaagtctagtaatatttctcggacacactttcctttttcctctctatcttttacaaacgatatcggcatattctttctagattctccctttttgaattgagtatagcatgctttctttcttttcacgtgctataataagttaaaatttcaaagttttacgtaaggagctatttgatgacaaaaaatatttttgattccatcgctaaccattatgattcccctgaccgtcaagcattagccaagattattcgcgaagaactaactacttatctaccgcgcgacagccaccaaaaagtcctgctggattacggaggcggaactgggcttgttagtttaccgcttgcggaaagattcaaagaactgatcattgccgatgcttcagaaactatgctgaaaatggcagaagaaaagatccaagcagcagatctgaaaaatgtccgaacgatccacgctgatgcttctgtcgaatttcctgctgtccaagctaatctcatccttctatcacttgtacttttacacattcctgatacggagaatattcttacaaaactttatgaaattttagctcctggcggtcaattgatcatcgtagactttgacaagaatgaacaaattagtcatccgaaagtccataatggctttagccaagaagaattgaataatcgattggaaaaaacgggctttgtctctgctactagtcataccttccatcgtggggaaaagctatttatgaacaaaaacgcttcgcttttcttatccatcagccaaaaagcttaaaatgagattgcaaaaaaagtgagcaactccaagaaataagaaggaattttcggaaaaagaagctgtgacaaaaaacatgtcacagcttctttttattttttcatcacatgattttaatttctgaaagaggccaataacggaaaacaacttttccttggatcatatctttgtcgactaacccaaacattcggctgtcttttgaaatcaagcggttatcgcctagaacaagatactttccttttggcacagtatattcaaagtcactcgtaaaggtggatgaactttctgcttgtgcttggaatcctgagctataagcatattctccttgtaacttatcttctgaaaattcttttttgaactcatccagataaggttcatcatactttttgccattaatggtcaactggtcattttccatcttgactgtatctccaggcataccgatgatccgtttaacaatcatccgttcttcatcccccggttcctttgtagtaataatatccattcgttcatagtttgagatcttagatgaaatcaatcgttgtccatcacttaatgtagggtccatcgaatgcccgtttacagtaactggtgtaaacacgtacactctagctaataaaatagccgctaatacaaggatcaaaatcccccaatttttcaaaaattctttcacagcttacctcctacttgtattttcctcgttatttattacgttttttcacaatacttcgttgtactttctttattctacaatgtttataaatgaaaggaaagaataagtgatgtgttcgtcttatctttctcgttatataaaaaaggaacgtgacaaaagacgtgtcacatcccccttattccgaataaacgtttttatcgcaaccactgatacacggcgtttcatcacattatgaatgtcttcttctttggctacgactataaaccactggttcttcctgcgactgtgccttttttgcaatcaatttcagacgataaggctcatgatagcgtaacccgtctttgacaaaatcaccgccgacgatgaacaatccgacaggttccaatgtgtcttctgttgagtcaagtcgaatggtccctactttttccatgtccgagtagcttcgtccaatatttagaacatactctttctctcctgttttcttgacatagtaataaggatacaatgtatttctatcgaccagaaatccatccatgcgaccgagttcatttgttttgatctcaccatttccaatcaaataccgcatattctcggctaatttcaattgataatcttcgtcataagaaaccatgacctcttgtgtattcactttatcgatcgaatttccattatctatcgattcttctgtctggatgttgaacgcttcatcaggtaaatacttcacaaaaagctgagtgacatcggctttcgtgtttttatctaaaaagtaataaaatacatttaaaacagtaaaataaacaagcactagaaatgcaagtccatataagaaaaattgaagatagttttggttttgccaaagtccataaacaattctcaataaataaagcgtgggaatcacacttaaaatcgtatatccacggttaagatatttaggactgatgtctaaatagccaaggaatttatgcaccccgttgataaggtctagtaaaaatgtcattgagaatcacctgcttgctggttatacgtttgggtatttcctgaatcttggttttgctgtgctgtacgtgctgcatcatcattttgcgtgttatcatctacagtcgtactgcttggtatcgtttcggagctagcacttgtatccggacttgtacttggattggttgaatccgatggagtgccatctggtaccgtattacttgtttcgcttgagctgtcagttgtatatgtctcatcatacgacgaactagttgttgtatcgtcccatgtacttgtcgtagtggtttcattcaaactttccgttgttgttggttcagatgtcgagactgaagtagttggtgttgtttcttctacagtactagaacttgaacttggtgcacggtagctggaactattcacaatacctgtagtagtcgcgacaatcgtcgagattgttaatacagcgattggcttcaaaataggtgctacttttcgcatcttatctcttccttcattgaaatttattcttgtttccttactttactacggacaaattatacagtctaccttatttctaccataaattctttatttttttcttacgtttttccgaaagatttctttaattttcctcaaaaactacggttgatgtttttaagtaagcttttgcttcccgattgatttctttcagatcgcatccttgctgcttggcagcgaacacgcaaccacaataacattggcgataaatatcatactctttgcacatttgcaaagagcgttcatagcctttgtttttcttgaaatcacttggcaagtattgtgtcccgtaaatcttttggatatccattccgatctgattgatcaaagctgcatttttctttggcgagatggtcagggcacttccaaagtaatcgtatcctagttcttgcgctttttgcgcaacaagatctaatcgcatattgaagcatgcactgcagcgagcaccaccttctttttcgttttcaagatggtttgttaaaaccattttggtgaattcatttggacggtattcatcaacgattagcgcaacatgatggtcagttttctcattaaattggtctacaaatcgtttttgttcatgtaatcttcgcaaatactcacttttaggatgaatattcgaatttgaaaaaaataacgtgatctctgcatattgagacatgaattccaatgtgtgcgtactgcaaggagcacagcatgtatgtattaatatcttaggctttacttcttctttctcccattgcatgatcatttttttcagaactgtatcataatttattttttgatttttcattttttctacgatttgttgagcattaatcaatttgttattcctcctccttcttttttctaggattttccttattataagccatttctattttaatcgaaagctgtattgttatctgtttgataatttctttgagtattcctaattccccttgtatactggtagaaacgactattgtcaggaggatagtactgtgcatgttgatttattctttcgaaggctgcagcggcgaggacagaagtttgctgccaatcatttctcatcgatccaaatcatcgttttttattatatattgatgacggtcttatcactcgttctattttatatgccgatttttcgcgaaccagatagccatgtttcttttgtggacatgctgttcatggcaatcagtacagtgagtgtgactggactatcgacttttgatatcaattctgtgttcaatgataacggtattatactgctggaaatattatttcaagttggtggtttggggatcatgatgatttctactgcttttgtcattttttctaaacgacggatcacactgaaacagcgacagctgatcatgacggatatgaatcaaccgcgtttgtctggtatcgtccgactgattcggatcacttttgctattttaatctggtttcaattactttttgggacattcttttctatttatttttattacagaggctattttgatcgttggcgtgatgccgttttttacggtttttatcaggcgatatcggctgtcacgaactctgggtttgacgtcactggggattccatcaagccctttgcacatgactattttttcttgatcctgatcatgtttttgatttttgtcggaggaattggttttcctgtattgatggagtgccgggaatggctattatacaaacgttccaatgcgaagcttccgtttcgtttttccttgtttaccaaattagctgtgttagcttttgttatcttgtttgtttcgggaactgtcttgatttatctattggaaaaggaccatttattccaagattccaatatgagtgtcaaatggatcaattcgatgttttattcgattacgactcgtaatgctggtctgcagattcacgatttgggtgattttcaaatcacaacactgatcattttttctttactgatgtttatcggatgcagtcctagttctgtaggcggcgggattcgaacaactactgtagcaatcatcggtttgtatctatattccttcctcaaaagtgaagataacatcaatatttttggacggagaatcgatcaagatgatgtgcgaaaatcagtcgttgtctttatgctttctcttggtatgtgtttcttttgtatcgtttttttatctgctacagaagaacaaacgctgatctcgatcatcatcgaagtaacttctgcgtttggaacaactggtttatctttagggattaccggagacttgtctgttgtgggcaaaatcacgattgctacactgatgtttattgggcggatcggaatgctatatacattgatgttattcgtgccaaaagaaacacgagatctaggctatgaatatccaagcgagaaaattattatcggttaaaatgggaatataggtaagagggaataataaaatcacagcagcttgaaacaatcattttgtttcaagctgtttttttgttaaatcatgcgattttgtccgatttcatgcactttcagccgtaaccttttcttaagaataagaaaagcaatttaacctttttttcaacatatggtatgattagttgaatttattcgtcagcaaatcgtttttggaggttacataatgggaatacgcagtcattttgcgattgcagttggaaaaacgtcgcaatgggcattaaaaactttttttaaaggcggatcaagtttaccaggtaaactagcgctgaaagtcgatccacatatactagatagtttggcaaaagactaccaagtcgtcgttgtcaccggaacaaacggtaaaacattgactaccgctttaacagtcaatattttgcgccagcaattcgatgaagttctaaccaaccctactggtgcgaatatggtacagggaattgtatcgactttcttgcaggcaaaaccaaaaaaaggacagaaaaagtttgctgtcctagaaatagatgaagcaagtttgagcaaagtcacagaatatatgaaaccagaactgttcttatttacaaatattttccgtgatcaaatggatcggtatggagaaatctatacgacctataaaatgattgtagacggtgccgcaaagtcaccaaatgcaacgattatcagtaacggtgattcaccaatcttcaattctatcgaaacagtcaatcctagaaaatattatggctttgaccatgaagaagatcgtgaacaaatggctcattacaatacagacggtgtcttatgtccaaattgtcatcacatcttgcattataaaatgatcacttatgcaaacttagggaaatattactgtccaaattgtgacttcaaacgtcctgaattggattatcgattaactgatatggtacggatggacaatgtgtcagcagatttcgtgatcgatggtcatgaatacggaatcgaagttggcggtatgtataatgtctacaatgctttagcagctactgcagtggcagagtacttcaatgtcgatcctgataaaatcaaacaaggtttaggatatgacgagaaagtattcggccgacaagaagtcatcaatatcaatgggaaaaaatgtacattagtacttgtcaaaaatcctgtaggtatcaatcaagtaatcgatatgattggtctagctccttatccattttctttagtggctttattaaatgccaattacgcagacggaatcgatgtcagctggatttgggatggtaattttgaaaactttgccgatatggatatcccagctgttatttctggaggagaccgtcatacagatatgactttacgtctaaaagttgccgggattccagaaaataaattgacagaaacaaaagaattaccagaagtaatcgaaaaaatcaaagaattgccaactgagcatgtctatattttagctacttacactgctgtattgcagcttcgtaaagaactagctgctcaaggatttatcaaaggaggaatgaaccgtggctaattatgaactcaatatcgcccacctttatggaaatttgatgaacacatatggtgataacggaaaccttttgatgttgaaatatatagcagaaaaaatgggggtttcttgccatacggagatcgttagtatacatgaaccttttgatgctgataaatatgacttggttttctttggcggtggtcaagactttgagcaattaatcatttcaaaagacatccagaaaaagaaagattctttgatcaactatatcgaaaatgatggcgtcatgttagccatttgtggtggctaccaattgctaggtcactactacatgggagctaatggagaaaagatccaaggaatcagtgcactggatcactacacgttaagtcaggaaaataaccggtttatcggtgatatcgttatccataacgaagaattcaatgaaacttattatggatttgaaaaccacaatggtcggactttcttaggtgaaggtgaacgacctttggggaaagtggtacaaggtcaaggaaataatggtgaagaccaatctgaaggtgtcatttaccgaaatgtcttcggttcttatttccatggacctatccttgcaagaaatgagaacctggcagctcgtttgatccgcctagctttagaacaacgttacggtaaagaattggatctgccctatcttgaaggacaaacagcctagttattcgaaaaaggggaatgtgacaaaaatttcgtcacattcccctttttcgtatcctattttaagcgacttgcttggcataacggttcacgttttgcttgatattcccgattgttttcggatcattgattcctgtgacttcttgaatcaattgttccaagttttcatggatcttcatttcatgcaattgacggctttgttcatcttcaggatcatagtaattaaaaataatccccattgttgccgtcaaatgtgggcaagtcaagttatgttcttgtagttctctcactggacgtgtaaatctttcttgataacctaacttacgtaatggtgtccgagcgacacgtgtgatcgcatcagagatatttttgttttggaagcgatgaatgattttttcaatatacgcatgatgctgctctgcatcaaacccccatttggcaatcagcaaacttcctgtttcctgcaaaactgattttaattgtgccacaactaacgcatcttgcattgcttcatcaatggtctggtaacctaacaaggcacctgtataagcgacagtcgcatgaccagtattgacactaaatagtttgcgttcgatatatggttctagatcatctacatataaaaccccttttaattggatttttttattttttctttggctatcgtcaatgacccattctttgaaaggttccacttggacgaataaaggatcttcatggtgttgtaatgggacgattcgatcgactgctgcatttggaaagccgatatatttgtcagtaaatgatgtttccggaagatatttatacacttctttttctagaaatgctgaaccgccaatcatattttcacaggcaatgatatctaaagatgttgtgcttccttccttttctctttcttggataccttttgcaatcaactcagcaataaaaggtaagatattcgggccaatggcggtagtaactaaatctgcttcagcgatttcttggattactttttctggatttgtttgattgttgattcctttgacattttttacagtgattttttcttttgattcatctgctaattcgatttcgtattcttttctttcatttaaagcatcaatgatcgtgtgattcacatctacgaaagtaatctcaaatccattagctgccaaaacctctccaataaatcctcgaccgatatttcctgcaccaaaatgtactgctctcatttttctctctccttaagcaattgctagattttccgttacttcttctttgctgagcgcgtctgctagctggacaacattgtccatatcactgcaataaagtgcgatttgctgtacaagttgcaaatgctcatctccgactcctgcaataccgaacaaaacagtcgcaatcttttcttcttcttcggtaccaaaatctacaccatctggtacttgaacgacacagatgccggattttttcacatatttttttgcttcatctgttccatgaggaatcgcgataaaattccccatataaacagataacattttgtctctatctaccatggcatcgatatattcctcatcaacgcaccctgcttctacaagcatctgaccgcaatagcggatcgcttcttctttggttttaaaagatcgattgagctcgatcatgtcgaatggcaaactttgcatgctgttttcctcccttaagctgtctgtttcaaatattgtgcaatcgattcgtatttttgcggattgaccatgctgttgactgataaatgaatggattgaggtgcagccatctgtactttttccgctaaactttctttggctacgatcagtgaatcaggttcatcttttaaatcttggatattgacttttcttaacgggatagttaaatggttcttgtctaatatatctttgagcacggtcatccccattgttgctgatccggaacgatcatcgtggacaagtagaatctctttgatttgtttgatgtttgctgaaagaaactcttctgctggctcattctcaatttcagaaactgatgttttctgcttgctgcttaattcttgaatgatttcatcatatcgaggtgaattcaaaaagttttctactgagacaaaacgcgcgctcggtgctttttgttttgctctttcttgtagttcgacctgagtaacgatcaatgtattcgagtcatctgtcagttggctgattgcttgattggtcaccgtttgaggcaagtctgcttcctgtactttttttctcaagatcgaagcgcccatcgcacttgatcccattcctgcatcacaagcaaaaatgattttttgtacgccagagaatgtagctccttgaggaataccttgggcacctttggaagcttgcttagctgcctttgtctcttgaacagatttttcgaagtcttcatttgtatctttcgcatccgctttcaaaattactgcagaaataccaaacgaaacagctgcggcaacaatcacgcccaaaataacaggaaggtaagaattgaacggtgtcatcgctagaatcgcaatgatcgaccctggagaagctggcgctcttagtccagcatccatcaattggaaaatgaaacttcctgacattcctccgcctataactgataagaataataacggtttcatcataacgtaaggaaaatagatttcatggatcccgcctaaaaagtgaatgatcatggctcctggtgctgaagattttgctgctcctttgccaaacaaagtaaaagcaagtaatacgccaagtcctggaccaggatttgcttcaagcaagaatagaatagattttccagcctctgctacttgttcagttcccaatggtgtcaaaatcccatgattgattgcattattcaaaaataagatttttgctggttcaataaaaatacttgtcaatggaatcaaatgggcagataaaatgatctctacaccttttgccattgcttgagtcaatgcatcgacaactggaccaatcgcagaaaaacctaataacgctaatccaaaaccgataagacctgctgaaaaattattgactagcatttcaaaaccggatttgatccgtttttggaatagctgatcaaatttcttgatggcatatccaccaagaggtcccatgatcatcgcgcctagcatcattggaatatctgttccgacaatcacacccatcgttgcaattgccccaacaactgatccgcggtcaccagcaattacttttccgccagtataaccgatcaataaaggaatcagataagttagcattgggcttaccatggtagcgaaagcctcatttggtaaataaccatctgggataaatagagccgttaatacaccccaggcaatcagtgctccaatatttggcatgaccatgcttgataaagtactgcctaatttttgtaccctcgcttttagcgaaatgttgtttttgggaatcgtccgttccattttgtctctccctctctccttttgatactctaattgtatccgcttactaaaaagagaaatagtcgtactttggcacgaaactttgtgccaaaggtttgagtatgtcagcaaaataaaaagatttcggtatcagaaaacttcaattttaaataaaactgttattttaatttttttataatatgcaaacaataacttttgttagcatttaatttagatgttttccattctattatgttattaaattttatattggaggcctatctatgacattactgatcaaaaacatgaacatgaaacgtggtaaaaaacgtgtgattcgacaattgaatcttttagtagaatcaggagaagtagctgctttgattgccccgaacggatttggcaaaacaactttgctgaatggcattgcccaactgctgccaacaacttatgatcaattgtcccttcacaacatctctcctactgcttatacagattatcgccggtctttcttttttctagaatcaacgaatcagttatccgactatctatcggctgttgattatttgactttgatcaaatactattggcagagcaaagtagaatgccaaactgttttccaacgattgaagatgactgagtaccttactttgccgattggaaaaatgtctctaggaatgaaacaacatgtcttgcttgctgcttacttgatcagtgattcatctgtcatgttattcgatgaaccgttgaacggattagacccaggaagtattgatatcttgaatagcctcatcagacaatggcagaaagaggggaagacgattcttctttcttcccacgctatcgcgaatatccaatcgatttgttctaaagcatgttttctaaaaaatggagaaatcgtcacagaatcctcaaatatggaagagattttagctatttatcgtaaattatatgaggtgtaactatgtctttacttacatttgaacgcaatctcttactaaaaaacaaagtaaactttttatttcctctattgttggtcgtgctctttgcattcccacttttttttgatcataaacttgcttatacagaattcgatgaactgaatcataactatgaagagatgcaacgtttgattgaaacgttgaaagaagatgagaatgagaaagaatttgtggaaagtttagagaaaagcaacaaactgatcgaagcaatcttacatgcaaaaaacacagggaatgtccagcaaatggtcgaagcaacttatcattatgaaaaagatatactggatcgactgatttctggtcaaagacaaggaattccaatcattgaacaacaaaaacgtgtcgagttgctccgttatatgaaagaacatcagatccaaagatattctatttttgacttgccagcgcatctctctttagcaaattactacgaaaatattttttcaggaatgatttctagttttttgattttatgtataaccgccttgtttctttcttccatcatctcttatgaaaaaagaaagcaggtaatctctctagtcaatctattaccggatagtatggtaaagaaacatagcatccgttttaccatttattatggtgcagctatgctaagtctcgtgatgccatttttgatcgtctctatactagtaataatcaaaaatggtttgggagacttccgttatcctgtaggaacgatcattggtcaggagatacgaatcctgccgatgtatgagtatcttttccagagctttctgttcctgttgttgtgggtgctctttttaagtacaatcagttttcttctatctgctttatttgaacattctctagtcaatcttttaggtacacttctttgtcttttcttagcagagtatcgcttgttttcttcgattggatggatagaatcaatcagtcattacttgccaacttcttatgttgattttcaaaatgtgatcataggaggagatattttctcgccactagcttcagaacaggttactttcatgaatggtatcttgacacttggtatatggagtatcgttttattattcataggtatgggcactatctatataaaaaagagctattaaaacacaaaaataataggggcggtgacaaaaaccttgtcaccgtcccctatttcaaataaacggttttctagaataaatagttttcaaaagcttgcatccgcagtaataagaacctcccaacaaaaatagctcctcttatttttatcttggttgaagttattacttgatgcaaggcagctttttttactgtgaacattggttatatatgtccatgttcaaaaatcatttggacttcttcaatggtttccgcatcactgagcgccattacttggtcgatgtctgaacagaaaaaggctaaatcttggagcaccgctaactgatgttctttttttaaagccactacaaataagagtgtcgcgatttttggttcctcttttgttccaaagtccacaccatcaggcacttggactaaatagattccttcttctactacttcttcatctttgtcagtcccatgtggcaaggctacgaaattcccgatatagacactcgctttttcttgtctttcgatcattgattggatatatgccggtttgattcccccttgttgggtcatccactggccgatctcggtcaacgcttctttccaattttgataggattgatcgagcaatattttttctgctggtagctgtatcatcttttcaccttcatttctttatttcttcaatcaggattttcgctaacaactgataaacgatttctttatttcctgagcggaagatctcggtgttcaagtcattcatgatgattgctccactgatctttcctaaaagaatcccgtctttttcttggattggcgaaggcgccagcataactaacatacgggacaaatcgactggctgtctatccatcccttcaatggtcaacggatgtttcaaattgaaaatacaaaagatcggtttagaaatcaatgagctggatgtatggaataaccccatatttgtatgaggaataccgataggtgcttgttcatatcgcttaagcagccggcgatgaaccacctcttcatccgttactagtccttcaggaaaataaggaaataagctgcgaatcgtttcggaaatcgtctcaggattatccagttcttggataaaaaaacgaccgagtaattgattgatttgatccatgaaatgcattgtttcctcataagtatcttctatcatccactcgttattgctgttatacgtaattttttgcctttttttcttctcaatatgcgaaaaagcttcttttagctgcttgacttcatcttctagcagtagcggggagactaaaatatattttccaccgtatcctggtaaaatagatgtagaaataacaacatcatattcttcttgtaaatcgattttttttaaatcagcaatccgatagaaatgaatttgttggatgaagggaaaataccttttcaatcgtagttccaacatgctagtagaagctaatccacttggcgaaaatcctgcaatactgatattgctttctttcggacttcgttccaatgaattcgcaaaatgaaggaccatataagcgatctcttcttcggataattttttttcttgaaaaatccgctctactgctttacggattgcattcgcaacttcctcgtattgaaccatgattttttctaaaatcggattggtcagtgtctcttcttgtaaaacggctcttgaaaacacaccagataaatgagtcaacagcattttgtacaaagtttcatcttcataaaaatggacattcgtctcttcacttacttcttgaatcagttgttttactaaataagcaagctgtgtatcgaacgtctcttcaaagaaattctgatcaaatgagttcgtgaagtcatttaataatcctgcaaaaaagacgatctcatttactggataaagttgttttgtctcagaagcgatccgtgaaaacaatcgtttagctgtctgtagtaattctttgtttgccagactattatatgtctcatttgtcagtaaatgatttttcgtcacacgctccatcgtcaatgtcagcatcaaaaccaaatgttcaagctttctatcacttagattggtctttttttggatcaattcttccccgattactttgcgtgcaagagatagatgttgcggatcaacgaatcgaaaaaaataattcagtgatgcatcgaaagaaatactatgaaaaagttcatattcattgatttctaattctaatacattcgctgtcagaagccggcggtatttttccggtccttcgatctcgtatccctggttccgaatgatttccaaaggcagttggcgaatactttcttccaactgtttgatatctgcataaaaagtggtattactgatgcgatatgattccatgaaatgagcaagactcaacggctctgtcgtcagtaacaactcggctaaaatcgcgtgttgtcgtttagcagtggataagtcattacttttcccatctgtattttcttttaattgctctaatacttcttctgatgcctcaatgacaaatgagcctctagctgcttttttcaaagaagcatttaccgatttcaatgagacttcaagattatctaattcgcggtaaatagtccgtttactgaccttcaataaattcatcattttttggatagatacaggtgacgggctactgagaaattctgctaataattgtttttctctgggcgataaatacatcttatatttctcccttcacgagtttttcgtattcattcgtagctacccaatgttcaactagaactagccgagggatcttttcttctagctgttcagttacagctagttctctttgtgcgatataaatcgtttcttcttggattttgattttttctattgattcttttgagataacaaactgttttttcgctttttttgctaattgacttaaaatcgtcatgcccatagtttgtgagccgcgtctgttgtttttatacaaaaatacaatattagcaggcgacgttttttgttctgtgatatctgctatctcttttttttcttcccgctttggaaattggatcgcttcttttattcgtgacagcaagatatctgtttccaaaaagtgatccagtacatagatttgactttgaggtactttttctcttgcaagacccgctagttcatgttgcacgataaccagctgatttacttggttattcaattcatagatagagctgtatccgacagaaagatcgattttttctgctgctaatttctttttcagcagggcggctcccatagcacttgatcccatacctgagtcgcaagcaaaaatgacggaatgaatgatagatggttccaagatttctcccctttctttgaccgttttgttctctttttctttatttggtaatttcaatagtatcgctgcacaaatgaaggtcacaaatgtactgattgctatccctatacttaccccagctagttgtggataaggcgcattggcaaaaatcacgagtagtgacccaggcgatacaggtgcagctaatcccgtatctaaccattgaaatatcaacgtgccgcttgccccaccagccattacagctaaaaatagatacggtcgcagcaagacaaatggaaaatagatttcgtgaatcccgccaatcgcatggatcatcaatgctccactcgcatttactttttcctgtttttctgcaaaacaaaggatagaaagtaagatccctaaaccaggtccaggatttgcctccatcaaaaataaggaagagtacccgactgtttgtgagaattcgattcctaaaggtgtcaatacaccatgattgattgcattattgaaaaatagtacttttagaggttctaagatcagactgacaagtggtaacagattcattgtgactagccaagacacaacggaggcgagcaacaagtgaacactatttaaaactggttcaataaaaacgattccaattatacaaataacgctaccagtcagtcctactagtaggttgctgacaagcatttcatatccagccttgaatttcacatggaatctagaaacaaattgttcatatacgatgccggcaagcggcccgataatcatcgctcctacgatttgtggagcattggaacgagcgatcaaccctaaagaagcaattgcaccggcgactgcccctttttgtccccctaccgatttcccgcctgaataactgatcaagatgggtaaaagcagctggatcatccaatggcatacctcttctaatgtggtgtgcaaatcgccagacacaccttttgttgctaatgacaagattccccaagcgataaacagacttagatttggcatgatcatttcatttaagtgatgtccagcttttctcagttgtttcatagacacgcgactgctgttgtttgctttccatttgtattccatctttttcaccagacttctatttattgatggacggattttatgtagaaaaagcagcaaacgaaaaaccgtctgctgctttcagctatctgggaactatttgcctggttcagacgcaatgattgctagttcaccttggaccgcccactcagaaacgccatttggaataatacagcttgttcctttttctaatggatatgtttttccgtcaacgacaaggtctcctgctccttcgattaccgtcatcaatgtataaggggcttgttttttgaaagatgtgattcctttaatatcccactcatatacattgaaaaactcagtttctaaataagtgacgatcgatgaattcccttttcggacttctttgatttgtaattctggtgttttcgcagggacagttgttacatcgatcgattgttggatatgcagctctcttgtttgtccttgcgcatcttttctgtcgtagtcatacacgcggtaagtcgtgtcagaactttgctgtgtttctaaaatcatgattcctttaccaatagcatggatcgttccgcttggtacataaaagaaatcaccttttttaactggtactttcttcaaaaggtcatcccagcgcccatctttgatcatctcagctagttcttctcttgtctttgcatgatgaccatagatgatttctgcaccaggttcagcatcgatgatataccagcattcagtttttcctaattcaccttcatgtttcatcccataggcatcatctggatgtacttgtacagatagatcatcttctgcgtctaagatcttgatcaataatggaaacactggttctgaaggatggccaaacaattccttgtgttctgaccatagttcatctaatcttttccctttgaattcgccattttctactacactgacaccatgaggatgcgcactgatcgcccaatcttctccgattttatcgttagggatatcaaaaccaaagactgaacgtaaacgacttcctccccaaattttttcttgaaaaactggttttaaaaacataggttcctgcataattcaaactcctctcatttttcatagctattatagcattatttcggtaataccgctttctctttcaaaaagttttcaacaatttcatctcgacatatgagatactccgcacgatgatcgacaggatgtacgcgatttgacaaaaatatcaacgcttcttgtgtttttatatcaatcaagaaaaacgtacctgtataaccagtatgaaaaagaatcgcatgaccgtcttctacatccttttttaagtcccatcctaaagaacgatagccattttttttcggtgtttgatcttgcagtaaagaatcaatcgtctcttcttctaaaaaacgaccattacggatttttcccttgttcaaatacatttggacaaaagtaatgctgtctttcaaatcaataaagagacccgcgttacctgcatgttcagccaaaactcttgctttcggatcatgagtttgtccacgcaaaacctcacccgaaggcagttgttctgtgggaacgatttttttggaaggaaaaggaagaaataagctgttcatcattcctaatggttccaatacttgttcttgaaagatttccactgcagtttcttggtaaatttcctctagcatcaacccaagaagaatcgtaccggcatctgtatattttacttcttttcctagttgctcacctggttctagcttcaaataagcggcgatcaattcttcctgagatagcttatctctgtttggtatccatgttttgatatcagaagtatgtgtcagtaaatgacgcaaagtgattgtctgattttcaaattcaggaagatatttatgaagcggttgatcgagttctatctttccatcttctaatagacgtaaaactaatgaagtggttgcaacgactttcgtcagtgaggctgcatcaaacaacagatcttctgtcatcagctgcttttcaggaacgacttgggcaaagccggctgtaaatgtttctacttgattttcttttatgaaggcgactgctacacctggataaaatccttcttccatctttttcaaaataagctgtttcgtgtgtggatacatctttttctcctgcttttctatcagattcttacagtccaagcttaaagcttaatctatgaggaatcaaccttttttacacaaaaaaactgcgcgaaaaaccgcgcagtttcccccggtatactattttctctttctatctctagaataagcgatagtatgaccgttcataaaatgacgagacatgcgacaatcgttaagaaagaaaaagttaagcgtcgcatcgaatgtcagttttattcttttcttttggctcactgacgaaccaccattcgattcctatagcatcatagattgtgagtactgtgtgctttttgtctaagaagaaatcaactgatagttgctgcaagtgagcaatcagtccttccatgctttcagtatcgatcatgaatttcagaaaatcaagtccaatcacttcatctgtaggcaaatcaattgcgcctccgctagcttctgtcaaaccaacatggaaatctccttcattcaatacatggatgccctcttcttcattatgtaccttcaaaccaagtacatgattaagaaattggcgttcttttgttaagttagtaacatttaaatggattttttcaaaataagaacctgttgatagtttactgaatttttcttcagattttcttaataatgcttcttgatccattgtttctggaatttctctttggtcgttcttattctcttcatggtaaatttccaattcattctcttctgggtctacgagcaaaatccccatacgtccatgatcttctaaagcttctttgattggataattcattttacggatacgacaaaggatatctgccatttcttctgtgctagggataatcaatgaaaaacggttcagctttttgatcacccccatgtgatcattcgctctaggactttcttccagcagcaacatttcacttccagcttcttctgttcctaaaatggctaattcgttttcttctcttttcaaatcaaagccaacaacgttcttgtaaaaatcaatcattttatctcggtctttcacccgaatggctacactttttaaataggtggcagcccccaattgaaaatctttcatatttcttgctcccctctacgtcaagctttattttaacgatggattcttcttctttcaagcaataactttgattttgttaaaaaaaatgtgagaaaattcgcattttgcttgttttttgtaaattaatgagtaaaaactcttataaaaagaggttgtgaaaaagctgttctgcatcaagtaataagaacagccaaacaaaaatagctcctcctatttttcgtttggttgggcttattaccgcagatgcaagcttttgaacaccgtttaaggaagaggttgtgaaaaagtcgcttagtttcgagtagtaagaaaaattttgtgaaaatggctttctacatttttgcataaatttggcttaataccgagaaactggcttttgaacaccgtttaccaagaggttgtgagcctgccgtttaactccgagtcacaaggagcaatttcaaaaaacagcttctcaggtttgttgactattgtgacttgtgaccgaggagttggcaggagaacaccgtttaaggaagaggttgtaaaatcagcggtttgacctgagtattagagatacaaaacggaaaaatagcttctcatattttgccgttttttgagctaataccgaaggacagctgattgaacaccgtttattcggaaaaagggactgtgacacgacttttgtcacagcccctaaaaaaaataataaatttgtactattctatgaagcttcttcttcagaaaactgactgttataaagatctgcatagaatccgtctttttccatcaatgtatcgtggtttcctgtttctacgatcgaaccatgattcatcacaataatgttgtctgcatcgcgtattgtagacaagcggtgagcaacaacgaaacttgtccggttttccaataggcggttcatcgctttttgaatcagtatttctgttcgtgtatctacactagatgttgcttcatcaaggatcaggacatctggatttgctaagaatgcccgcgcaattgtgattagctgacgctgcccttgcgaaatattgcttgcatcctcgtttaatacagtgttatatccttctggcaatttacgaacaaaatcgtctacgtgagcagctttagcagcctcaatgatttgttcgtctgttgcatcgtcgttcccatatttgatattgtcatagatacttcctgtaaacagccaagtatcttgcagtaccattgaaaactgtgcgcgcaattcatcacgtgaaagatcacgggtatctacaccatcgtaacgaatactacctccagaaacatcgtagaaccgttcaagaaggttgatcagtgtcgtcttccctgcaccagtcggacctacaatagcgaccatctcaccaggtttgacatccaagttaaaatcagtcattagcaagttatctggtgtgtagccgaattgaacattttcaaaacgaactttgtatggtgtatctttttcttctggaaggccagatttttcattggacatctcttcttcatccaacacttcaaatacccgttcggctgaagcaactgttgattggatagtgttcatcaaacttgcaagttgagtgattggttgagagaactgtgttgtatattgcaagaacgcttgaacatcccctaatgtcatgttcccatttgcaacttttactccgcctagtacagcgacgaacacatagcctagatttttaacgaaattcatcaacggcatgatgattgccgaaataaattgagctttccaaccagcggcatacagattctgattttctttttcaaatacttcctggtctttttcagtatgattgaatgttttaacaatggtatgaccaccatatgtttcttctacttggttattcaataaacctaaacttttttgctgatctgcgaaaaacacttgtgatttcggcgctacgatcatcacgatgatcaagcttaaagggatcatcaataacgcgactaacgtcaattgccagctgattgaaagcatcatcacgatgaccccaatcaatgtgactgcactagttacaaattgagtcaaattttgctgcagcgtgcttgcgatgttatccatatcattgattgctcgagacatgatatccccatttgtatgtgtatcataataggaaatcggtacacgattcattttggcttccaaatcatgacgtaattcataaactgttcgttgggaaacacgtgtcataataaattgctgtaaaaagttgaatacagcagaaatcaaatacatcacgattactgtcgcaatgatctgcgcgattttatcaaagtctatcggaaattttgttacttgttggccttgttgcatctgttgagcgccagccattacacctttgaatatttctgtggttgctttccccaagacctttggtgtttggatttggaagatcacggctgctattgctagtacaaatacagcgatgatcgcaaccatacgtttagacatatagccaaacaatcggcgtaccgttccccagaaatttttaggcttttcaccttttacaccgagatttctgccaggtccaccatgtcctggaccgcctgctggtccatgagagggacgtgtgtttgttttactcatgctaagtcctcctctcttagttgtgaatgaacgatttcttgataagtttcgtttgttgctaatagttcttcatgtgttcctttgccaaccagttttccttcatctagcacaaggatcatatctgcatccattactgtacttactcgttgagcaactaaaacggtgatactttctttcatattcgttttcaatgcttggcgaagattggcatccgttttgaaatccaacgctgagaaggaatcatcaaacacatagatatctgctgttttgactaatgcccgtgcaattgccagacgctgtctttgtccaccagagaagtttcctcctccttgttccacatggctatctaagccatcttccatctctgaaacaaaatctttagcttgtgcgatttctaatgctttccaaatcatttcatctgttgcatccggcttaccatactgcatattgtctcggatcgttccagagaacagaactgctttttgaggaacaaagcccattaattctcgcaaattatattgagtcatgtcactaatgtccgttccatttatttggatcgaaccagattcgatgtcatataatcgagggatcaaattgactaaggtcgttttacctgaaccagtcccccctatgattgcgacgatctcgcccgacttggcttggaaatcaatatcttccaatgcaagtttttctgctccatgatatcgataattgacatgattgaaggccaatgttgcgttttttccagcaaaagaaactgttttaggattttcagggtcatggataccgattttttcatccaacacttcattaatacggtcagctgaagcttgtgcacgaggcaccatgataaaaatagcggaaagcatcataaagctgatcaagatctgcatcgcataagtcataaatgcaatcagattaccgacttccaaagtcatatctgctatgtagtgtccaccaaaccaagtgattgctacgtttgtaccgctcatgatcaatgtcatcattggcatcatcaatgcgacgatcgtattaactttgattgccgtatttgtataatctttattcgctaaatcaaaacgattttcttcaaagcgtgtcttatcgaatgctcgaatcactctgacccctgtcaatccttctcgaaataccaggtttaaacggtcagttttcttttgcatacttttgaataatggaacagcaaagtacatgattccgccgatcaaaataatcattactgggatgacaactaagaagatttttgtcaactgatgatctttttgataagcaagtatgctcgcgccaatcaacgtgattggtgcattgatcatcatacgtaaaaacatttgtgtaaccatttggatttgagtcacatcattggtcgttcttgtgatcaaagaggccgttccatatttatcaaacgcatcttttgtcagactctctgattttttatagacatccgtacgcaattgcttacccagtttctgtgattcacgagtagcaaaaaatgtatttgcgatagcagctaagatactgatcaaagaaaagccgatcatcacaaaacctgtatgccaaatataatcgacatctccttgcgctacccctttatcaataatattggaggtaagtgtcggcaaatataaatctgccagtacttggatcaccatgaaaactgcagctgcaattgctgaagtcaaggagatccgttttacgatttttagcatctagttcccttctttctatttatatactccgtttttcagccaagaaagtttcaaattgaattcactgattgcttgctctactgagtaatcttcagatgttgaaaataagcgatacgaatgcgcaattgttgtaaatacagtattcatcactaattggatcagtaattccaattcatgatcattttttactttcagcttcgtccgatcgatcaattcaagcaactcttttgcatcttgtttgtgttctttatgtggatcgtgaggcgttttttggcgactcgtatgaggagcgacttttcttgaggcacggtaatccatgttcataaacaagttacgataaaaagaagcattctcgccttccaaaatctcataaatcattttagaaaaataggattcgaatcctttgaatagatcaccatcggattctttcattagttgtaacatatctttagagctgtcacgtctcattgtctcaaagtaataaaaataaagatcctctttatcttcaaaatactgatagaaactgcctctagggatatccgctaatttgacgatattagcaatcgaagcttcttttaagggtactctagaaaactcgattctcgcagcctcgattagtcttttttgtttttctttaggcaaatggaaaaatgtctgtgtcggcatatggattctcctttctttcaagatgacacattgtcatatgacgctatgtcattataacacctcctacctgttttgcaagacatttgcatagtttttttcattatcatccgatacattaaaaaagtgataagaggaatccttccatttgaattaatgagagttgcccattaaaatagccacatactaaacaaaggatgagataaatggcccaatcaattagtgtccaagacttcaataaattgcctctcgatgctgacagcatcgttttagatacaagaaataccttagattacacaaaaaaccacttaagccactcgctttctatccccgctgctatcttgccaagacaattaaaaaatctagatccaaagaaactttattatattctaagctatacaggcaggcgatcagaagcattagccgatcaacttactgctaatggttttcgtgctgtttatatcattggtgggatggaagctcttcagtcgagtgttgcttgaatattgcttgttagattcaaaagaggctgtgacaaaaaatcgtgtcacagcctcttttataccctgtctttttttagttatttattcttcaaccttatcaatatgacttgatagccttttctttttcgagtaaactgattttgttagtcatagttataacaatcatagcaataaaaggagaaggtaagcatatggcatctgttttagtagtcaaaggtcatcccctaactgcagaagaatcgcgcacagttaaggcattgacgtcttttttaacaagttataaagaaaatcatccagatgatgaagtgactgttttggaactttatcgcgatgatattccggaaatcgatgaagaattattatcaggttgggaagcattacgtgctggtgcagaattcacttccttatcagaaagtcaacaacaaaaaattgctcgtttcaatgaattgactgatcagttccttgctgctgataaaatcgttatcgcaaacgccttatggaatctaaatatcccaacaaaattaaaagcttggttcgataccgtcaatgtagctggaaaaacgttccgctatacagaaaacgggccagaaggattagtgacaggtaaaaaagcactgcacatccaatctaatggcggtgtatacaacggacaagactttgcctctcaatatgtaaaaggtattttaaactttgtaggcatcgatcaagtagatcagctattcatcgaaggaatcgattatgaccctgaccgtgcagatgagttgatgcaaaatgcattagataaagctgctgctttaggtaaatcattttaaaaattgagataaatgcatacaaaagagacagaggaaaaaatcttcaaagcagcatttgtgccttggatattttcccatctgtctctttttgttattctttctgctttttcaacggattttcttcataaagagaagagattgttgtgtaccattcaaaaacatgagtaatcactactttagctgctgcataaacaggaatccccaagatcacaccgatgattccgaacaatttcccagaagtcagcagaactaataaaatcgttactggatggattgctaactgattccctagtactaatggagagatcaagcgtccttctattgtctgctctactgcaaaaacgatcagtactttgatgatcatgaatggacctgctacaatggctaaaaagatagccggaatcatcgctaaaaatgatcctaagtaagggatcaggtttaaaaaacccgcaataatccccaacgtgacagcatactctaaaccaatgaccgcaaaaccaatcataaacatgattgccacagcaaaagccacagttagttgtcctcttatataagaagaaacttgactattcatttcactcagcacattcaacgtcggtttttgcatgcgtgtcggtaaaaatttgacaaaataaggtgctaattgtttaccgtctttcaatagataaaataagataaacggcatcgtcagcagagccactaaaatagtcgctaccgcgccgacaaaacttccaagactctgaactgtactcttagatatatcttggatcatatcgcctgccgaattcatgaacttatcacctgctgtttccaactgttcgcgaaattggttgaacagcgggtcccgcaaaatctcggttaatttattatcaatcgtatctacatattgagggaagttactgatgaagctcactgtttgttcctgaatcttagggatgatcactacgctcccccatgcgattagtgcaacaaccaaaacaaacagcccaatgatactgtaaagccttggtacttttcgcttttcaaagtaatcaactaccggattcatcaagtaatacaagattcctgctaaaatgataggcagacctacgattgctaaaaattgccagattggtgcaaacaaatatgaaacttttgtaaataaaaagacgatcagcaatattaacaatacaacaagtaaggctgtgactacttgattatttaaaaaccagcgccaaaaccacgataccggtctgttcttcttattttttccttccataattcctcctgttagttataaaaaatttggcttcccaaaccaatagcaggcagtctatgcggatgaagatagattccatttgcaatttgtccttcttctggacaagcatcaaaaatcaatgatacgtgagctactgtctttaaattcccattggccatcggaccgacataatcgatcgtatatacctgatcatcaaaagcaattgttccgcctgctttcaaagaaaaaggttcgtcttttgatacttcttgaatcaccgaatattttcgtaaggcagctgttgctgttttatcgaacaaaatcagcatgggttcttccttgtttattgcttctgtcccaatttctgtaatctttgcctgaatcattgcactctctcctttaattgctttcaaaaacagtataacacattctcattctttagccgtgtggaataattatgtgatagaataaaaacgaaaactatttcattacaattaggaggaatcagctcatatgatcgaaaagataattttaggaacctatacgcgtcgcgaaagtaaaggaatctatacgatcgaccttgatacagaaaaagaagaattagccaacctttcattagctgttgaagaaaatagccctacctatgtagcaaaaagtaaagctggcaatctttacacagttactagtgtggatggattaggtggtgccggtgcgtacgataaggattttcattttttgaatgcggtaacagagtctggcgctcctttgtgttatgtagcggttgatgaagcacgtcaattactatacggggcgaactatcataaaggtgaagtaaatgtctaccatatattaggagatggcgaactgaaagcagcagattcaatattccatcaagaagcgacaggtcctcataaaaaccaagatcatgcgcatgtccactatacggatctgactcctgaccaacgattagtcgtatgtgatcttggtacagatcgtgtgtatacttatgatgtgtccgaaaacggcaaattgaatcttgtaactaccttcactgcagagccaggaacaggccctcgccatcttgtctttcatccaaatggacaattcgcttatttatttggtgaattagacagcacagtccgcgtgctttcttataataaagaaacaggtgcttttgaagaattacagaaaatatcgaccttgccagaagaattcgacggtgaaaatggaggggcagctatccgcatttcaaatgatggcaagttcctttatgcttctaaccgaggacataactcgattgctgtattcgcagtttttgaagatggttcccacattcaaaacaagcaaatcatctcaacagaaggggattttccccgcgatttcgcactagatccaagcaataattttgtcgtgtgtgccaatcagaacaccgataatctgacattatatcgccgtcatcctgaaacaggattactggaattactgaaaaaagatgtctatgtaccagaatgtgtctgtgtttattttgatcgttagtaagaaaaggagaatgaaatgaatcagcaagacgtattagacagactacgggaagaactaaatattcctttctttgatgggaaaatcgaagataaagagtatagcgaagaggaatatcagaaactcaaagccgatttacagaactactttgaacaatatgtacagaatgtagaaaactaatcagctttccatactatctgaaaagaacatcaggacaagacttttccgtctatcctgatgttcttttctacaaataaaaaaccgccgagatggttagactcgacggaaaaggagtatttactcgattttgagtaagtacaaggttgttgttggttataggtatgtcattatcataaaggattttgatcactctatcataaaggtaatattacatttatattagataactctagtttttattgttatcaaagatttcttttattttttcaacaacaaattagtcattttttggatggcagctgtcaattggtctgtcgcttggtcttgttttgcttcagatgtattgaatagatcttcatctacccctgattcaagatcgatactttggatcatttcttcacagcctgctacatatgaaagataagctttttcaaaatttttatgaatgcccattgcttttgctggtggacgcaaagtactgactttcataagcattgcccgatatttttttgttccttcttcaaataacaggatgatctcttcaagagtcgatttgtccagttcacttgtttttccttcatcaattgcgtttctgatcacttcatatttcggatgcattccttctccgattgcttctgtttccttgacgatttgatcgatggactgcacataatagccaatattcggtaacatgttcgttttcctactttctccattgttgttattatttattctacttgtttttatcctcaaatgacaagtacttgaaaaaatttaatggtttctatacagctcgccattcttattcgtgctcaaagaaaccatctgctaaactatattgtttccctgcgacaatgtcatattggatcaattgatattcgtcgtaaatctcttgttgcgagcgattgaattgcgcttctttataccactgtccgttttgatagtacagttctcgttcaaacgccggaagttcctgttctaatgataaaagcagctgataaaagccatttgttgtctgattcgtctgttccattagattcgctgcaaaataaaacggactggtgattgcatcgtgagtcgtttgcttttctaattctcctttactgtcgaacataagaaattgtgtttcatgcaatgtttgtttgtcattttttgcttggatcgtatctgaatagatccctggaagatgatccccccaaaaaacaactaaagtccttctagaaagattcttcaattcttccgtgaactgcttcagtgccgtgctgctataggaaatatcttgcagataattctctaagtcaagtgtcccacttccatctgaagtttttgcaggatagtctagattatcatactttccatcgtagggcatatgtgtctgcatcgtgactaaatgaatgaactgaggtgttttttcttccttgagaagtgtcattacttctttgtaagctgactcatcagaaatatatggattattctctatcgtatccgtataggtcatcgtacgctcgctgatgaactggtcaaatcctaatgtctgataaacatcctctcttttatacatcgaagtattgtatggatggatcgctgtcgtctggtatgattgtgcgtttaacgctgaaacgatagaaggaagctgatccatttttggtacaagcatcgtgtaaggggtggtgagttgcgcattaaataacgccatagaaaaaccagtcaatgcttcaaattcgatatttgctgttccaccgccatagttttgagaaagcatattgccactatatgtttgatcagctacttcataataatctgccaatggctcaccagatacttctacgccgtttaatcgactaggatctgagaaactttcactcatcacgaacacgatgttcggcgactcttcctctacagttttatttttttcatcggctagcttctggtatttttcagtgatttctttgatcttttctttcgaatatccttcaggttcatccattggttctaccttcagattgtacaaaaacccaccgataaaaccagtgttatagtagttcattttctggctgtaaggtatccatagtgccgttttattatatgcttttcgcaacaaattatcgggattgttgaaattactgatataccctagcagtccaattgccacaagcagtgtcgttaatcggatcaattggaatcgccttccttttttcaggcttcgaaacatgtaccagcaaaacaatcctatcacggttcctgcggcagctaagatcactgtaaacagcatagtgccggtcatatctttcagcaatccgatttcagtgatcatcttcaaatcgtctggataaatcggttcttgccgataactcattttcatataatttgcaaaacctaatacaccgatggctacgacatacgtaagggaacctaaagggacagatcctgctagtgcaatcagaaaaataagaataatcagcaagacgagacaggctaagaagaatttttccgtatgccaagaaaaagcaaatttcaacgcaaggtctacggatagatcattttgacaccactgcaaaaataaattactaaaaacaacaagaaaaaagatactgatgattgctgctgttccttttaaaatctttttctgtttggtcgaaagtctgcttatatatcttttcaaatgcttgctccttcatttctatcaataaaagaatgttgcttctcttattttagttgtacgaaattcgaaagtaaagaacggaaagaagaattaatgaaatccaaatattctctttctttatggcctttctggtttctttaataagcggacctttcgtactccagaaattttttctagctgttgtttcacttgattgagctgttcaaaatcagtactgtctatgtcaatcaatatgtagacatgctcattcttatggttacgcgatatatctgcgatcgctagctcgttctcattcagcagagaaaatatctctgctaatatattggttttcttttgataaaatatagtgaatcgaaacggcgcttggaaaaacattcgtgcggatggataattgaccgcttctctaaccgtaccgaacaaaagataatcttttaaggcttcaactgccaaacgtccgctgtctgccaaagcttcctgagtcgatccccctagatgaggcaacataagtatacggtcattttctaagaactcttcttctggaaaatcagtcaagtatttagccagatgttgtttttccaatgcttgcataacagcatatttatcaacaatttcacttcttcctacattgataagtacagcatcttttttcattttttctatattcgcctgatcgatcaatccttttgtatcttctgtcaacggcagcatgactacgatgtaatccgaggtagaaagaactgtttctaaatctgcttgccgaacataatccaactgggcatcgcggatagaataacccaagacatccatccctaagctatagcaacttagcgctacttttgtgcctatcgctccaagaccaagaagaccgatggttttgccttgcaattctcgtcccacataagcacttcttttgttttctgcctgttctaaaatattaggacctgttagtgtttgtaccatacgacttgcttcgattatcggacgggaagataagagcaaacagcacaaaacaagctcttttactgcattagcatttacacctggtgtattcatgacgatcgtcccgttttcagaagctttttcaacgttgatcgtgttcaccccaacaccagctcttgaaattgctagcaaatctggtgtaagccattcatctttcactttcgtactacgaataactattccttcggctggcaaatcatctattattttgaaatattccccttgtaacttttctatctcttgttctggaatagcatcaatcaaatgaacgtgatacataaaaccccctccttactaacaagtatctcgaaatttctgcaattagacaactgtttaccatttgacttcctagaagcaaaaagagcagttagagcagagtaggctgagtgataaaaataaggctatgacaagttactgccataagccttattttcgagagcaaaatattgagggtgagatatcttgataaatggtgttccgttagctgacattgataataagactaaatttcaaaaaagttgaaaagcaaatttcgtcaatctcttcttatttcttaaaactaagtggctttttcacaacctctttttatctaataaccactgtttccaactcaactaattttgcccacgtttcaatttgatctgttgttagatttagcgagacaacggtatgatgaccgccacctgcctgaatccatgaatggacaccttcatggaaattcggtttagttttccataacacacgtgcaacaggtaaattaggtgcttcagtcgttggttcaaaggcttctacttcattgatcagcagtttataatgcgtaccgaaatctgccatcgatacgactaccccttctcctgctttcccatcaaatacaagacgcgccggatcttctctatctcccattgataaaggagaaacaacgattcttggtttcgtcgcagcaagcgtcggatctacttccatcatatgggattccaagattgcttcttggccactagctagctcgtaagtataatcttccatgaatcctgtatctttccctcgagccatgattttcagcaaccgatcaatcgctgcagttttccagtcgccttccccagcaaaaccgtatccttctgccatcaaacgttgtacagctagtccaggtagttgtttcattccatacaggtcttcaaaattagtcgtaaaagcgttatagcctccttcttctaagaaacggcgaataccgatttcctgctgagcttgtacttttacatgttcctcccatgtcttttcttcataatcaccatagtcgaaggtatacaattccttgtactcttcaaataattgatcgacttcttcgtctgatacgcgatcgattacttgtacaagatctccgataccaaaataatcaacagtccaaccaaattgaatctgtgcttccactttgtctccttctgtgacacccacgtttctcatgttgtcaccaaaacgagccacttttattccaaaactttcattataggctactgcaacatccatccaatcagcaatctctttttggatctcaggtcgtttccagtagccaacgacgattttattttgtttatttaatcgagcattgatgaacccatattcgcggtcaccatgagcggattgatttaaattcatgaaatccatatcgatcgttttccaaggaatgctttcgttatattgcgtagctaaatgaagcaatggtttttgtagaagctttgtcccgcggatccacatttttgctggtgagaaagtatgcatccaagtgatcacacctgctacttcttctcgataattgacctctttcatgatttttgtgatcgtatcagcagtaactgctaattcttgaaggcggattggataaggcaattggccattttcattcagttcatcgaccatttcttgtgcatgtttctttacttctcgcagtgcttcttccccatataaatgctgtgatcctacaacaaaccaaaattctttttctccaatattcaacataattagccactccttttatttgttttgtccgtaatacgcattttttccgtgttttcgtaaataatgtttatctaaaatccgttgaggcagctcttctgaaaatgaattgagctgtctggtaaataaattcatcttgcatacttcatctagtacgactgcgttcattaccgcactttgcgcatctttcccccaagtaaatggaccgtgtccgtgtaaaagtacccctggaattgctaagggatcaattttgcgttctttgaatgtttctatgataacttttcctgtttcatattcgtacccgctgtcgatttcctgttgtgtcaaaaatcgagcacaaggtaccgatccataaaaagtatctgcatgcgtcgtccccatcgcaggaacatccaatcctgcttgtgcccagatcgtcgcccatgtcgagtgagtatggacgattcctccgatttgaggaaatgaacgatataaaacagcatgagtaggcgtatccgaagagggattgagtttaccttcaatgatatgattgtccaagtccacaacgaccatgtcgtctgctgtcatctcttcataactgactccgctaggtttgataacgaaatatcgtgtttcaggatcaaaagcgctcacatttccccatgtatatttgacgagtccgtgtttaggcaagtcaagatttgcttggtatacttcttctttcagttgttccagcattttctatcactcctttttcttgcaattgatgaatcgctgttttttcaatgtcgatcccctcacggtaacgtctcataaatatctgatagcctgctatttcttctgctgaaggtgtgatggtgattccttggtcttgtccaaacacgtcttctgccaagaagttttctaaagacttcccatgtcgatccatcatataggctgctaataacgcgattccccacgctccaccttctccggctgtgtccatcactgtaactggtgcctccatagcagatgctagaatccgctgtccaacttctggtgttttaaaaatccccccatgccccactaaacgatcaatttggacattctcagatttcaatatatccattccgattctcattgcaccaaaagcactggctaaatggatccgcatgaaattcgctaaatcaaaacggctacctggtgtacgtacaaataatggccttccttcatttactcctgtaatgttttcaccggaaaaataaccataagaaagtaatcccccgcaatccgtatcgccttctagcgctttgttgaataataccgtgaataatttatctctgcttatctccatacccaaagaattggtaaattcttcaaaaatactgacccaagcattgatatccgaagagcagttattcgtatgaaccatgcctactagttctcctgaaggtgtagtgaccatgtcgatttccggatggacattttctagttctttttctaatacgatcatagcgaaggcggaagtaccagccgaaatgttccctgtccctttggctacactgttcgtagcgaccataccggttcctgcatccccttctggcggacaaaccgggattcctggtctcaaatttcccgtagggtcgatcagataagcccctgattcgcttaacttgccagcttcttctcctgctactagaactttaggcaaaatgtgatccaagtcaatcgctacgtgcgctttttcgattaactgaccaaaaatatttttcatttcttgatggtaggttttcgttgaaggatcaataggaaacatgcctgatgcatctcctacgcctagtactttctcaccagtaagctgccaatggacataacctgcaagcgttgtcaaaaaattaatttctttcacatgttcttctttattcaaaatagattgatacaaatgagcgatactccatctctgcggaatattgtattgaaatttttccgttaatattcgttctgcttcttcagtgattgtatttcgccaagtacgaaatggtactagtaactgttccttgctatcaaatgctagataaccgtgcatcattgcactgaacccaatcgacccgattgtcgtaagattctcgccatagatttcgaatacttctgctgccatttttcggtaactgacgcgcagtcctttccaaatatcttctaatgaataggtccagataccattttctagtttgttttcccactcataactaccagcggcaataggagtaaaagatgaatcaatcaatacagctttgatcctagttgatccaaactcaatccctaaagatgtacgaccatctatgacatctaacatactttgcgcatttacttccttcataatgatttaactccctccttctcgtcaaacctgatcaaaccgtctttttagtagcgcttacaatgattattgtatacttttgtacgtacatgtcaagcagttatttacaagaatacaataaaaaacacttgttttgtacgtacataagttataaaatgaaattgcttacaaaatctgatcaaccgccttctcgaaattctagaaggagagaatacttatgaaaaaagaaaaaaaagtttcctcatcgtttatttatttttttggcgcatttggcggcattctatttggatatgatattggtgttatgaccggcgccttaccttttttacagcatgattggggtttggcaggtaaagcttctttgataggatggatcacgtcttcggtcatgttaggtgcgatccttggcggctctttatctggtcttctttctgataagcttggacgacgaaaaatgattcttctttctgcacttatttttatggctggttctgtcctttctgcatctgcccctcacaatggttcttattttctgattgcagcaaggattcttctaggtttagctgttggcgctgcatctgccctagttcctgcttatatgtctgaaatggctcctgctagactaaggggaagattgtcagggatcaatcaagtgatgattgcttctggcatgctcctttcctatgttgcagattatttgctaaaagggttgcctgaaacgatggcttggcgcgtgatgttagggctcgctgctgtccccgcgctgattttatttttcggtgttttagctctaccagagtcaccgcgttttcttatgcaatctggccgcttggaagaggcaaaaagagtattgaactatattcggacaccaaaagaagctgaacaggaattcgaacaaatccagctgaatgtcaaacaagaaaagacaaccggaacttcttggcatactttgtttttagaaaaatatcgttccttagtcattgccggtattggtgtagcagtattccagcaatttcaaggagctaatgctattttttactatattccgctgatcgtagaaaaagcgactgggcatgcagcgagcgatgcattgatgtggccgatcatccaaggaatcattttagttgctggttctttgctctttttggttattgcagacaagttcaatcggcgaactttattgaaaataggcggtagcgtgatgggactttctttcatcctaccagctgttttaggaactgtactggatgctcatacaaattctttgttgattctcttgtttttatgtatttatgtcgcattttattcttgcacatgggctccactgacatgggtaatcgtaggcgaaatattcccactagctgtccgcgggcgagcatctggcctagcctcttcttttaattggattggttctttcctagttggcttgctttttcctgtgatgactgcttctatgtctcaagaaatcgttttcggcatttttgggatcatctgctttttaggggttttatttattcaagagatcgtaccagaaactcgtgggaaatctttagaggaaatcgaacaaagtgcatctaaaaaaacttatcctaaacgtatttctatccatcattcttaaagaggttgtgacagaagtggtcagcttcaagaaataagaaggaaccgcttagtttccagtcacaaggaacaatttcaaaaaacagcttctcatgtttgatgaatattgtgacttgtgaccagttggtaggagaacaccgtttagtggagaggtggtgaaagaaacgttcagccttgagcgatgacaaaagctctcacaaacattgcgacgagtaaccgtaggagcaataagaggcggtaaaaacccgtctcttatttttcgttttctttcactgtttcccgttcaactagtacaggttcatagagaatatttggctgtgcctgtcctttttcaatcgttgtgacgatccaccgtgcggcatcttgtcccaacttttcttttggatgcgtcaatgttgtcaattttttattccctaaatggcttaaagaagaatcgtctgttcctacgatcgataggtcatctggaatatgatagccattttctgtcaacttatctagcattaaactagctatttgatcgttatagcaaatgatgccatctaaagcttgttcttctttcaaccgttgtactgttttttcagcgattgtttctcgtgtttccgtggtgaaagtaatgatatcttccgtcaaaaaacgcacattatactgttcacacgcgctgataaaacctttcatcctgtattttccttgaagatcgtcgatttttgtgatgaacaacagacgctgatgtcctttttttatcaaatattctgctgccataaaaccgactttcacatcatctaaacaaatataagaggcatttaactcttcataagcagcattgatcatcaccatcggaatgccttgttctctcaaagcaacataaagtgctaagtttgggttatactgattacttttcgtaggctcaacgatcaaaccatctaccccataagcaatcattttcttcaaacactctttctccaattcgtgatcgttattcgtactggctaaaagcaatgaatacccagattctcgtaattcattttcgattcctcggataatcgacggaaaaatataatcagagagatatgtggtgatgacaccgatcgtttttgttctgttcaatggtgttttttctttcttatagctgtcatctacatatgtgcccgaccctttttctttacgcagatagccctcatttaccaacacagcgattgcttgccgaatcgtatgtctgctgacgtcatatatttcttgcagcttgaattctgagggaatggttgtatttacttcgtattcctcacgaaggatcttttgttttatctcttctgcaatatcttgatattttgccatttgccttgcccctttttatttgtacgtacatatatcataacgagtctgcaaggtttattcaagcaaaaatcaaggtttcttgtgctcataaggcatacggaacaggttcaccaaattctggaaatccttgctcattccacgtaaagcattgcgcgttcgcgtgccgattaggattgtctaacggatcccctttttggttcttctctggtcgagcatgatagatcaaaatatcaaagcacccgtcttctgaaaccgtaaacgagttgtgaccaggaccaaattgcttatttttttcagaagaaacgaatactggctccgataatttatgccatgattcttttaataaaagattcttgtgctcatcagcccacagcaggcccatggcatagttttcatctgttgcactaccagaatacgtaatgaatattttcccattgcgagtaaggactgctggaccttcatttactgaaaaaccccgtttttcccattcatactcaggtatagaaaggaggatctgcttcccctttaacgtccaaggattatccatttcggatagataaagattagaattcccagtaatttcaggatcttgttgggcccacacataatatagctttccttgagaagagaaagttgttccgtctaaactgaaagtttcccttttcgtttttatttgtcccttttctatccaatctgtattcattggatctatatgctgattttcaagtacgaacatgcggtgatgatgagattcatcacgtatagttttatgattgcttgcagcaaagtaaatataccattttccattgatataatggacttcaggtgcccagatcaattcactcatcggtccttcttcatgagcctgccatacaatcaggcttgcagcatgttctaattcattcagtgactttgcccttcttaattcaatcacttggtagcctggaaccgatcctgtaaaataataataaccatctgtatgtttatatacccaaggatctgcccgttgccgaacgataggattattataaagtgtcttcatcataacaaatttcctcacattttctttattctaattacattccaagagtatttttctatccctacatttaattcgtcatgtttttctattgaaaaatagtttatttcaggttttattttttctggttcttcacgtgtatttttgtccaacagatcgctactggttaatgtgtagtgctctccttgatctagcaaattgaaatcatgttcaatcgttatcttttgttgttcatttgtgcgattgatcaagaaaatagtcagctgattgccgttatctacgatcacactgtccacataaggaacattttttatcttttcacaatcataaacagggcaaatgatttgttgtttcaatacttgacctttagcatatttcgataagtgttgcatcacataataagttggattcctccatgcttgtcctttagcatctgtcagtattaaaggtattgtgtttactaacaatgattgacaactaatctttacgcgatctgcgtgtcgtaaaatagccagccctaatgaaccaaataataatgtatcttccatagtaaagtaacaccaatcgatgggactaccgacttcaaaatccctatgtcttttttccggttgggcatgtacattccattcatcaaacgctagatacattgttttctcacttctcaaatatccttttacataatcacaagtagcaacgatttcttcaatttgacgatcgaatcgataagcttttgcaaggtatgtcgctgtatcatcacgctcatttttaggaggtttagtcaagtcttcttcatcatacttatcaatatagttatgcaaagctaaataatctacattctcataagcttcttctaatgcgatacgatcccattcagggtacgatggtaaacgtggcgtagagcttccaactaagattgtttcaattgaatcatccactaacttcatgacttttgaggcttcatttgctaacctaccatattcataagcactcttagcccccacttgccatggaccgtctagctcattccctaaacaccataatttaacgccaaaaggctttttttgcccattttttattcttaaatcactccagaaggttccttttggaaaattacaatattctactaaattttttgcttcatcaattccttttgttcctaaattcaccgtgaatatcggtttcgcttgtacatgactgatccatttaaaaaattcgtggagtccaaaagaatttggttctatacctcgccatgctaaatcaattttttttggtcgttgttctttcctacctacagtatccacccaatcataaccagatgtaaagtttcctccaggatagcgaatgacacctaattctaattcctttacataagagaggacatcttgtctaaacccgtcaccatcagctgtttcatggcccggttcataaatccctgtatagacgacacttcccatatgctcaacaaatgagccaaacagccgagaactgatctctcctaccgtaaaatcctctctgatttttactttcacttcttcgtccaacagctttccctacctttcatttcctatagtcaagataatagatacaagtttccatacgccaccagcaaagataaaaataaaaggagggaaaagaaatatgagcagtacaaatcctaataacaatacgcaacaaagaatatttctcaaaaaatcaaaaaatactttccatgcactttgttcaaaaatttgtaaaaatgtgatatctttgttttcagaaatcacatatatccaggataaaagaaacatggaataaataagtaaaactacatatccactaattgaaagtacgattgtctgttcttctaataattgattaacaagaaaataaataatgatcgttaacagactaaggaacaagttcttaccaaaatgttgctttattccttgaaagaaaaaataaatgatatttcctgatccctcacctttccattgcgccattacataaaaaacagcacatgtagcaggcacgatagtaataacaggcaaacacacgattacccagagaatacctaataagatgtaatcagaaaccacaatcaactgtccataaagtttagtctcaactattttcatcttcctcactctttcattccagacatagctgttccttgaacaaaatatttctgtgcaaaaatataaaccactagtaatggcagcattgaaataaccgttccagccattacaggtccataaaaagaaatgttctgccctgtaaataaagctaaccctgctggtaaagttctcatttttgaactacttgtcaatatcaatggataaagcaagtcattccaactattcatcagcgtgaaaatccctaatgataaaagagtaggtttgctcaatggcaacatgattttcaaaaaaatattaaactcacttaatccatcaatgcgtgctgcctcttccaaagaatctggtaaagtaataaaaaaggaacgcatcatgaagataccaaatgcagttgtcatacgaggaatgatcaaacctgcataagtatcaagcatgccaagcaaattgacttcaataaatagaggaatcatgaagacttggaatgggatcatcattgtcagcaaaacgaaatagaacaaaactgattttcctttgaaacgcatacgagcaaatgcataccccgcaagagaatcaaagaatacagaagtgatcactgtccctccagcaaaaatcactgtatttttgatgtaatctaataaagggatcgttgtccaaaccttaatatagttatctagggtatagctatctgcaaatattctaggcggaaatgagataatgtctttttcgtgtttaaaagaagaaataatcagccacaaaaaaggaaacgcaataaccaacaatataactagcatactaatcgttcgaatgatttttttaccactaactgcttttcgactattcacagtaactgtaatcgagctttctggtgccatacaggtttccctcctatttcatttgtttttctttccgtgacatgtacacattagtggagatagctatagttgcaacaatgataaacaaaaccgaagacagtgctgatgcatagcccaattcataaggtgctgtaaatcctcgactgtaaatatattgaacagctgtttctgtcttaaattgtgggccaccagcggttgcaacatatacttggtcaaacacttgcatcgaaccaatcagattcgttaaaatacaaaaacctaaggagggaacgatctgaggtagcgtaatgttaaaaaactgctgtcgatttgttgcaccatccatttgagcagattcatacaaagagggagagattccctgaatagcagtcaagagaatcgtcatagtaacaccaaaattcttccaaacagtcatgatggctaccgtcggcatagcaagggttggatcgcgaaaaaattgagggatcggcaagccgacttgtgaaaacaagtaaggaatcgcccctacattcggatcaagcaacatagaaaaaataatcgcaattgacgtcaatgaacaaataactggaatgtaaaatgtcgaacgacaaaaacgattgaatctggtatttttagataatgctactgctgctaataaaccaacgataatttgtgttggcgtttcgagtacggtgaaatataaagaatgaatcaacgaattaactgctcgttcatcactaaatatacgtgtgaaattttcaaaacttacaaaatttcttgatgtaaagaaaatattcaaatctgtaaaactaatagcaaatgttcctaaaagcggtatgacagtaaataataataaaactaaaaaagatggagttaaaaacaaatacgcagcacgatcaggacgattccaatatttggtgaatccgttcatatagtccacctcatctttcattttgataaaatatacaatcttggtttaaacgaatctgaataagatatccgaacaatcgctgtgatttttgcaataacacctatctgcaaatactaggtcgatcattcagatatctgtatcttgccaacagtctatcctgtataaagttctgtactatttttgcagtaattgattgatggcatcatctgcatcgttcatgagtgtctcaggatcttctcctgctaataatttttcaatcagtggattgatgatatcgttattgatcgcagagatttgggtaaaacctggtaaatatggctctgcatagtccatttgtttcgataattcagatacaataggatcattttttacttcttcatcttttgctactgaatccaagtaggcaggaaaaccattttcgatactccattttttaccaatttcagttgtattccaatatttcaaaaactcatagacagcttcttttttattattatctgtacttgccggaatggcatatcctacgccatctaaaatagctgtttttttgtctgaatcactcccttgtggtaaggtagtcacattataatcaatctcgtttgctttcaatccgttatttaaccatggcccattgatttcaatggctagttgaccagcattcattaaattgtccatttcggcgccagaaatcgattctggaccagtcttgtctacatggatcattttttggatcgcttttaacgttttaaggttctcaggagacgcaaattcagacttagtataatcatcgttcactaatttaccgccatttgctaacatccagttatataacggtgcagttccatccttattgaagacaaaacctgatacatttttactactatcagttaattttggtgccatttctgtcaattcttcccaagtagtaggtggttgttcagtatctaatccagcttgtttaaacaaatcattattccaatacatatacatgccttgtacctgcatggggacaaaatactgtttaccttctacttcacctaattcaatagccgtttctttaaaatcagatttatctactccatcatattcccagaaatcgtctaatggttgtaccgctccgttttctacatactgtgcaaaatctggataatttaatgcaataaagtcaggtgcttttttagaagaaatcgctgtaggaagtttttcattcaaattggcccaagtcatgatatccatttcaattttgatgtttttatcatttgttttattaaattcattaacgatttcttgcaatatttcaccatcagatgcagtaaacccattccaaaaagtcaaagtcacttctttatcagaatcagattctgctgaacttccgccaccgcaagctcctaaaatacctgttgcagctaccaacaaagagccaattaaccattttttacctttcattttttgttcctccttcatctgataaacgacatctgaccacattccaagatagcggtttcaataaacaattgattttcccatcttcagcttttacatttgttgaatgacttggttttacttgttcacttttaggaagattagttgcttttgtatcaaatccactcatttcagaaaaatcaatcactccctctaatgataattcagacaagtgaacagttagattcatttcttcttctccacggttaactgcaaatatgacaagttctttgtcatttattacggctatactttctaaatacggcacttcttcaaaatcttccgtcgcatagtttgctgaacgaatttgtgggcttaacacctctccttgtccatacacagcagcttgcataaatggataatagatcgtctgtctccaagcttctccgtttgtttctgtcctgattggtgcaataacatttaccaattgagcaagacaagcaatctttactctatctgcatgtttcaataaagtgattaatagacagcctaatagtaatgcatcttcaaaattatagttatcttctagtaaaggaggagcaatctgccaaggcgctgcttgctcatcttgttccgctgaatgataccaaatattccattcatcaaaggacaggttgatctgcttcttactatgtttcttcgccttgactgtatcgcacatcgctgtcacttcagaaatgaaccgatccatgtctaaggaacgtgcaagataatgagaaagatcatttttttggttgccataatattgatgcagagacaaataatctatttgatcgtacgcttgatcaagaactgttaactcccaatcaccaaatgtaggcatttgccgattcgaacttccgcataaaaccacctcaattgaatcatctacgagtttcatcgccttagccgtttcctctgctaaccgtccatattcttccgctgttttatgtccaatctgccaaggaccgtccatttcattccctaaacaccatgtcttaattccaaaagggctctcttgaccattcgaacgccttaaatcactccaataagttcctttaggaaaattacaatattcgactaaattacgagctgcatctactccacgagtacccagattgacagccatattgatttcggcccccacatgctgacaccagttataaaattcatgaatcccaacttcattcgtttcaattgtccgccaagctaaatccaaccttctaggtctatttgctatgggcccaatactgtcttcccaacgaaatcctgacacaaaatttccaccaggatatctaatcatgggaatgttcaattcttttaccaagtgaatgacgtcttggcgaaatccacttttattagctgatggatgatctggctgataaatcccttcatatactgctcgtcccatatgttcaataaatgaactgtacaaccgcggatcaactttgcctacacgcttgacactactaatcaacattgtggcttccataactgacctcctttaatttatacatgaataatacacctcgttgaaagcgttgtcaataatataaatgttaaacttacttattttttatcgattttaattaaccaaaatattaataatgattaaaacaaataatttaatataacttttattaacaaatatgttaatatataagaaaaaccttttaagaggtgatatatatgcaactacaaataaacgaagaatccttaccggtatatgaagcattagctagtaaaacaaggatcaagatcatccagctactttccaaaaaaaagatgaatgtcaaagatttggcaaaagaacttggagtgagcagtgctatcacgacgatgcacgtgaaaaagctagaggaagcaaacatcatcaaaacagaaaaagtaggacaacaaaaaatttcgagccttcgtgtcgataaaatcgatatcagttttccagaaaaaatattcaatgcttttgatacgaaagaaacatcgatacctattggtcactatacaaattatgcaattgaaccaacatgcggtttagctacgatccatgattttatcgggaaagtggatgaaccacgctattttatggatcctcgaaggatggatgcccgcattctctggtttaccagcggatttgtcgagtatcaggcacctaattttttaaatacagaggatacattggagatgttggaagtttctgtggaaatttcttctgaatttcctttttcaaatgacaattggccttcagatatcactttcagcctaaatggtgtggagctaggaacatggacgagccctggagattttgctgatatccgcggtaaatatacgcctgattggtatccagataatcttaatcaatacggcttgctgaagacgatccgaattaccaaacacttgacgaatatgaatggagaacccttgtcaaacatcacgatcaacgacatccctaaagagcaagacacttggcatttgcgaatcgaagtgaaagacgatgccaaacatgtggggggctgtactttatttggtaaaggattcggtaattacgatcaggatatcaaattaaaagtttactacagctgatatttttcttttctattttataaaacaaaaacagccaatccctatgaagggacggctgtttttgctttattgttatttccagaaatcatccaaaacggaaattggcaaatgtcgtttatgttgtgtcttgttccaccatgcttcgattttttcttgtgcttgagcgggaacttcttttccttctagataatcatcaatttcattatatgtgacacctagtgcgacttcatctgcaatcattggtttcccatcttcaagatctgcagtcggaatttttgtgtataatttttccggtgcattcaatgcttgaagcaattgtttcccttgtcgtttgtccaaacggaataatggcaaaatgtcggctccaccatcaccaaatttcgtgaagaatccagtaatgttttctgcagcatgatctgtccctaatacggctcctgctctttctccagctacggcatattgcgtaatcatacgttgacgtgctttgatatttcctttgttaaaatcgctgattcccacacctgcttcgcttaatacttgtacttgtgcatcaacagctggtttgatatttactcgcagactaacatcgggctggataaagtcaagagcagcttttgcatcttcttcatctgcttgttcaccataaggaagacgaacagcgataaattgatagttttcatcttttgtttcttcacgcatttcttccatcgttagttgcgccaaacggcctgctaaagtagaatcttggccgccgctgatacctagtacaaaagttttaagaaacggatattttttcaaatatgctttcataaagtcaatacttttacgtatttcttcttttggatcaattgttggtttgacacctaattcattgataatttctgtctgcaggctcatttattctcctcctatgcttctgtatgaagttctgctacgctttttttcattcgttccatgatagccattttatggttccagcattcagtagacagatcgactgggtatttttgcggattcaagtctcgtttatactcttcccatagtgaatctagattttcttttgtatattctttgatttcgtttagtgcaggtaattcgtaaactctttttccttcgataaagatatcttgtaaaactgggcgagctgtaaagtctcgaacagttttattgataaacgtatgcactggatggaacatgaagatagcttcttcttctcgagggtcttcatcccataatgtcacgtagtctccttcagatttcccatcaaaatttcgagtgatgcgccacacttgttttttccctggagtagttactttttctgcattgcttgataacttgatcgtatccatcatttttccttcatcatcttcgatcgatactagcttgaatactgcaccaagggctggctgatcataggctgtgatcaattttgtcccaacaccccatacatcaattttagctttttgcatctttaaattcaaaatcgttgcttcatccaagtcattcgaagcatagatttttgcttccgtaaatccggctgcatctaattgttcccgaacacgcttagatatataggccatatctccactgtcgatgcgtacgccttggaagttgattttgtcacctaattctttcgccacgcgaatcgcacttggcacacctgatttcaacgtatcataagtgtcgactaagaacacgcagtctttatgggttttagcgtaggccataaatgcttcataatcatttccataagattggactaacgaatgagcatgggtcccgctagctggtatcccaaatatcttcccagcacgtacattgcttgttgcatctgctccgccgatatatgccgctctagttccccagactgctgcatccagttcttgtgcccgtctagttccaaattccaatagtggatcttctccgatgacagatttgatacgagctgcttttgtcgcgatcaacgtttggaaattgaccatattcaacagtgctgtttctactaattggcagtgcgctaaaggcccttccacttggattaatggttcatttgcaaaaactagttctccttcacgagcagaacgaactgttgctttaaattcaaaattttgtaaatactccaaaaaaccttcaggatagacttctaatccacgcaagtaagcaatatcggaatcattgaacgtcagattctctaaataattgactaaccgttccaatcctgcaaaaaccgcgtatccgtggttaaaaggcatttctcgaaagtaacattcaaaaacagcatgtaaatcagctcgacctaattcccagtatgtctgcatcatattgatttgatatagatccgtatgcagcgtcaaactgtcgtctgggtaagtattattcatcttgtattactcctcttggcaagttttcatttcctacccattataacaaaaaaaattaataggaaaagaaatcttccattttttctgaaaaagcacatgttttacggatatttcttgctaaaaatgaactccatctgctaaaactatcctttcttattggtatttaacctaaacgagaaagaatacttattttattcaatgtatccgagacacgaagaaattagcgttttctatttttcttacttgataaaataagtagattttcctactacaatcgtagccgttaagataccgatgattgaacaaatataaccaaatgtctctacaacataatcaatggcaaaagtttttgaagcaataatacgtctttccttttttgcttcttatccccaaagaaacggatataacttattatgtattgaatttttttggaaaggcgaattatgacaagatataccttgcgttgaaaaaactcgcggaaaaaatatcacacgtttttaaaaagatacaaagtaagaaagcagctgtcaatagaatggaaacaaaaatggcgagacatcaatcagtctcgccttgttttttattgtatacattagatatggagcaggttaccataaagatgattattagtcgttattaaatagaatccttcgtatttttttgttctatcactacaatatctttatttggacgtttgaattgtattccggcacgttctagctcctgtttcactcctacatggactttgacatcttctcgtgtcatttttaaaacgtgatgaatcgcatagtcgatttcttgccttgtgatttttttcttcgtattgatcatcacgacttgctttttatcatatgtgtctaccaatagcagttgtgttcgatctaacgaaaataatttgtaataattaatagccgtattcccaaaaaagaattccactactttaggataaaatgtcttaatatttaaattactattcacaggtgtttcgattagcttcatctcattcctcttttctatatagtcgatttagatccaatcttaagttatgttaccatctttcctagcattaaggaatcggttacaattgaacctttaaagacaaaaggatttaccttttatcacttaatagtataacataatttcgtgagaaaaaaatacaattttttcttgaccatctcgttacgtaaaggattatgcttacatttgtcaggaggaaaaataatggagtacacaataaagaaaatgtcagagatatcaggagtcagtccgagaaccttgcgcttttatgatgagattggactgctaaaaccagctaggatcaattcttcaggttatcggatttatggcaaaaaagaagtcgatcgtctgcaacacatcttattttatcgaacaatggcattcaagttggatgatatccaagaggtcttagacaatccatcttttgaccaccagaaagctttaatcaagcatcagcaaatgttgctggaaaaacgggcacaaatcgataccctcttgacaactgtccaacagacacttgatatgtacgaaggaggaagaaaaatgagtgacaaagaaaaatttgaagggtttaaacaacaaaagttgaaagaaaatgaagaatcctatggacaagagattcgacaaaaatacggaaaaaaaaaggttacagcatccaatgaaaaatggatgaatatggataaagaaacgtatgaagaaatgcaaactgttgaaaagcagatgttatttgatctcactctttacttaaaagaaccagaagatgaaagcttagcagaccgtatcttccaagctcataagaagtggttctcttacagctggcctgaatatcagccaaaagcgcataaaggactaggaatgatgtacgaagccgatgaacggttcactgcatattatgacgagcgaagtggtcatggtgcagcaaaagctttaaatgaaattatccaaaaaaaggcgtaatcttttacatgatccaacaaaaaagtacacgtaaaatgacctaataacaaaacagcagacacccaagttagatttttatgctaacttttggtgtctgctccattctttcacaagttttttcatcctactttaaatatattcatcgttgaataaacgtataaggtattttcactttatcctttttttctgtaagaaacaattgaaatgccatttctccgcaagcttccagatggtggtcgatggttgggaaaccaagaagctcgctgatcagcaaattatcgcgtccaatcaccactggtgtcttatcttgcagatagctttgcaagatgcctgctgcaaccatatccgaatttgtaaagacaccatcaactccaagctctttaaaaaagaagcctgcttgttttcctttctctgcatctatacaatcccaaaaaacaagtgattcatcaaaagatggaaaaagttgatgacatagctgcaaagtgatttttgagttataacttagcctgccacttcgccccaacgtgatgcccaattgctttataccttgctgcttcaaataagtaagaccttctgtaattgattgttctcgatcaataaagacacagcttgcctgttttcccttgatttcttcacaaaaaactagaggtccatatttttgatatgccaataaatcatctagtgtattggcacgagacgtaatgatcaatccatcgaaagctttagctgcaaattcttcaagataccttcgctctttttctttatgatagcccgtcggtaaaagtgtcactttgtaatcataatcaaacgctgcttcaatgatcccactgatcaactgatcaaaatacggatgattggtataaggcagaatcactccaatgcttttcgtttttccataacttaactgtctggcatttgcattagggatataatcgacttctttcatgaccgcaagtatttctttccttttttcctcatctacatatggatgtccattgattacacgtgaaatagtagaaactgaataacctgtgagctttgcgatatctcgaatgtttgccactgctgcttcgccacctatacaaaaagattttcttgtaaatagtctaccacagctggaccgcattcaaaaaactgatacatttttccttcatgcgaaaaactgatccgctgcccgccccaatatatatcttttgtcaaattttcgatttcattcattggtatttcttttactatattcctattcaacccttgaaaactgtacaacgttaatacggatcccttgaactcgacaaacgcataaaaataattgttcgttgtgccatctgttatctctacataagtattcattgcaagccctccttttgatactttgagtatagtgtatgaaacgcgtctcatagcaaggagtttgttttgccaaagaaaagttttattcctctttcattattaccaaagtctcttattttaaattgaatacattataatgatactgtaaatatatctttattattagtgaatggagtcaagtccacaatcttgtgtaaaagttcaacctcatcaaaagcacaatgttttgcgttgtgaacctaactgccatgcctttctttctgaggagagaggtcaggagcagtagcgcagcgactcttgatgtctctcctcagaaagaagagactcgcacaggttcatggtgctaaatgttattcgaattaaattctaaatattttcgtggagaagccagccactcagtgtctttttccatcaaaagtgttccaattatccgagtgatggaattgatatttggaaaaatccgaatcactcgttctctccggcgaatctcttcgttcaaccgttccaacacattggttgtacgaatccttcggcggatattttcaggaaaagacaaaatttgaatagcatcttcaaagccgttttctaaaatgtcgcaagcagcacttaattttgaatcacaaccatatttttccaagaagtgctcttttctttcacgtgtcaattcaagttcagaggctttaaagatactcttcaactcgtcttttacatcagaagaaactttctttggcagcttatcaaaaatatttctcaaaaagtgggcttggcatctttgccagctcgcacctaaaaagttcttgcgaacagccttaactaaccctttgtgtgcatcagaaatgaccagttttacaccgaacaaacctcgttgaacgaacgattgaaaaacggtatcccaattatcttccgattcgccgtcttgaacatcaaaaccaagaatcgtacgtcgtccatcagaatcaatgccgataccaatatatacaccttttgagacaatacgatgattttcccttactttcatatacagggcatcacacatgaaaaatggatattccgagccttctaggctccggtttctccactcaaaaacaaatggatccaactgtttcatcagatttgaaacgaatgatttagaaacagtcgcaccatccgttagcagttcaactgttttagttactttgcgagtggagacaccagaaatgaccatttcaatcatggcagcgatcaaagctttttcgcttcgctgatatctttcaaagatagtaggactaaacttaccgtctctggttcgtggaacatgaagttctaacgtaccaattcgagttgtaaacgaacgatcgtagtaaccatttctttgtgattgccgttcttctgaacgttcataggcatttgcctgaatatattgatttcgttgttcttccatcagctgattaaacatgatagtcataagtgtttttgcggtatcattcgcaccgctttcgtttataattgcttgaatttcttcgctttcaaaagtaaaatgtacttgagtcattgatatcagtcctattcgagtatgttttctgcaaaaaacattgtactcctaactgagatcaatggcttttttgatgcttcacttttacacaattatatggacgtaatcgtgaatggatatttacttttaatagataaaatattataactattaaaaataactattttcattataattacacacaaaaaagagcgtgggacaaaagtaaagaacacttttgtctcacgctctaaacacgtataaacagcggaagcagaagcaactccttcggaaataagctgaaattcacaaaaatttgaaaagcaatttccgtgaatttcttcttatttcttggagttaaacgcttctgttccagcctctttttatctgtctttcactaatgatcagttgtagataagcaagttgctttttcttacatcataccgcccatcattgatggatccattgcaggagctgctggcgctgctggttctggtttatctgcaacgactgcttctgtcgttaataacaaggcagaaacggaagcggcattttgcaaggcagaacgtgttactttagttgggtctacgatacctgcttcaaccatgtttacccattctccagtagcagcattgaaaccagtgcctagttccacgttcttcaatttatcaacaatcactgatccttcataaccagcgttttcagcgatttgacgaattggttcttctaaagcacgaacaacgatcttgatacctgttgccacgtctccttctgcttctacagcagaaactttgctgataacgttcactagagctgtaccaccacctgagaccattccttcttctactgcggcacgtgtagcattcaatgcatcttcaatgcgtaattttaattctttcaattctgtttcagtagctgcaccaactttaacaacagctacaccacctgctaatttagctaagcgttcttgtaatttttcgcggtcaaaatcagaagttgtttcagcaatttggtttttgatcaattgcacacgagcttcgattgcttctttttctccagaaccttctacgatcgttgtattgtctttatctacaacaactttagaagcatttcctaagttttcgattgttacatctttcaattctaaacctagatcgtcagtaattactgtaccacctgtcaaaatagcgatatcttcaagcattgctttacgacgatcgccgaaaccaggagcttttacagctactacgttgaatgttccacggattttgttcaatacaagagttggcaatgcttcaccatctacatcgtcagcaataatcaacaatggacgtgattgttgcaagatttgttctaacaatggcagaatatcttggatgttagagatttttttgtctgtgatcaagatatatgggttttctagaacagcttccattttgtcgttatctgttaccatatattgtgataagtaaccacgatcaaactgcataccttctacaacatctagttctgtttcgatcccttttgattcttcgattgtgatgacaccgtcgtttccaactttttccattgcatcagcaatcaaatgtccaactttatcagaacccgaagaaacagctgctacttgtgcaatggcttcttttgaatcaacaacagttgagatattatgcaattcttcgactgctgcttttgttgccaattcgatcccgcgacgaatgcctagaggattagcacctgcagttacgttttttaaaccttcgcgaacgattgcttgtgtcagaacagttgctgtcgttgtaccgtctcctgcaatatcatttgtttttgatgctacttctgatacaagttttgcacccatgttttcaaaatgatcttctaattcgatttcttttgcgatcgtcacaccatcatttgtgatcaatggagagccgtaagatttttctagtacgacatttcggcctttaggtcctaatgttactttcactgtatctgctaatttatctaccccgcgtaacatagctgcgcgtgcgtcttctgcaaatttcaattcttttgccatgattgattcacctcattgattatttttgattatttttttatcttccaaatttactcaacaatcgccatgatatcttttcctgcgacgatcagatattcttttccttcgtattttacttctgtaccggcgtatttttcgaacataacttggtcgcctgcttttacagcggcaggaactttttcaccgttttctaacaaacggccttcaccgactgcaacaactgtcccagtttggggtttctctttagcagcagaagctaaaacgattcctccgacagttttttcttcttcttttgcgacttcgataatgacgcgatcacctaatggttttaacacgataaatccctccgataactctttttttaatctgttagcactcttaaccttcgagtgctaacctacatttttaataatactcattctccctcttttttgcaagcttttaaatcaaagaaaagaaattttattctgacagctgcttattgaaattatgatataattgaaatcaatcgatataagcttgccttgcatgcttgttatcccttaaaaggaggaattacatgtctttaaaaaaatatagcttcctcagcattttttgctatggtctaatttttatctcacccttgatcctagcttcgataggacttgtaaaatctacgtctgaattgatcacagcaactgcagtcatgtatatactaggcgccgttgtcctagctattttttattttaagcaacgtgaacccttagcgatcgaatcagcggtaaaaaaagcttctgctccaaagattgttatttatggattggttggaatctttgtcgcattgattctgcaaagcatcgctgtcatgttagaatctgtattgtttggcaaagcaaccccttccgagaatacacaaaatatcatccagatgatcatggaagcacccgcttttattttggcgacaactgttgctggacccatcatggaagagttcgtattccgccgcagtatactggggatcatcagtcgatattcaaatttttgggtcggagcagtgatcagctctttgctgtttgcgtttgctcataatgatggtcatctgctaatctactttttcctaggtttcttcttcagcctagagtacaaagcaactggtcggatctggacatcgatgatcacacacgtaggaatgaacacattagttgttcttgttcaattagctgtccaaaaagggctagtataaacatgactataaatactcctgtcatcctagattggtgattttcccaatctaaagcgacaggagtatttttgttttttagtcgttcatcttttctgctgctccatcattttttgtctgtctttcctttttgcagtttgcagaatctatttttttcaaaaatgggaaataaatgaaaaaactaattgacaacacgataccttgtaaaatcgctgcaggcactccgcctactaagaaacccgagaggatcggcggtgttgtccaagggacttggactgctgtaaataaaggaacgaatccaaaatataaagcggaataggtaatcaatcctgaaacgaccggtgcgaaaataaaaggaacagccatcatcgggttcatcacgatcggtgtggaaaaaataattgattcattgatgttgaaaaaggctggtaaaagagcaagatttcctaattctctgtatttcttcgatttcgcaaaaaccgtcataaaaaatacagcccctaacgtcaatccagcacccgtaaccgtcatgaactgatcgagaaattgctgagtaacgatatgtccgccatttgccaccgtcaactcttgtcctgaggctaagatttctgcattcgctaatgaattcgcttgcaagacgggactaaccaacccattgaccatcgcagatccatgaagaccaaataaccataaaaacggaacaaaaaaacctaataaaagcacaccaaacaacgtgtctatgaacgattgaatgggaagctggacatatgtccatactccttgaacaacagtcattctgaacaactgttgaaaaaccgctgaaccgataagcgtaaaagtgactataacaatgattggaatcaatgaagtaaaagactgccaaacattttcaggtatcttctctctttgcttccaccctttcgcaagtcttactaaacgtgcatagccccatccgatgatgagcccagttgtaactgctcctagtatcccttcagcacctgtccagacagtatctatctgagtatttagtggctgaataagcagtagataagcagacaaggctgttatgccgactggtaagcgatcgatgtcttcttcttttgcataagcgtatgcaatggcaaaaacgatccaaaaggctatcacatcaaatgtagcctggtatacttgtgtaaaatacatagaaaatcctgttttgtctatccactgagcgatgtaatccacaggaaaatgagcaaataagaaaaacagcgagccaacaataattattgggatcgtgtaagtcattccattacgcaaagcagttaagggtctaagattcacaacagatgttatcattggtaaaaaggcacgatctaaccactctttcatttcttatctccttcaacttctatttttatcaatcagttttcttaatttaactatacccaatgatcacgaaccatgaaaggaatgcgcactgagcttttcaaaaatcggattctttgacgaatattcagcaactgcttacaatggacaggaataaaaaaggaggttttttatgaaaattgcactcattggagctactggccatgcaggttcatttattttagacgaagcattgtccagagatttagacgtgacggcaatcgtgcgtcatccagaaaaattgccatcagatgttccgtttatacaaaaggatttatttgagttgacaactactgatcttgcatcttttgatgttgtcgttgatgctttcaacgctcccaaaggaaaagaagaaatgcatcaaacttctttgtcccatttgattgagatgcttgaaggaaccgatacacgcttaattgtcgttgggggtgcctcttcgttattcttagatacagaaaagacgactcgtatgattgaccaagtacctaaaaatgcacccttctatccaacagctttcaatatgtacgaaggattgttaaaattgaaacaatctaaaaatctacattggacttatatcagtccagcttctttatttgatccacatggcaaacgtacaggtacttatttgttaagtgatgattatttacaaagaaacgctgctggcgacagtacgatcagcatggcagattacgcgattgcattagtagatgagatactggatgagaaacatgaaaagcagcacatcagtgtagtcagtcgataatacggttatttttttaatatgctaaaaaaataaaaatagaagataaaaccaaccctgattgattttatcttctgctttttatatttttattgattgaactgtttaaatcgaaaatagctcagttgcttcatctggatctgtatcatagatttcaaaatcatgtccaacgccaaaatctttttctttcaaaacattttccattgttaaatgagcaagttctttcatattgttttccttgctaagatggccaagatagattcgtttggtccgattaccgatcacatcagtcatgacaagtgcaccgtcttcgttggaaagatgtcctctatctcctaaaatacgctgttttaaattccacggataaggtcccatgcgtaacatctcaagatcatgattactttccatcaaataaccatcggcattttcaatgacacctcgcatataatcactgcaatatccggtgtccgtcaacatgacgaatgaccgattttctttatggaaacgataaaattgcggagccgctgcgtcatgggagacgccgaaactctcaatatcgatatcgccgaatgttctgactttccccatctcaaatagatgtttttgttccactggtacatttccaatcagtggttccatcgcttcccaagtctgctgattggcaaaaacatccaaatgatacttacgagccaagacacccacgccatgtatatgatctcgatgttcatgcgtcacaagtattccatctaattggtccggtgtccgatcaatttgagccatcaaggaagtgatttttttaccgctaagtcctgcatcgaccaaaagccgttttttttcactttcgatataaagtgaattacccgaacttccacttgctaggatactgattttaaaagctggtttttcttcagccatttgactcctacttcccttcttactttgtaaacttttttcattatactcgcttttttattgatcttccacttttggtacagtattgtttgtcacgatcgtattgctgaaagcgttgacactctcaatttggaccactttatcgcttgtttcgatcgctacatgccaaacaggaacatacacatttttttcccggactttcagaatacaggaataagctagctgacgccataaaatttttgatcctcttggtattttgttattgatgtacaatgtattgattgcttcctcttccgtatacagttccgtcttttcgcgcagctgctcgatatcagataaatgcgtctgcatgtatttcgtgatgctataatcattatcgtttttttctaaagaaagaacgatttttgctgtatcatcattgaatgggatgccttcatactcttggcttgcttggatttctagtggttcttcttctaaatgagaaaagtttttcgtgtacacataatcattaccgaataaaatattgtctttgttagataaaaaatcttccaaggaactactaattttatctggatcgatcacgttcttttcagcatctgaactggataaagatttcgtcaaaacatcaccgtctaaaaacacaccacttgccagcaagccgcttttaccagccttgcgataattcgctaatgaagtgctaagattggtctgctccgcgctaagataatagccttgcttgttctcagacgaaatcttccccgtgtaagtgatatcgtcgctagccagacgttgttggattgattcagtctgattagagcgaatgacattgttttcttggtataccgcgtcatgataactgctgaataaaaacacattcaaccctaaaaaagcgacgaaaaatatccattcgatttttttgaaatccaattaattcgcctccaatccaggtaatttttccagaaggtcgttagctgaataccagttatctttatatttcacataccattcaggtaagagatcaacgacacgattcgtttctttgacattttgccatgtatagccaacgatcactgaaccaatcttgttgctatctgctcccttagcttttaactgctggatgatttcattcgtacttgcaagttctacttcttcgtctgaaggtatcggcacttgaatcgtattcaaactggtttggatattcacttgcacagaaccattcgtttcaccgccaacttccacaccaatctgtcctctgctgtctgtcccaaaaaccgggaagccttccacgaatatccgataatcgatcgtattgtcactgcggtcaaaatatctgaggttccctaaagaactgcctaatttgctaatataggggaaactttcagaaaatacactagcattttcttttttctctggcagctctccacgaaaatcaactacttgcgtttccgaatggatagacattgtttcattcccaccgtaaaaaatcaattcattgctttcatcattatttttcacgctatctggtttctggaaaaaagcatttctaaaaagtgtatagggttgctgtgacaggatataactatactttttcagtttgatcgaatgtttcgtagcatattgcgtgtcgatcgtcgatggttctgttgtcatttctgtccattttgtgtcttttgctgttaattctttattgatatctgtccaattcaacgaaatatttgcttcatatacgagatggttcgaataattcaaaaatcggatttttttatttccttgatcgaattgtattctagtaaaatacatattttcgctttcttttgccaagttcgacacatctaaatctaaatcaaatgcttccttgtattctcttagcaaaaaaggcgcattataggccaactcaaaaccagagttcagatttttcacctgttcaaactgtgatttgtctcctgaaactacttcagaaagctttccaaatcttgctttatcgatgatcaattgcaatcggtacacgagattttcactgttggtttcttggatcattcccgaatggtgccatgtaacatgaagcggaagaaagacttcggaagtttttcgattgctttgagactcgatcatttgagtgtttgtctcatctacgttgattgaactttttcctgctgggctcagccagattgcataagagaagtatatgcttaacgcaaccatcaaaatgagtcctatacgaacgactttttcagagattctcattcccaccattcctcctcataaggttcatatggcagcgagatataaaaagtcgacccttttccttccttgctctctgcccaaatagcgcctcgatgcgccttaatcacttctctagaaatagctaatccaagtcctgtcccaccttgtgctcttgcacgtgctttatctactcgatagaaccgctcgaacactcggttcagatcttttttaggaatccccaatccttgatcggtgatacttaaaaccacgttattatgcgtttctaataagcgacaagtaatcgttcccccatctggtgaatacttgatcgcgttattcatgatattatcgactacttggatgattttatctgtatctacttcgacccaaagatctctttgcgtaaattcacgacggatcttataatttttttcctgatttcccaccatcatatcaaaccggtcaagaacaaaattcactaactcgttgaaattgacatattctaattgaagctgggtattacctgtatccatgcgagatagatttaagaggtcattgatcattcgaatcattcggtctgtttcatctagcgttaccttcaaaaaatttggtgctacttcctcgtctttccacgcaccttcgctcaatgcttcgatataactacgcatacttgtcaacggtgtacgaagttcatgggaaacattagagacgaattcacgacgttcccgttctgttttttcttgttctgtcacatcatgcaagacagctactaatccgctgataaaacctgattcgcgacggatcatagaaaagtctactcgcaagatcatctgatcactttccaatgtactggttgaacggtcaagtaccatttcgtttggatcttctaataatttccgcaacgtatattcttcttcgatatctaaaagtgtcaaaatcgattgtccgattgcttcctcgtttttgatatctagcaaggaaacagccatatcattgatcgtaatgactttacccctgcgatctgtcgcaatgacgccgtctgtcatatgggatagcacgctatccaaacgattgcgttcagcttccattgtatcttgagcttcttcaatacgttcagctaactgattgaaggtatcagccagctgtccaagttcatcttgtccatgcactttgactttccgactgtagtctcctctagcgattcgaatggcttgttctctcatttcaccgatcggctgtgtaatcgaacgagcaactaaaacagatacgatcattgaaataaatgccgcaattagtgaggcagtaaagaaaatgactgctgtgttattgatttccgaatatttttgttcgatattacttttgacgtaaagagccccgataacggcatcgccggtcggggacaggatcggttgaacattgatattcacccgtttatcgtcgttatctaaagcaacataacgtttagtcgtgaaatcattgatatcaacataatcatttttctttcccacagcgctttgttcattgacatcggttgttcctcggatgatccctttttcgtcaacgacccgtatttcgatgatatcgctagtcgcactgttttcaataaatcttttgatattcgcatttacctcttcatcatctgcattatcttttcgattcaattccgggctgattgttgttgctaatgattccaccgtttgattcatatctttaataaatgtattgatcgtggaacgttctaaaccacgtataaagtaggcaccaataatttcgatcgagatcaataaaatcagaataaaggtaatagcgatcttaaaattgactgatcgaaaaaagcggacttttcttttcatccaattactcctgttctgggttacgcaaatagtaaccgacaccacgacgtgtcactaaataatttggatggcttggattatcttcgatcttttcacgcaaacgacgtacagttacatccactgttcgtacatctccaaaataatcataaccccaaaccgtttgtaataaatgttctcttgtcatcacttgtccaaggtgcttcgccaagtaaaagagtagttcgaattcacgatgtgttaactcgattgtttctcctcgtttcgtcaccatgtaagcttctggatggatcgtcaaatcaccaatcgtcaattccgcaggtgctgcctcttctggttccttcgcagccgtggcaccgcgacgaagatttgctttgacacgtgcaactaattctcggttggaaaatggcttggtcacgtaatcatcggcgcctaactctaagcctaggactttatcaatttcagaatctttggctgttaccataatgatcggcatatcataagttttgcgtacctcacgagcaacttctaagccgtccattttaggtagcatcaaatcaagtaaaatcaaatcaggttctacctcagcaactttttccaaggcttcttccccatcatatgcagtataaacatcatagccttctttggctaaattgaatttgacgatatccgaaatcggcttctcatcatcgacaactaaaacttttttcataaagagccacctcttatatattattgtcataccttctcattataccgtatttctgcttttgtttcatctttgcctataaaacaaaagagaaaattaaaatgaaagtgcaaaatactttattattttttgttctaacttcaataaaaaaggaaaacactgattttcacctcagtgtttcctttttttgatttatccttctaaaacttgtacaccgacacccaataatcccggaccagtgtggactactaatgccggagaaatctggccaaagtagatttggtttgcttgtgggaactctcttttaagtctcgcttccatttcaattgcttcttctttcgcatccccatgggcaacagctaagttgaagacctttgcattaccgattttttctttgacgtaagcaaccgttttatccaaactttttttacgtcccctagcttttcctactgtgtaataaatcccttcttcattacatgagatgattgggttaagctttaaagcggttcctacaatagaagcaactaaaccgatccgtccacctttttgaagatattccaatgtcgcaacattaaagaaaacttttgttctttcgactaactcattcagattactgatcagttgatcccattctactccttcttccagccattttgctgcttggatcgcagaaaaacctgcaccaataccaatatttttcgtatctagtacatatgcttccaattcttcttgctgttgtgcaattaaacgaaccacattatatgtcccgctcaatccactggaaattgttaccgcaagtaccttttcataaccgtcttttttgatttgctcaaagatttctgtgatcgactcaccatccggcaaagatgtaccagggatttcctctggcaaacgttgatagatctcttcagaggtaatgtcaattttatctgtatatacctgatctttataaataattttcaatgggatcatatacatctcgtatttttttatcaattcttctggcacatccgtacctgaatctactaaaattgcgattttattgtttttcatttgttttctcctcttttaaatattcggtttctagaacaatcgttttttccgcaagaagtttcattgcaaacgataaagttgccgctcttacagcaatatattctacaggggttgcctggtcgaatttttgcggatgagatttaccttgtgctaattggctgaccatccacacagctgcttcttgttcatcgcaaaatagattataggcttcacgaattcctactgtttttccttggaacaatatcccttctttgatttcaggaatagtcaatacttgtttcaacgtagtgattgcaagtaaaaatgctacgtgttctttgttatatctttttttaactggtgctggtatcaaacctagtttaacgtaattgtttaccatagaagaggtaagcaatggatgcttttctccttgtatcacaggtgaaagataacgatcaactaacgttctgacttggtccatataaagttctaagtcagggagttcttcccagtgaggcagacggaatgtttctagttccttcccccactccattaattgctgacgcattttttccatcataaccgctccttttttcatttcataaacatgatatcagacttatgataaacattcaatctagttgctttaactaggtgatttgattagcgggattccatgaaaacaaaaaacaagaaggctaagccttcttgtcttttatcgttaagaacaggagacccgccggggagacggcgggaaaggagtaaaaaatgaaaaaagtgttagggtttgttctcttgcaagaactttgtttgttggtatgcttatataatagcgagcaaatgtgaataatctatgaatgatttcctataaggaagtaaagatttttctgattttctttaaatgtagtcttgcattttaaaattcttagtgctactattattaagtactttttgtacgggccgttagctcagttggtagagcagctgactcttaatcagcgggtcgcgggttcgagcccctcacggcccattgggtgccaaacccacggaacaggtaaatgttggtgcgaaagcatttcgaaaacatttacgctgttctttttttattttcgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactttctcaaatgtggtggaacagcacttgaatactttgaacaatacaaagaaaataagcgacgttgtgggagaaccgaaatcatttttcctgctgaggaaaaagaatacattgaaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggaattcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatataatgaaaaaacacattccactaaatttgatgccggttttccttgaggttttgttccagcacctcctttaatttttttaagctcttgatctgaacattgtttagcatttagtctatttttttcttccattacgattccccctacaaactataaatacttttatgtcactgattcaatatacctatttttctaatcaaaaaattttgagacatatttaatattataagtatcattaaaattgagatttatctccataatctgctcgatataaaccatttattccagcagttcttccaatttcactcaaatttcttattaattcctcttgatattcagtgaatcttattttattagtataagcagtaaaatatagataattcaccaatctatttattaaaggactgggatctaattcatatttttgtttttctaattttaaatataccttttgtaaaacctcaagaatatcagaatatttaggatctttacttatagatatatcattatataattcatgaacaatttgcttagcattttttttcattttagcacttccctggaattgctccacctaaaaaaccacctatagacattcctgcaatacaagtagttgccttggcccaatcgaccgtacatttatttttagtgcaatacactccatttccataatattttccactatgagtggtacccccatagataagttgtgtctctttaatagacaaaatttttaaatgtttcataatctaatcacccctaaattaatgtttttagactattattctaacattcattaaatttcaaaaaacaattccttcttgaaacgtagcaaaataattcctgaataagaatttaatcacttttaagtatataaactatgtatattctttaatattttttgagaatgcacttcgtacataataaactttaatcacattagtctttcatacctacgatcgatctctttgactcgcacccataaattcataatagtttgtcggcgtctttgaacgtttcgaagatgagctacgcattctctttttttatagacaaaaaagatagagacgaacatggagcttccaaatttggatatttgatccaattttggaagctccatttatttcgtgtctgtctttttattttttccagctttcgactaattcttggttctctttgatccagtcttttgctgcttgctgtggatcttttccattgttgatttccaacataactttttccatatctttttctgaccaatggaaattgtctaatactttgtaagcttctggctggtcttctttcaatccttttcgaaccatcgtatggatctgctcttcgcttcccattccgttttcaggatcttctaagtatttcagatcatatttggcaaacatccaatgaggtgtccatcctgtaactacaattggttcgtgttttttgatcgcttgacctagtgcaacggtcattgctcctgaagaagatgtctctactttccagtctttcaagttgtcatatttttggatcgtgttttcagcagccgtaactacaccagctcctggctcgattcctatgattttcttacctgcctgatcggttaactcatcgatcgaatttacatccatgtaggctggcactgctaaaccaacttttgctcctgtcaaattggcacctaggtcttcgacttgatctttatattgtgcatattgtgaaccatgagttttaggtagccaagctgaaaccatggcatctgactcgccatttgaaacagatttccacatgattgaattatctaatggcgtcatcgttacatcatagcccatttgtttcaatacttcaccgactacatttgttgaagcaacttctgtatcccattcaacataagataagttgatacgttttgtttctttggcagatgaaaaactccctataccaatcgcacctaagatcactactactacagcaccaatgatcagtccttgacgttttttacttttctgtgttgttgctcctgcagcttttttattgtttggctggttcaaatgctgtgtaaaacggtcaatgatgattgctaagataactaatgcaaccccgttgacaaatccattcccgacttgtgctctttgcaatgctgataatacgccgcgtcctaagccgggtgcaccgatcatagaggcaataacgaccattgaaagtgacagcattgttgtttgattgatccctgccatgatcgtacttttagctaaaggcaattctagtttgaatagtttttgacgacttgtgctcccgaatgaatcagaagcttctactaattctttaggaacttgtcgaatccctaaattcgtaaaacgaacggttggtggcagagcaaagatgactgaggcaaatacccctggaaccatcccgataccgaaaaatgcaactgctggaatcaaataaacgaatcctggcattgtctgcataaagtcaaggatcggtttgataatactttgggctttactgctttttgccatcaagatccctaatggtaccccaatgatgatcgagatcacactagataaaagaacaagtgtgacagtattcatcaaatcattccatagaccttggttataaataaaccatagaccgattaatgtgaacaacgtaagtcctggacgtttcttagaaataaagaaagctgctaccgtcaataacaagataaacaaaggagctggaatcactaacagtaaatttgtaatccccgacatcactgcctgtccaatcgtttgtaaaaatgaaaataggccagaaaaagttgtcgtaaaccattctgtgatattttctacccagtttgccactggtaattgatagttcaatagattattcatgttcactcacctcgcttgtttctgctaatgcttcaatcacactacctcggatgacgacaccttttaattttccatcctctacaactgcaagtggagtcggtgagtcataaataatattgaaaatatcacttaccaccatgtctttcccaatcaccgtcacattttcatctaggaagtcgatcaatggacgtttttgcttcctagcttctaacgcttgatctgcagtgatgatccctttcaggtgtctctttctgtcaacagccatcagcatgctgacttcttcattacgcatccttgtcaatgcaacgtttggtccatcagattcgatattcgtcgtcaatgcaggtaccatgatgttttgagccgtaagcactttggaacgatcgacttcttccacaaattcacgtacataatcatttgctggattggtcaatatttcttcacctgttccgatctgcatgatttcgccgtctttcatcaaggcgattctgtccccaatccgtaaagcttcattcaaatcatgggtaatgaaaataatcgttttttgaacattggcttgcaggtccagtaattcgtcttgcatttctcgccggatcagcggatcaagagccgagaacgcttcgtccatcagcaagatctcaggatcatttgctaaagctctggctaggccaacccgttgttgcatcccaccagataactgactaggatattggtctttaaatgaaagcaaactagaattttctaatgctttttctgctttttcttgtcgttcttctttaggtacaccacggacttctaacccgtattctgtattttccaagatcgttcgatgtggaaacagaccgaagttttggaaaaccatattgattttatgacgacggacttctcgcaattcttctttgcttaacttcgatacatcttctccatcaatatagatactgcccgaagttggctcaatcagacgattcaatagacggatcaatgtggatttcccactcccggaaagccccatgatcacgaagatttctccttcttttacgtcaaaattcacgtcatacacaccaaccgttgcaccggttttctttaaaatctccgttttcggctggtgatcattcatcatatctaaagcggcttgtgtctttttaccaaatatctttgttaaatgttttacttctacttttaccaaacaaattctccttttttatgtaaattcatttttctttctgaaaaaaagtgaccacactatgttaacatcatgtagtcactttgtcaaaaatgaaagaaatttgcttgtccaaactgaaaaaaacttggctaaatctttgtaaataaaaggtttagccaagttaatatttttttaatatttcacacaatcattctgcaagctgatgctccgggtaaaaaaagtttgtcatacgctgtagtgtatattcatttccaataaaatgaacgatgtcccctgccgtaaatttagcataggggccaggtgaaacaagcagttcttcattatgagaaattgcgataactgtggcgccagtcgcctgccagatattcaactcgctaattgaacggtccagatgcattgctttttctgataaagataattcaaacggaagtaaaggattcatcttatgtattcgcttcgtttgattgaccagctgatccaataattgagaaaaatgattcagctcatcttgttgcttctccacacttgccatgatttctgcttttgtatcttggatggattgtacatcttgatattgcaataggaaatcttttgctttttccttcgaagcaacaaatgccccacttccatgccgtacttccatgattccaagatctaccagcacattgatagccttgcgggtagtctcaggagaagcattgtacgtactggcaagtgttgagcgggcatggatcttctcacccactttatatcggttttcaacgatacgttcggctaaatcaacagcaatctgctggtagcgcgggcggacgatttttttctttccagacattttctttcctctttctttttttactttccctcatcttactatgctctagcaaaataagcaaaaaaggggagaatagcctcttgcaacgactgatcatcgcttgatctgttccttttttactgggcaagctgtttgacagtcatcacaattcttaccggattttaaacgagtatagacaattgcgcctgcacttccaaagattaacacacttaataagaatgtcgccatcctattcctctccttctaatgacaatatagtataaaactggttcttggattttggctgacggaacaaaacataaacgagtcctatcatcagtaaaatagcaagatacgtccctaacgctacctgtccaccctccaataagtgtcccaactgataaatcacaaaactaactaaataagctaaaccgcattgatagcctatggcgatccaagtccatttcttggcattcatttcccgatggatagccccaattgccgcaaaacaaggcgcacaaagtaaattgaaggctaacaatgaataagctgctgcgggagtatatgtgtgttgtagcacttgccagatttctctgccattttcggatacttccgcatgaccaaacaaaataccaaatgtgccaataatattttctttagcgaccaatcctgtaatcgctgcgactgttccttgccagtttccccaaccaagcggctgaaaaacaactgccaggattcgcccgaaaaaggctaagatactttggtcttcagaaacaggttgagcataaaaattataagaagagctgaaccagatcacgatactagaaacaaagataatcgttcctgcttttttaacaaaagacttgctgcggtcataggtttgtcttaggaccgctgaccattgaggaaaatgatatgcgggcaattccatgataaaaggagctgtatctccagcaaacaaacgtgtttttttcaagctgattccagagaaaataattgcagtcataccaagaaaataggcagaaggagctacccaagattgatgaggaaaaaaggcccctgctactaaggcaataatcggcaactttgcagaacaaggcatgaaggttgtgaccatgatcgtcaaacgacgatcttgctcgttttcaatcgtgcgactggccatgacgcctggcactccacatcctgtagcaatcagcataggaatgaaggattttcctgaaagaccgaatttcctgaaaagtcgatccatgacaaaagcgatcctcgccatatatccgcagtcttccagaaagctcaagcataaaaacaatataatcaattgcggtagaaatcctaacactgctcccacgcctgcgatgatgccgttcaagatcagctcctgcatccatcccgctacttgccattcagctaacaatctgccaacatgttctggtaaccatgtaccaaacaatgtgtcattgatccaatctgtccccattgttcctactgtttgaatagccagataatagatcagccacatcacaaatgcgaagatcggcaaggctaaccaacgattcgttgcaatctgatcgattttgtcactcatcgataattggaaagaatcatttgacacaacacagagtgtacatagttgggtaataaattcataacgttcattgaccagaatcgtctcactatcgtcgtccaatagtttctctgttaactggatcagttgctcgatctctttttgctgagaaactgctatctcgtaatcctctcttaccttctgatctcgttcaaaatatttcattgcataccagcgtttcttgccgctttgttctcctagtacatcttcaatttcatgtaaagctgcttctaaacgtggatcatatgtacagggaacaggaatagaaggccgcttttttgcagactcctgaatcttttcgattagtttttcgattccttgctttttcaatacgctgattggtaaaactggtacaccaagaccataggaaagcttttctagattgattttttttccttcttttttgatgacatccatcatattcagaccaatgatcataggaatgtctaaatccaataactgcgtagttaaataaagatttcgttctaaattggtagcatcaataatgttgatgatcagttcaggctgttcctgaaccaaataatctcttgcaatcacttcttctggtgtataaggagacaaagaatagatgccgggtaggtcctgaatatgaatgttcggattttttttcaacgatccttcttttttttctactgttacgcccggccaattccctacatattgattcgaaccagtcaagagattgaacaagctagttttcccgctgtttggatttccgactaacgcgatattcattctttttcctccctttgtatcaagattagttcggcctctgactttcgtaacgtcagttcataccctcgcactgtcagttcgattggatctcccagaggggctagttttcggataactatttttacatttcgcgtcaatcccatatccattaaccgtcgcttcactgcgccttgtccgtggattgctacgacgatcccagtctctcctgcttttaattgatcaagagaagtccagctttcagaggaagcagtctttttattgacaaagatttgacctagtatttcccgacttactgccactcgatgactttttaccagtaaaatggcattgttgcctgataaattgacgacgacgattttacttccggcaacgatcccgatattttgcaaatggcgttttgttttttcttctgtttcgattcgttcgacttgataaacgaaattctgctttgcctgcgctaaggtctgcatattgattcctctcttgtgaaataaatcatgtattaaaatcattcattatatgttctaattttcttacgtgttacgcaaataaatgagaatcattctcacatagaatactctcggtaattgagaatgtcaattatacttgtgatattatgagcgaatctttagtattgatagataaaaatgagaaaaaaatatttcttcatagttttccacaattttttctctattaaatttgctattttcccacacgatacttgttttcagctcttttttcaaaaacacaaaacttagtattccacagtttccacaacacaatatgtagtgtttgttgtttgacttttttactaagagttttatactatctattatagataataagaatgtgttagaggaggcactcaccatgaacgtaaaaatcttttctaaaaataattgtatgcaatgtaagatggtcaaacggtttttaacagaaaatcaaattgcttttgaagaagtcaatatcgatgaacagcctgaagcagtagactggttgaaagcacaaggattccaaagtgttcctgtcattacttctgatgcagaaacagttatcggattccgtcctgatcagttgcgtaaacttgccagctaacatgactaaaagaatcaaaacgtgatacatggatttgaagggcttgagacagcaccagtttttgtcgcaaacttccaaatccttttttaaagcttaaaaacaatgcaatgatttgcaatcaagcatcatcaaatacgaaatgaaggttgggcgtacgtatgagtcttaaaaatttacaagatgtcagttatttcaagctgaataatgaaatcaatcggccagtcaatggtcaaatccctttgaataaggataaagaagctttagttgccttttttgaggaaaatgtcaaaccaaatacgatgacttttccatctattatggaaaaaatcaattacttgatcgatcaagaatatatagaagcagaattcattcaattgtattcaccatcatttattgaaaagctatatcaatttttggacgagcaacatttttctttcaaatcttttatggctgcttacaaattttattctcaatatgcgttgaaaaccaacgacggttccgcttatctggaaacttatgaagatcgagtagccttcaatgcgctttactttgcgaacggggatgaagaattagcacttgctcttgcagacgaaatgatccatcaacgatatcagccagctacaccttctttcttgaatgctggacgtaaacgtcggggcgaattggtgtcttgtttcttgactcaagtcactgacgatatgaactctatcgggcgctcaatcaactctgctttgcaattgtcccgtattggtggcggcgtagggattactttatcaaatcttcgtgaagccggcgctcctatcaaaggatatgagggtgctgcaagtggtgtcgttccagtcatgaaattattcgaagatagtttcagctattctaatcaattaggtcagcgtcaaggagctggcgtggtttatttgaacgttttccatccagacattattgctttcctttcagcaaaaaaagaaaatgcagatgaaaagattcgcgtaaaaactctttctcttggcgtgatcgtacctgataaattttatgaattgacacgtaaaaacgaagatatgtatttatttagtccatatagtgtcgaaaaagaatatggtgtcccattctcttatgtaaatattacagctgagtatgatcatctagttgcaaatccaaacattcgcaaacaaaaaatcaaagcgcgtgatcttgaaaatgaaatctcaaaattacaacaagaatctggctatccttacgtaatcaatattgatacagcgaaccgcgagaatccaatcgatggcaagatcatcatgagtaatttatgttcagagattttacaagttcaaacgccttctgtgattaacggcaaacaggaatatgaagtattaggaacagatatctcatgtaacttaggctcgacaaatatcgtgaatttgatgcaaagccctaactttggtcaatctgtgcgtacgatgactcgtgcattgacatttattacagatgcatctgatatcgatgtcgtaccaccgatccaaaacggaaataagctgaatcatacgattggattaggtgccatgggcttacacacttatcttgcaaaagaacaaatggaatatggctcagaggattcattagactttacaaatatttacttcatgctgttgaattattggacacttgttgaaagcaacaatatcgctcgtgaaagaaaacaagttttccataattttgaaaaatcagcttatgctgacggcacttatttcgaaaaatacgtaactggagaattccagccaaaatcagaaaaagtcaaagcattgtttgaaggcatttttatcccaactgctgaagattggaatgctttgaaacaagcagtaatgaaagatggactgtatcatcaaaatcgcttggcagtagcaccaaatggctcaatttcatatatcaacgatacgagtgcaagtattcatcctatcactcgcatgatcgaagaacgccaagagaagaaaatcggtaaaatttattacccagcgccttatctatccaatgagacgattccgtattacacttctgcttatgatatggacatgcgtaaagtaatcgatgtttatgcaacggcacaacaacacgtcgatcaaggcatgagtttgactttattcatgcgttctgaaatcccagaaggcatttatgaatggaagacaacaacgaagcaaacgacacgtgatttgaatattttaagacattacgctttccacaaaggaatcaaatccatttattacgtacgtacctttactgatgatgcagaagaaatcggaagcaatcaatgtgaaagctgcgtgatctaatatcatagatagattcgcttattcatattttaattaaaggagcattctcatgtcagaaacatattatgaagcaataaactggaatgaaattgaagatatcattgataaatccacttgggagaagctgacagagcaattttggctagatacacgtatcccactttcaaatgacctagatgattggcgtacattgtctcaattggaaaaagatacagtaggacatgtatttggcggtttgacactgctagatactgtccaatctgaaagtggcatggatcagttgcgtaaagatgtccgcactccccatgaagaagccgttttgaacaatattcaattcatggaatccgttcatgccaaaagttattcttctatttttagtacactgaatacgaaaaaagaaatcgaagaaatttttgactggacaaatacgaatccttatctgcaaaaaaaagctgagcgtatcaatgaaatctacaaacacggtacaccgctagaaaagaaaattgccagcgtctttttagaaacattcttgttctattcaggtttttatactcctctttattatttaggaaacaacaaattggctaacgtagcagagatcatcaaactaatcatccgagatgaatctgtacatggaacctacatcggttacaaattccaattaggattcaacgagttacctgaagcagaacaagaaacgttaaaagactggatgtacaatcttctttatgagctttacgaaaacgaagaacgttatacagaagaattatacgatccaatcggctggacagaagaagtcaagacattcctacgctataatgccaacaaagcattgatgaacctagggatggatccactctttccagatactgccaatgatgtcaacccaatcgtaatgaacgggatttcaacaggcacaagcaaccatgacttcttctcacaagtcggaaacggctatttgttaggtcatgtagaagcgatgaaagacgacgattatttgattggattggaataaggatttattttaattcaaaaatttttcgaaaaataaaaagagtttagcgtacagatattttaaatgtacactgaactcttttttatgcttattcacttgtttcttccagcacttttggactgtctaacttttccgaaacatgttccattcttctcaataaatagattttccggatatttaatattatcgtcttaatcactgcatagacaggtatgcaaatcagcatgcctaatattcctgcgacacttcctgctccaatcaataccaagatgatcgtcaaaggatggatattcattgatttcccaaataacaacggcttgatcaaatttccatctaattgttggatcactaaaatcgacaacgccatatacaaagcttgaaatggagagataaacaaaccgacaatgattgctggtaccgctccaataaaagggccgacatacgggataatattcgtgattccgcaaatgaccgcaagcaacaagctataaggctgatcgaatattctcattgccaaaaagctcattacaccaataatcaaagcatctaagatcgtactgctgatataggcagataatgtttcgtttaattcttttaccgtttggcgtaactctttacgaatcgctttcggaaagaagtgagacaacgcatcaataaatttgtgcccatccttgaacataaatagcaaaataaatggaacggtaaataacaaaataaaaaattgcatcataaatgaaatgatttttgagacacttgcagataaactgactaatatgatattgaacaaattactaagagataaatttgctgatgctaattgttcttccaaattgaaatttttaaactcttcccgctgcgccaattcatttaaccatttgcttgtttcatctgcatacattggcaagctctgggtcaattgaattgtctgttccattaactgaggcactacattcatgacagttaaaacaactaaaatgattacgaccaaaaacgtcaataaaaaaccgaacactctcgggatccgatgcttttcgagaaaaacaacgattggatcgaacatataatagataaaaccagcaacaagcaatggtaaaaaaattgccgaaagcattttcaatattggactaaaaatattcggcatttgtaaaataaagtacacgccgatgatcgtgagtactagctccactgtccagaaaaataattttgattgtttaaaacgtgattgcatacatctcctccaaggtcctttgatacttctattctatcatttaacaaagagttacgcgctgagattttcatttgcttaaaaaaacaaaaaaataaacatattttaatgagtagacgagtacttaaacaaaaacacggtttggagtagtgacaaaaattatactgcagtccctttttccaaataaacggtgttcaaaagcttgcatcttcgtaataagcccagccaaacgaaaaatataaggaactatttttatttggctgggcttattacttgatgtaggacatctattttacaacctcagatcatttattgcgcaatactgactaaatgcaactttgtgatatttttgtgtacggacaactcctcgatcacatcggcataagtgagcccttttggaagatcaatcgtatagatatttttgtacactcggtagtcatcaacgaattttacgtcaaaattcacatcttcgattacgatatttttctcttcaaaataatcggtaagaaaatctttggtttcttttctatggataaattggatttctaactttttagtcgtaggtacatggatcacgcgtttcactactgtgagtgcaatagcaatcccgataaaactgatgatcgcaatggaatagtaacccatgccgatggcgatccctaatccagcaattgcccataaagaagcggcagtcgtaagtcccgtcaccgattgtttcgtgacgatgatcgttcccgcgcctaagaaaccgacaccactcaccacttgagcaatcagccttgcttcatctgaacgaatcgttccagcaagctgtggatactctaaagcatctcttaatgcaccactagcgatctcaacttggatcaatgcaatgatacatgctcccatacaaactaaaatatgcgtacgcatacctgctggacgatttttatattgtcgttcaaaaccgattgctccgccaaatagcatagcgatccctaaacgtaaaataatctctggaattgtcaataccatatcattcatctaaacaccctccagtccaatatatcatgtctgaaaggagcagacaaaaaaagtgcaatttttacctcttacgaaaaaaggactgtgacaaaatttttgtcatagtcctttttatgaataaacggtgttcaatcagctgaccctcggtattactcaacaaacggcaaaatatggggagctatttttcctttgtcttctctaatactcaggtcaaaacgctgatttcacaacctctttagcctactattgaaaattacaacttacttgctgcttcttcatcgatgatcacaacaacattgtcgtgattttgcaatacacttgctggcaaatgattcgttacaggtccttcaatcatccctttgattgcatcagctttgctttcgccaaatgccatcaagacgatttctttacttttcataattgaaccgattcccattgaaacagcttttgttggtacatcttctgctttatcgaagaatcgtttgtttgcattgattgttgattctgttaagtcaactactgaagtcgttccgtcaaatgaagcaccaggttcattgaaaccgatatgtccattttgcccgattcctaagatttggatatcgattggatgtgcatcgatgatttgatcatactttttgcatgctgcttccagatcttctgcttttccatctggtacaaacgtttctttgaatggttttttatcaaataattggacatccatgaaatgacggtagctttgttcatctgaaccgcctagtccaacgtactcatctaagtttacagaagtcatttcactgaaatccaaatcgcttgaagtcatttctttatataaagtaactggtgtgcttcctgttgccaatcctaatacttttgcacctttgttcataccttctttgatgatttcaaatgctttttttccgccttcttcagcgttttttacacgaatgatttccatagtgattgctcctttatattttggtatagcccaattatagcattctttttttctttttacaataattagtatagaccaaattgcatttttttcattttcttgacaataaataggaatccgtgttaggtttcataagatggttcaatcaaacaatccatgttgcatgaaaaccaagcaagtgattcactgtggacgctttatgtctgcagtttttttatgaaaaaggagttattatgagtatactgacattaaacaacattacccagcaatttggcgacaaaatcctctatgaaggtgtcgatctgcaattaaatgctggcgaacatcttgggctgattggacaaaacggagccggtaaaagtacattgattaaaatcatcactggtgagatcttaccagatgacggacagatccattggcaaaaaaatattcacaaaggttacctcgatcaatatgtggaagtcgatgaaacattaacaatcgaagaatttctaaaaactgcgtacgcaaaagaatacgaaaaggaagaaaaaattgcttttctttaccaaacatatagcgagaccttcgatgattccttgctggaaaaagctgggaaactccaaacggaattagaccaaggagtgttttatcaaatcgacaccttagttgctgagatgagcagcgggttggggatcgatgtcttaggtttagattcactgttgaaaaatctaagtggtggacaacgttcaaaggtgattttagcaaaactacttttagaaaacccagatgttctgatcttagatgaaccaaccaatcacttagatgatcagcatatccaatggctgacgcagtttcttcaggattttgacggtgcgtatatcgtgatttcccatgaccaagaatttcttgatcagatcaccacccatatcgcagacatcgagtttggaaagattactaagtatactggccatctaaaacaagcattgaaacaaaaggaacaaaatcgcgaaagctatttgcgccaatatcatgctcaacaaaaacaaatcgaaaagaccgaagcttatattcgaaaatacaaagccggttcccgatcaacgatggcaaaaagccgacaaaaacaattagataaaatcgaacggctgacgcctccagcttcagcaagtaaagctgtctttgattttccattctcgcctattgtcacgacattagcagtggaaacaactgatttagtcatcggatatgatcgaccgctacttgcacccatcaatttgaccatccgctttggtgaaaatattgccattcgaggcttcaacgggattggaaaatctactttattaaaaacactgatcggtgagattgaaaaaataagtggcgatttccacttcccagataacacaaaaatcaattacttttcacaagatctgtactgggaaaatccattagaaacaccactacaatatttaagcagtcaatttccaaaagcgactatcaaagaattacgtcgccaactagctaaagcagggttagttaatcaattagcaagtgaacctctcactacattaagtggtggggaacaaactaaggtgaaacttgcacagttgacaatgaaccaaggtaatttactgattctcgatgaaccgacgaaccatatcgatcaagaaacgaaagaaagcttacaagacgggatacagaaatttccaggaacagtaatcatcgtctctcatgaacaagaattttatcaagatcttgtgcaacgagtcattgagattgaaccaaaataaacgtttgattgaatagttgaaaaaaaggagctgtgacaaaagttttgtcacaactccttcttctgaataaatggtggccaattagctgaccttcggtattagctcaaaaaacggcaaaatatgaggagctatttttatttggctattcttattacttgatgcagaacagcttttcacaacctcttttcgtctattttttattttcgagatttctctttcctttaaaaacaactgtttgaaagaagaacgcacatccttgaaaaacaagcccgctaaccgttacacctaaccagccatactgctgccacattgtcgtccctagcaatgaaccagccgcacctccaataaagtacataaacataaatacagacccgtggtgctagttaattttaatatcctaaagaatatctcaaagttccttcaaaacgtcgttgtgctcgacttaatagaacactgtaagccagtaatatgctttcaaatctactctctagccctttaacagaacgtgagttgaaattttgacaacctaatttttctaaggaagaaaaaacagtctcaactgtttttctttgttttccaagtaagctgtggtctagtttttctgatttatccatgtttttacgtggcggaacggatatagtaatgcccttaagggcaagcttttcatggattttatggctaatatatcctttgtcccctaggatattgggaagattcgcttcttccgataaagtctctaacactttcacgtcatggacacctggattcgtgattgagtaagtaatcggaaagccagtcttagtaacgatcatatgaattttaagaccataaaaataagatttttttgttgagttatagccaactttggctatttgattcaatagttttgcttgtctatttctaactggtttacataatggactaggaaaactatctataattccgactagttcacctttggtgagcttcttgatgaaaaagtatcgaataatcttgatagtgtaagctaagtttgaacttaagcgagtgaatcgactcctactaggaaagtcaccattaggaaataagacggaacaaaccgctctatacgtggctctttggctagtatagccattaattatgccccatataacacaagcaataatcactgtatcgcgttgcttcagttgatcagtatttcttcggttttaatcttatctggtacacaattgtggtatatgttagaaacagttctcataatttccttgaatgttataaaagtatctgtataatgttcagtatattttgatgaacgcatatgtagtcctcatttcttgggagttttgagactactatatgcgtttttttgttgatttaccaacatgtttagacattttcctctaggaaaaaattaactagcaccacgggtaaatacagtattatttcggttgcttgctgcttcacctagcccttgtactcgtgtttgattggcgacttgaccaaattgattcccgacgtctaataaaataatagctaaaagcaaaatggccaaatggcttccgccaaccaataaagcaataaagcttattgtttgcataacaagtcccatatacacgatttttctttcagaataagaatctgccagtcgtcccacgataggtgcagcaactgctccagacaaaccaaaaatcgctaatatccctgcttcgaatgttccccaattgtaggcgggactgctgatataaaaaatcaacgtagaccaaaagatcgaaaatgttccaaacatgaaaaatccactgactgccgcttctcttaatagacgttgagaagcaactaaatgcggcaaacttttaagtgaatcaaggtatgaaacagctgtactactttgctggacagaacgcggcattttccagtaaagcagaagtgtaagaattccgactgcacataaagcaaataaatagatcatccgccaagaaaaaagactggcaacaataccagataccgtccgagaaagcaaaatccccacgagtaaaccgctaagcaatgtacccatgaccttccctcttgcttttggtcccgctagtaccgcaccgtaaggaatgatgatttgcggcacgatcgaaagtaatcctattaaaaaagaagcgcatgcaaataacgtaaacgaaggcgcaaaaaaagcggccaacagagagacggcagataacgctaccattcgaatgatcaattttggacgatccaccacgtcccctaaaggaactaaaaacagtaaccctaacgcatagcctaattgggtcaacatcgtcaatatcccgactgcacttgtgctaacagataaactagctgctacttttgttccaatcggctggatgtaatacatattggcaacaacaacgccacaagtgattgataatagtaaaataagcgaagttgttaaaggtgttttttcattactcttcattgatttcccccatttcctatcttagtttacaacttatggaaaagattggaaatagaaaaatacaactattcgccacacttattatttgtgcttttgttttccttgttttttcttgcgatctttataaatgaagacaactaaccctactagcacagtaacacttgcaaccaacgtgactgcagttttgttatatccgtgaaacagagcttctccaccacacgcatacaacacagacgaagggatgactccaatcacgatcgacaatatgatttgctgtagaggcaatttcatcgcatctgcagcaaaattgaccatagaagatggaataaccggtatcatatagcctaacattacacctatttttggatgtttcatttgtcggattgcttgcacccaatgattcgtttcggttttcttatctaaaaattttaagcgatgcataaggaaaattgcagtgatgttaccaagagcattacccaaaatgttgatgatcgcacctgtcagtggtccaaagctcaaaccagcaatgactccaactactgaagtaggaatacctggaacagcacacatcaccgctgtcaatacgatcaagagtatcgatgcaaaagtcccatgcgaacgaatatgtgcgagtagctctgccttactcgctctcggatttaaaaataattggatgtctgtctgatattctaaatacaaccgatagcccactaccagtatcagaatgattcccaacgagatcaacatcaatcggattattttctttttcatatttcctcctgaaaaaaatctatattcattaaataatagtttaacataaaaacaaaaaagcaccgaaatccaacataggatctcagtgcttttaaatagtaaaaattatttaacagttacagatgcgccaacttcttcaagtttagctttcaattcttcagcttcttctttagatacgccttctttaactggtgcaggagcgccatcaactacagctttagcttctttcaagcctaaaccagttgcttcacgaactgctttgataactttaactttttggtctccagctgcagttaattctacagtgaattctgtttgttcttcagcagcagcagcgccaccagcagcagctacagctacaggagcagcagcagatacgccaaattcttcttcaatagctttaactaggtcgttaagttctaggatagttgcttcttttaactcagcaacgatgttttcaatgttcaatgccattataatttcctccgtttaattgttctttttatttaatgctttatgcggcaattaagctgcatctccatcttctttgtctgccactgctttgacagcgtaagccacgttgcggactggcgcttgtagtacagatagcaacatagatagaagtccttcgcgatttggcaattttgccaatgctgtgatttcttccaatgaagagactttaccttcgatgataccgcctttgatttctaatgcttttgcttctttagcaaattcgtccatgattttcgctggtgcgactacatcttcgttactgaatgcaacagctgtaggtccagtgaatacttcgtccatgccttcaaggccagcttttttagctgcacgtgaaagaatagaatttttgataactttcatttctacgttagcatcacgaagttgtttacgtaaacgtgttacttcatcaactgttaatccgcggtagtcaacgactactactgatgcagctgctgtaaatttttcgcttacttcatcaacgattgctgctttttttgcgataattgcttcactcatttttgagtttcacctcctgaattttgatggaagagttttttgcactgaaaaggcaagtcacttttatagttactttgctcaaccagtattattcatcacctattcacttcgttcatagtgattctactcgctttgctcgaaaggaaactcctttcgctttgctcaaccagtattgttcatcatctcttcacttcgttcatagtgattcacaataaaaaactctatgccaccgcagacatagagggactattgaatatattcaataaacgtcctcggtaggaaattaaggcttgatgccacctactgtcttcggtacaagttaattattaacctcaactagcttagcatgctaaactagttgagtcaagaattatttttcagttggatcaatcaacattctaatatttaattagaaagaagcttggtcaacatggataccaggtccaaatgttgttgtgatcgttacatttttcatgtattgacctttagctgctgatggtttagcttttagcaatacatcatggattgctgcaaagttttcaactaatttttcatcgtcaaatgaaacttttccgattggtacatggatatttccagctttgtccacacggtaagttactttaccagctttcacttcgtttactgcttttgttacgtccattgtaactgtaccagttttagggtttggcattaagccttttggtcctaatactcgtcctagacgacctacagtagccatcatatcaggtgttgcaacaactacatcaaagtcaaaccatccgttttggattttttgaaccatgtcgtcgtcacctacgaaatctgcaccagctgcttcagcttcttttgctttgtctcctttagcaaaaactaaaacagtttgtgttttaccagttccgtttggtaatacaacagcaccacggatttgttggtctgcttttttagggtctacgttcaaacggtatgcaacttcaactgttgcatcaaattttgcaatgtttgtttcttttgctaaagctactgcttcggcaacaggataaactttacttgaatcaactttttttaatgcatcttgcatttttttgctctttttagccattttggttcctccttgattgtggttataacggttgtacctcccacgtgttctatatctttcaatatagagccaactgagaagctgctgtcttagggtgtatagattattctacagtgatccccatgcttcgtgcagttccttcaaccatgcgcattgctgcttcaacgttagctgcgtttaggtcttccatttttaattcagcgatttctcttacttgatcgctagaaactttcgcaactttatttttgtttggttcgcctgaacctttttcgattttagctgcttttttcaatagaacagcagctggcggtgtttttgtaacgaatgtgaatgaacggtcttcgtatacagaaataacaaccggaatgatcaaacctgcttgatcagctgtacgagcgttgaattcttttgtgaatcccatgatattgatacccgcttgacctagtgcaggacctactggtggagctggagttgctttacctgcaggaatttgcaatttaacgattttttctactttctttgccacgagacatacctccttaagtccgtgatgtggttaattggagatgcatatttctcctcccacgttttatctgatctgaaaaaatccagacaaataatgtgcaaaacaatgcacactggtacagtatagcaaatttatttgttttttcaagatttttttctgctatttttacattttgcttgaataaacgctaaatttattctaaaaaaacaacaatttttcgttctcatttcttcttttatgttacacttgcgctagcatggttcaacagatgaaagcaaacaataacacggttttttagacccttgtacaaagattcctacataacaaaatgaggtggagaaaatgaaagatttaaggtatagaagtgtctttgatattattggacctgtgatgattggtccaagtagctctcacactgccggagctgctagaatcgggaaaatcatacgtagtatatttggcgaacagcctgattctgtagatatttatctatatgaatcatttgcaaaaacctatcgggggcacggaacagatattgcattagttggcggcctgttagggatggaacccgatgatgaacgtttagctgattctttgaaattggcatatgaagccggtatggaagtcttgtttgttcctaagagtgaaaaagccgaacatccaaactctgtaaagatgcttctaaaaaaaggaacacgaaagctttcagtcactggcatttcgatcggcggtggcaatatccagatttctgaattgaatggattcaaaatttctttaagcatgggtactcctaccttgatcgttgtccaccaagatgttccaggtatgattgctaaagtgactagtatactttctgagaccaatacgaatatcggcactatgacagtgacacgggaatcaaaaggtgaaaatgccattatgataattgaagtagatgatcctcaagtagaagaaacggtaaaaagactcaaacagctgccaaatatcgacagcgtaaattatttcgattaaggagctaaaaaaatgtttttatcgattgaagaattagtagatcaagcaaaagcttatccaagtgtagcagaattgatgattgcagttgaaatggaaatgagtggccgttcccgtagtcacatcatcgagatcatggaaaaaaacctctcagtaatggaacaatcaatcaacgagggaaaagaaggtgttacctccgtcacaggaattaccggtggtgatgcaaaaaaattagatgattatttaaatgaggcagactttttaagtggagaaacaatcttaaaagctgtacgcaatgctgtagctgttaatgaagtcaatgcaaaaatggggttgatttgtgctacaccgactgccggaagcgcgggtgttgttcctggtgtgctgatggctgtccgagatcggcttgatttgacacatgaacagcaattggaattcttatttaccgctggcgctttcgggttagtcatcgcaaacaacgcttctatcagtggtgcagaagggggatgtcaagcagaagttggttctgcaagtgcaatggcagcagcagctttggtttgtgcaaaaaatgggactcctcatcaagcagcacaagcagtagccattacattgaaaaatatgatgggactgatttgcgatcccgttgcaggcttagttgaagtcccgtgtgtcaaacgtaatgctttaggctcttctcaagcttttatctctgctgatatggcattagcgggtatcgaaagtgtcattccgccggatgaagtcgttgctgcaatgtaccaagtcggacgtcaaatgccgtcgattttcaaagaaacagcagaaggtggcttagctgttacgccaactgctaaacgacttgcggaagagattttaaataagagggcgtgataaagctccttaatttcgagtattaagagattagttatcttcataacaaaaaacgaagagaggactaattgcccttctcttcgttttttattaatccatcaatttcgtattttttacttcatcgatcgtttttgttcctgcaagttgcatcgtgatcgacaattctttgttcaggtgttcaaaaacagatgttactccttctgccccactagattcaacccataaatcactggtcggccaatcgcaactaagtcagcaccacttgccagagctttgaagacatgctctcctcgacggacaccagagtcgaaaatcactggtacacgtttgttgactacttcggcaatttttggcaatacttcaaaggacgcaggacctccatctaattgacgtccaccatgattggatacccagataccatctgcccctgcagagatagcgattactgcatcttctggcgattgtattccttttacgataactggaagatgggtgatttctttgattgttttgatgtcatctggtgtcaagccttgttttgcagctgcataaatttctgcgattccttttccttcgccattaccacttgcactttgttcgctatacgcagctaagttaggcattggtaatggaaattggaattgattgatgacgtcttcttcacggtaaccaccgagcgttgaatctgccgttaaaatgatagctttagcccctgcttctactgctttgttcaaaatgaactcattgaatctgtcgtctttactcatatataattggaaaaactgcggtgcgcctggcgctgcatcggctgcgtctttgattgtcgtatttgcataagtgctgatggaaaagattgatccagcagcagctactcctttagctgtatcagcttcccctttttcatgtgccaatccttgggccgctgatggcgcttggataatcggtgtatctaattcaattccgaaaacagatgtatgcaaatcggctgagtcgattccgcgtaatatccgtggcatgattttctttgtattaaaagaagtcgtattttctttcatcgtccactcatcttcagaaccaccgcgaatatagccaaaagctcctgcttccatgcgctcttttacacgaccttctagttaggcaatgtttacaatatcgattggatgttcttcattacttgtatgataagtcatagtagatccttctttcatcttcttgattacatataaatcatactaaacttacaaaaagtaagcaaacatttactctcagatacttttatcgctattctttccaaataaatcgacttacaagctgatctacttcttggttttcatgaagcatactatgagaggcattttcacctgtcactactttttcctctatttcatttccgcgttgcttcaacaacgcatagaccgctaatgcactgtttaacggtactgttccatcactcaagtctgtttcatctagttgaccagcaatcaagaaaaatcgagtggttataggaatattaccgatcatttgctggtaatcttgatagcggttagaaacgacagcaggcccctttgctaactcatctgtcagagactgcgcactatcatcgacaaaatcattaaaaggcgcgccaattgctgttaatgtctgaacttgtggcaatgacgtatcctgtccatacgttcctaaatagcgtagtgcactaactcctcccatggaatgccccactatgttgactttatctatgccgtagttttctttcagatacaaaagacaagttttgatccattctgcttgattccactcgttatttttattatcttcaaacaatacttggaccatcggattgtctgcttttccagacaaatctcctgttgcttgtatttgtccatctgttcctactgttaaaaccaattcttttactgcttgctgatttttttccaaacgccgcaacatccctttaaaggaattttctgtcccgctgtagccgtggaaaaaaagtgttggaatagtggttttttctatcactttactggattctgccgttttttctttatcagaaacttcagtagtatttatcttcgtcgtctggcaaccacttaacgcaaacaaactgataaggactaaagctgctgcagttgcacgtttgcataaatttttgattggttctgtcatacacctcttcctttccatatagaaaaaagaaagacttgaaaggccaatcatatgatcgacatttcaagtctctttattaatcgattttatctacttgatcgaaatcaagttctgtactggtttcacgtccaaacatatcgatgttgactttcaatttttctttttctccgtcaacttctgttacttgtccttctaatccagcaaatgcgccttcgatgattttcacgacttcgccaacttctacttctagatcattttgtcgcaggctcataccgatagaacgcaagatatgattgacttcttctggaagtaatggtgctggtttgcttccggctccgtgtgaaccaacgaatcctgtcacaccaggtgtgttgcggacaacataccatgaagcgtctgtcatgatcatttcaacaagtacgtatcctgggaatgttttatgaacgatttctttttctttcccatttttgacttcagtttctttttcttcaggaacaacgacacggaaaataaagtcggccattttcatactttgcgcacgagattcgatatttgcttttactttgttttcatatcctgaatatgtatgcaagacataccagtttttttcaaaagattccattgaaggctcctcatttcattgtaaaataaaaaaacctcagtacacccgaagtttttctttcgcttcattatagcactaaaagtacgttgtggctagcgagttattttaaaatccagccaaataagctttggatggctgtatccattacgtaaaacatcaatccgaaaataatagaagtttcgatgactactaacgtatctttacggagttgttttctgcttggccaagttacttgtttgatttcatcttttacgctttttagaaatttcatgagacaacctcccttgctactgtttatttcgtttctttatgtaatgtatattgattacaatatttacaaaacttattgatttccaaacgttcgccgctttttccttcactgactgattttgtgtagttgcgagacccacaaacggaacaagcgagtgctgcttttttctttgccatttacttctgcccccttgctgagaatcagacttatacttcataacagtatcacgtaactttttacttgtcaatttgtgaaataaactatctattgttttggataaaattatgatatgattaatttgaaattaagctaaaatgagacaattggaggtatagcgatgctattaaaaacacttgtatataagaaaaaagatctgacaaccgttacagagactagtacattagaagaagcattaaaaattttagaaacttccggataccgttgtgtgccgatcttagattcttcaggtaatattttccgtggaaacatttacaaaatgcatatctatcgtcataaagcaaatggcggtgatatgacgcttcctgtcactcatcttttgaaaaacgctacaaagttcatttacctggatacttctttcttcaaagtattctttacgatcaaagagcttccttatattgctgtccttgacagtgaaaatcatttttatggtattttgacacatagtacgttgcttaatatgctctctcaatcttggagcgtagaacaaggaagctatgtactgacaattgcttccacaggaaagcaaggagatttggctgctattgcaaaaatcatttcaaaacacagcagcattgccagctgtattactcttgatatcgaaaaagacgaatacattcgacgtacattgatcacgctaccggctaacactgaagcgaaagtatgtgaaacgatcgtcaaccacttagagaaaaagaattataaagtggtagaaattgaaaatttgcaaaaccaagaagcataatcaaaaagcgaaaaaagaaaacagctaatctgctttcttttttcgctttttataattagacacgcttttcaaaatcaagcgcgcgatctaaataatacatcaatggtgctgaaacagccatgacgataaactcacttaatgcaagcgtgccataggttgtccaaaatgcttggccacctgttggaactaacatataagcaatcagtcccatgctgatggtaaagaagatcgtgttcaatactaaacgcatctttacatttttcactttgttttgcaataaagctgtcaggcctaaagaaagcaatgtttggccgccaccaaaaaccacatccatgataccaaaaccaaagaaggcattatagacgatgaccccgcctaaaactccccaaagcaatttacggttaaagacaactaaatgattcaaactttctgaaatacgaaactggatcggccctgaggatacaggcgcaactaaaatagttaacgctagataaagagccatgatgatgccatttacaacgattacggataaccgttgtctgcttttcgttttttgcattttctctcctcttttctcctagtttttttaacgcgggatggttgatgaaccgcggttatgtgaaacaaacaataattataacagacttttcatttatttcaatccgtcttatctgcttttaaaaaagcaaaagcttaaacaatgtaaacgtttgctaaaaatcgtgggatatggtataaagtaagtgtaaggggtcataagaattcccagtaaagcagacgaagtaggatctgcaagaacagaattgttgtgaaacttaaataaataaaaaaggatgtgggaatttgagcaacctcttactagagaacggtctagcaagcagctgaagatctaagtggacatgccgaaccttggaacttctccttacgtaagtaatggatcatgcgcttgctaggcttttttgtgtttttcggtcttcggacctttttcattttcctagacttctgctataataaccaagaattaattttgtaacagatttttttgaaaaaacaagtttctttcattcaaaaaatagaaaaagcttgctaattattggttaaccagcaaacaggagtattaaaatatcttgttttattgaatagcaggaggaaatcatgaaattccattatcatatattgatcaatccatcggcaggcagcggaaatggctataaagtagcagaaagaattttaccggtattaaaaaataagcatattgactatacacttcattatagtgaatacaaaggacacgatgctgagattgctgaaactttggcaaaagaaacattgattccttggatagaagaagaacagaaaacaatcgatactttcccccttttgatcatcgtaggaggtgacggcaccttacatcaggtacttgatactttctatcagatggaagtagaattcccagttgcttatattccagcaggttctggaaatgattttgctcgaggggcaggccttccaaaaaatcccaaaaaaggacttcagctgattttagcagctcaatcaccagaaaaagtccacataatggcttatgaagaaaaaataagtgaaaaaaaaggaatagctgttaataatttcggtataggattagatgcagctatcgtccatgcgacaaatcattcttccacaaaaaagcgattgaacaaatacaacttaggatcattttcgtatttattctctattctccgtgctttattcactcaaaaaggatttccaattctggtagatgcaggaggaaaacaattaagtttttcaaacgcatttttatgtacagcaacgaagcatcctttttttggcggaggaatcgcgattgttccaactgctgatgcgtctaaaccagtcattgattttgtcgtggtcgaacgaatcaatttctttaaaatcttgtggctcattcttttacttatacagaaaaaacaattgaaatcgaaatatttccatcactacacaacaaacagattacgtatcgtttcaacaacaccgcaacatggtcaagaagatggagaagaaatggaaaaacgaccttttgatatcacaataaccacaactaaacagttgttttggtgttaataaaagaggttttgtcagaagctacatctggaacaccgtttattcggaaaaaaggactgtgacacgacttttgtcacagtcctttttttactatgcagttaattctttgcccaattgggttgccatcgatagtttctttctttacccaaaataaattggatcattgaaaacaccgcagcaaaagcaactaagacacaaccattgaaccaaaaagattctgcaaatgtttgattgtaactgagtgtttcactgatcaagttattattttgaacaaaccaatatgttggtgtgaatgccgctattttgctaaccatttctggcaagtattctgctggtacaaacaccccaccgataaagcaactgcctgtgataaaaatatctttgatcccaccgctggtttctgagttttttaccaatgaagtgatacaagccgaaaagctaatgatcggcaataaaaacaagaaagtatttaaaatatgataccataccgttatatcccacgaggtgtggatcactaacagaaccattagaagtaagaagccactgaacaacagcagcgagtaactaatcaaactaaaggttactttgcgattcaagtttcgtttggtaatgggcgcactctggtttcgtttactgatctctttgcgattaaacgctagattgatgacgctgaaaccgctaaaaatggatagaaacaacccataagacaagaaattaaaggttgtgcccgtcaacagctttttcatccgctgactatatcccgcacttagctcaacttctccagtaaccgagagtgccatttgtgtctgttccatagctgcatcgattgttttatcttcttcttgaaacagaatcagtgtttgcaaaaaggtgttcacttgctgtgtaacaactgttttagaaaaggcatctgggcgactctgtatcttgatcgtcgccatctttcctacttcgacttgttcggtaaagtctgcaggcagatgtaagataatgtttacacgattaaaataaagagcatcatcgatttctttttgtgaggttccatccaatgtaacgactgtttccttgtcattcaaatatttacgaaggccatcgactacaggcgactcttcttcactaatcaaggcgattttcgcatcttgcagagaggtattttcaacatcaatattttgcgcaaaaaagaatgtggcaacaacagtgataattacacctatcagtaaattcgatttatttgctttaagcaatgtccaaatcgttttataaagcgtcataacgcacccctctttccatccaagcatttcctaacgcaaaaaggaaaataaatccgatcaaccatagaagattggtataaaaactagccaaatcagtgtagaaataaagtttatacaaactttcgctgatcaagttgacgagatttaattgaccaacaatcggaatatgaagatcaatccaatacttcacttgttccgaccccatcataccagcaaaaaagctcatcgcaatcgtcactgaaatcaagatgctatccttttgcaccagattcatttttggtatcaaattaccaaccaatgtacctaacaaaatcgcacacaacgaccccagagcggtaacaatcatcaaccattgccaacgttcaccaaagtctacttgatagataaaacgaaagacagctaacataatataaatctctgtcaaaacaatcgtaaagcttgctgccaaattagcgattgaaactaacgattgctttctaggaatcaaggacaagcgaataccatttgacgattgatttgcttgctgatcctgtacattgcggaccccccacatcgtcccgtagagaatcgccattccaatcagagtgaagaaataaaaacttttgaaactcatattacgacctgcatgaacttcttgaaaagatacttcttgttcaaaaacagtcatgatgggcgcgagatcaacgttctccacttctgccactttactcgaaattataccaatacgctgtaaaaattgatccatgacgtttttcatcaacgtctgactcattcctgcttgacccacatggagcgaaacagatgaaccatcaatgagataaaaaccagccaaatcatctgcatttagcttttcattcgcttctacttccgatagttcctgtacttcaaataatggtttatcattgacttcgacttgttctaagactgtggtaaaattttccgaaagcgctgtttgatccgctttgattacaattccagtattaatcgtttcaagattgccaccttgatcaatctcgccaaaggccgccataaacatcaatcctaaaagaattggaaaggccaatgtccaaaacaacatggatttatttcgcagcagtatttttgtgcgatatttataaaaatgccaaaacattatttcccctcctctagtctctcaaatccttgccagtaatctctaaaaagacatcattcaaggacgcttctttggttgctatttttccgtaactgatcttttcttcttgtaagattgtaagaatcggcaacaatactgtatttagttcagtagttgttacttggagctgaccttttttataagcgattccatcagaagctattgttcgctgaatcgctgacaacacattttctgggagtaatgggatgtcgatcgtcaaacgatccgccgtccgtaccatatcttttagagattctttggttcctttagcaatcacctgtccttgatccatgatcacgatctggtcgcaaagaatttctacttcttccatgtaatgtgttgtatagacaatggttgctccttgtcgattcagctccttgatactttctaaaattttattccgactttgggggtctacagctactgtcggctcatctaaaaaaattaaccgcggcttgtgggcaatcccacatgcgatgttcaaccgacgtttcaagccaccactaagttctcctggacgaaacgaaacatatttttctaatcccactaattgaatcacctcttcaatcaaggctttccttttctctttttcggaaacatataaaccgcaaaaataatcgatattttcttgcacacttagttcgtcaaagaccgcaacgtcttgaggaacgaccccaatcattgccttgacagcataattttcaggagtcattgttgtcccgaacaatttaatggttcctttgtcataatttaacaaagaaagcatacagttgatggcagtcgatttcccactgccgtttggacctaacagacctaagacttctccttcttgtacttgcagatcaaaatgattcaatgctacaaaatctccatagcgtttgactaatttatcaatttcgataatcatcatgaaaaactccttccaaatttcttgttgatctgactataataaagtgcaagaaaagaaactagtgacgattggctaaaccacacatgacatttgtcacaatgaaggagtctgctatgcataaatctcggctactcaacgaaactagctttctactggttatctcattgcttttgctggtaagtcaaggattcgttgctatgcaagttatctatttattgatcgccgttttattcactggtgtcagttatttactgcctacaaagccaaattggattttccaagttattctatttcttttatgtgcctttttacctgatcttgtcctgtttctgccagcgacgatgcgagtgatcgcccctgaagaaagccaccttgattacttgtttttgttaggttttttgttgatttcgacggttggtaatcatccccccatcaaggtcgcctttgtcgtaattttgctgtttttttccttttacttacgaaaaaaagatcaacgaacgaccgatcttgagaaaaagtacattgtctccaaagatactcattgggaaaaacaacaagagttatcggaacaaaataaagcattggccctgtcacaagaaacacaattagccttgcaaattgtggaagaacggaaccgaattgcccgagacatccatgacaatgtcggtcatctgctgtcaagtgcgattttacaaattggtgcgcttgaaatgatcaatcaagaaccaaaactaaaagaaccattagaaaatttaagtgccaccgttcacactgggatggatcggattcgtcaaagtgtccatgacctccatgagacatcgatctcttttcaacactccttagagtttctgatcgctgattttccttcttctgttacgattgaaggaaacttgtttgaaggattgaatgaaacgcagcaaaactgcttcttaatggtcatcaaagaagccttaaccaacagtatcaaacatagtcatgccaaaaccgttgttttacattttcgaacgttgccggccttttatcgcttgcaaatcacgaatgatggcaccagcccacaaaaaaattctgctcccggtattggtttgaaaacgatgcgtcaacgtgttcaagaacaaaagggacaagtccatattttccaagaaaaccagcaatttcagttaacgatcattttaccaagggagggacaccaatgataacagtagtcattattgatgatgatccatttgtgacgaaatcgttacaaaccattttagaaagcacgaaagagatccgtgtgttaggcattggtcattgtgccaaggatgcgctagtcttatacgaaacccatcgtcccgatgttttgctgacggacatccgcatgcctaaacaaacgggcatcgatgctgccaaagaaattttggctaaatttcccaaagccatccttttgcttttgacgacattcaaagatgaagaatacatccgcgaagcattttccatcggtgtcaaagggtatttaatcaaacagaacttgcaagcgattattccttctgtcaaatccgcttataatggacaggccgtatttggtaatgaaatcatcgagactttcactcaaatgatgaagaataaaccgacgattgatagtcatgcttatgcttcttttagtgaacgtgagcttgcaatcatcaaagaagtagctgccgggaaaaacaataaagaaattgcagatgccttgtacttgagtgacggcactgttcgcaattacatcagccaattactagaaaagctagatttacgggatcgcacgcaattggctatctatttttatcagcatttgcaataagtcttatctaacacaaaaaaacctgaatgatgctccttcgcatcattcaggtttttttcacatcttctattcaattgtcccgcaaaccatttcctcacgattgaaagaatcaaggattcgcagggctgccaggattcgttggattgttcggcgtgttaggcggaaaaataggcgccttgtctaacgttttttctagttttgattcttcacgatcgtctcgttctacatcaggactttcattcaatttgaattctttttccatctcatctaactttttaaagtcattgccagattcttttgctaatttcgctaatttatcttcggtttctttagccataaagtaacgccccccttttgatttcagcttagcatatcacactgaaaaaacaaaagaaaacgctaaccaacgatcatttttagctatttctcatctttaaaatcaagcattttttgccggtataaaatcgtagggagaactgttttccataccaatcatcggatctactaactggttatcgatcacttctgctgtaagaacgaaatctttagaaacagcaggttctacctcttctttcttttcttctccaacaaatgaagaaaacagatctggttccactgtttccattacttggtttttcgtttcattcgtcccactgtcatcttctacaggtagcttttcttttacaacccgtggctcttttgtatagttcccatcttcaaatggatcatttccgaccaaagaatcttcataagctgctagtttggtccggagagtgatattcattttatcattatccatgatccttgatttcaacgtagtcatccggcttgctgattcattcgctacacaagtgacataggcttgctcttcccctaacaaaatcaacagttccttactgcgagtcactgccgtgtagagcaaattacgctgaagcatccgctgatattgatggaccatgggcaaaataaccatcttgaattcactgccttgtgatttatggattgagcaacaataagaaagagtgattttattccattcgtttcttttataagtgacctcatttgcatcaaactggataactaattcatccactttatcttcagaatcttttgccaagatgatacccgtgatttctcccatatctccattgaatacattcaattcgggagtattgactaattggaggactttgtctcctatccgataaacggtgtcgttccaatgtacttccttttttccaggtttccctggattgaatatctcctgcatcattttatttaacgcatcgatccctgcaggtccccgatacattggtgctaatacttggatatcttgtgcacggaatcccttatttttcgctttttccacaattttagagatcaagggttcaatttgataagcatcacttcggaaataggaacgatctttttgattctttgtgaaatcttttggcagacgtccttctttgatctcatgggcaagaggaataatactagaaccatcaccttgccgataaatctgattgagttccattttgggaatttgttcgatttccaaaagatcatggagtacttgaccaggaccgacagagggaagctgatctttgtctcctactaagataacttgcatattcgtcggaatcgctttgaataatgtgttagccagccatgtatcgaccatagacatctcatcaacaatcaaaagtccgccttctaattctttcgtactgactgaaggtgttttttcccgtccattcagccccagaagacgatggatcgtactggcaggcagacctgtcgtttcgttcattcgtttagctgctcggccagttggtgctgcaagtagaataggaaaaatttcttgggtatattttgaaggatccaattccagtccgttcaactctgcaaaaagattgacgattccgttgatcacagtagttttccccgtacctggtcctcctgttaaaataaatagaggggaacggattgcttcagcgatagcttgttcttgcgaaggtccatactgtatgccgaatattttttcgatacgccgaatattcttctgcacttctttttcaggataatggatttcttttttacgactgagaaggcgctggatcgaattaccgatcccccattcagaaaagtacaaactgttttcgtaaagattagtctcttcttgttgtatctttccttcttcaacaagttggataattacagtagcaacctgatcaggctggatttcaattgggcgacttgtttctaaaatacggatcgtttgctgaagcaatgtctccgccggtacgtatgtatctcctgtttgaactgcatgctgaaaaatctgatgcaagatagctgctcgaattcttctcggtgaatctgctgcaataccgatttgttcggctagattatctgcacgtttgaacccgattccttctatgtcttcgactagctggtacggattttcttcgatgatatccaaagactcgttcttataggcctggtagatactgaaagctaactgactaccgaacccgtaacgattcagtcccatgatcacttgatccatcccgtggtttagccgaatcgtctcagcaagcatttctctttttggcttcgtcaaaccggagatttgttttaataccgaaggatcagcaatgattttttcgatagcatcttctcccagcaattctacaattttttctgctgttttcttcccgattcctgggaatttttcgctggaaagatacgctacgatcccatttgcagttgttggcttttcttgctcatatctttcgagtttaagctgccttccgtatttaggatgatccactaattctccataaaaacgataagtctcattttcttgaatatcgccgaaacttccggtgactacaatctctttttcacggtaatcagctgtggtttcactgatgtgtaccaaaagcactttgtaaaaattactaggattttgaaaaaaaatcgcggcaactgtaccaacgaaataaggcatttcttctggctgcatcggaagccgcctccttcttctatagtaaaggttctggtgctgtttcagttcctaaaaaatctgtttggttccatactttcagttcatatggcaataatctgcaaggctcttcagtctctaaaatcgtcaaactactattgaacaatccacccatttcacgcaactcacttagctcttttcctgtcatccattgaatggctgcagttaaagaagctccatgtcctacgaataaaagtgggccatctttatgtcgggcaaccgcatctgctacaacagtttcgatacgtgtgattgccgattcaatcgtttctccgtgaaaaggagaaggatcatacagatctaaatgattacgcaaattcggcagattatccggatatttctggtacatttcatcgatcgactgaccttctaaagtacccagccctagttctcttagcttatctgtataaaaaatctctaccggacgagcaagctctttgttgataccttctgctgtatcacgtgctcgctttgctgtactggaataaattgctttaaaaggaacatattttacctttttcccaaatgctttgatttcttcgtaactttgtggcaaaagcggagaatcgccattgctcccttgaaaacgtctttcctgattccattgtgtcttcccatgtcgggtaaaatatagttccatacgcagcaaactcctgtctttcttttattttactctataataaactgtctaatccagcttgtcattttcatagtgatgcgtcaattctaaattagggaatccttgctggcgaagtgcttcatacactatcattgcagctgtattcgataaattcaatgagcggacatgctcatcattcatagggatgcgtaaacacttttcttcgttttcacgcataaatgtttctggcaaaccggttgtttcttttccaaataaaaagaagtgctcttctccatcagcaaaattttcgtcactatatactttatgggcaaattttgagatcaaatgtagtttacgattacctaaaaatgttaaaaaagcttctaaattactgtggtaagtaatatttacatcattccaataatccaaccctgcccgttttagatgtttgtcatcagttgaaaaacctagtggctcgattaaatgaagcggagtattcgtggctgcacacgtacgggcaatatttccagtgtttgcagggattaatggttcaaataaaacgatatgattcatcaggatcattcctctcatatttatgttcgtttctattttctgacaatttgatttttgcataaaaaaaacgtatcaactcggtgtcagtcactgcgagtcgttacgttagtgaagctcttctcactaacttttatcagaacaggaacctgataaaaaccaatgaaaaaacaacttgttgctaatataacaccctcaacttttttttgcaacctctactcattaaaaactgctagaaaaacgttttctcttagttccttttaataattctatgtcaattgtaatcttcttcaaaggattcttatataagtctgctttgattcgctcttctacctgccattctaaaggtgacatggccaaaagatctttttgattttcctctggtatctcaaattcataggttacacgctgacgttcagttaatttcattgcttcagcaaacttggctactacacgttcattggaataactctgtttttcaggttgattcggataaaaagcctgacgtagttcctttaaataattttcttgtggcaccaccttcaacacttctccatcttctgagagtacacgttggaattcttggtaatgagaaggcgaaaagatatttaaaaccgcgttgaatgtttgatcagcaaacggcaaattggtcaaatcagctacacaccaaaatgcttcggcagattgttctgtagctgcgtagactccttcttttgaaatatcaaatccaacagcattttgaatctttttcaattttgaaagttcattcaagaagctaccttctccgcagccaacatctaatagcgagacttcttcaggtaaatgctgcgcaatagtctcaataacgggctgatacatgccagattggatcattctacgccttggaacgaacattccttgatcgtattctgttttaaccgcatgggataaaaaataaagtgttccttttttggaaaggtcaaaacggtgattatttttgcatatcaagccattatcagacttttttacttcttcttggcaaaccggacagcggaacagctgatgattttctgccaaaaactggcgtcctcggtcaattttttttaacatagttccccctcatttctgttttatcttaccgttagatgctcactttggcaactgctaaaaatatgatacaatgcctagaagaaagtgaaagataaaggagaagattagatgatcaaagaattttgcgctgaaaactacacatctattcctctagcaattgctagaggagccgatcggatcgaattgtgtgacaacttagcggtcggtggcacaaccccgagtactggtgtgatcgaagaaacgttaagttatgctggggaaaaagatatccccgtaatgacgattattcgtcctagagggggcgacttcgtctataacgatatcgaattgaaaatcatgcatactgatttgattgaagcaaagaaattagggacggatggcgtagtatttggttgtcttactccttcaggctggctagacgaagaggccttagaactattgatcgaaacagcagaagggttgcagatcaccttccatatggcttttgacagtattcctgaagatcggcaattcgaagcaatcgattggctggtagaacatggtgttgaccgtatcttgactcatggcggtcctgctgacaaaactattgtagaaaatttcccacggcttaaagaattgattgcctatacagatggccgcttaatcattttgcctggtggtggtgtcactgcagagaatgcagcacatgtagctaaagaattgaacgtaagcgaagtacacggaaccaaaatcgtggatcttcagttataatcttataaacaaaaaaacatttgcaacaggcataatgcttattgcaaatgtttttgtttttttacataaaatagcccataaataaagaagcaatattgaaataaatcagtacactcgtcaaatcgctcaaagtcgtgataaagggaccgcttgctactgctggatcaaatcctagacgatccattagcatcgggattaaactacctgcaagattcgccactgtgattgcaaatagcatagccatccctatgacaaaccccaagataaaattatgtttccaaaaacctacgattagaaaaatcgtgatccccgtaacagctcctgtgacaacgccggtcaagacttcagccaaaacaagtcgaacaaatccatgatctttctcatcagaaatcgcaagtcgacgaacagccacagctagcgactgggttccagcattaccggcagttcctgtaatcagcgaaatgaagactgctaaaatactcgcttcacttaccaagtcttcatagtgactgattaaagaagcggtcgacatacctaaaaacaacagagtgatcagccaaggcaaacgtcgagacgctgcctttactggattttcattaatttcttccacattgaccccggcaagtcctgaataatcgctagcagcttcatcatcaataacgtcgatgatatcatcgactgtgacgattcctaacaaatgatcatcataatcggtaacaggaagagctaagaagtcataatctctaaatgtttgtgccacatcttcttggtcgtcgcctacatgaactgaaagcactcgttcgctcatcagatcagaaatcattgcgtcgtcatcattcacgattaggtcgcgcagagaaataacccctactagctgaccttcttgattaacgacatagatgtaatagattgtttcagctacatctgcttcgttcttcagcacgtacatcgcagagcgaacagtttgattggctacgatcgaaacaaattcagttgtcatgatcgcgccagccgtttcatcctcgtaatggagaagttccttgatttcactggcatcgtctgccgacatcaaacttaaatatttagcaatttgctttttatccagcgtattaagcaagtcaacagcattatctgtatacatctcagaaagcatatcagctgcatagctaggacgcatttcatctaggtattctttcatatgttcgttgtcttcttcaatcacatcgaacatatccgctaattctttaggcgacagataggaatagatcagctgcctgttctcttctgtaagagattggtagaattgcccctgctcatagatatgcatctctaaaaaactgtttctgaatgcctgaatattattttcccttaaatcttgagtcaactgggcaaatctttcctctaattcttgattttcatccaaaccaatctcacctcgccttattcttcaaaccgtctcacaactgcctccatgtctgcggctaaaggctgcttgaactccagcaactcttctgtaaatggatggtaaaaacgcagatcataacaatgaagggcttgtctttttattcccagatccattcgcccgccatacatatcatcaccgagcagggcacagccaattgcggaaaaatgaactcttatttgatgtgtccttcctgtatgcagctggatatcaactaacgcgatttctgttagtcgcttctctatccagtactcagtctgtgccgaacgtccttcatcagagaccattcgcttcaatagcgaagaataatctcgggcgatcggcaaatcgatatgtccatgtgccgataaatctgaaagccttccactgactaaggcctgatattttttcacaaacttcttttcacgaagttgcatatctaattttgcgtgcgcaaatccatgctttgcaaaaagcatcaagccagatgtatcccgatctagtcgcgtcaccacatggattacttggttttcgtaaccttgttttttataataagcctttacacgattagccattgtcccatttggatggtattgggcaggaatagacgaaacgcctgctggtttatttactaccagaacgtgttcatcttcatacacgatatcgatcggtgtttcatccaaaagtacggtttcatgttctccttcagcaggaatcacaatggttaccttatcatccttagctagagaaaacaagacattttctacttgatcattaactttgatttgaccgccttgaaattttattttcgctaacagaccctttgagatccctttttcttttaaaaaatattttacttgctgagaatgatctttctcataatcccatgtaaactgcatatcaatcctcactaataaaggcatctttcacacgatgccaaaaatgcatatgtcgataagaagcaaaatggatccgttcttctgctattcgataataaattgagcggatatttgcttttgcgacattcaattgatcaaccgttacaagataatcttctgtattttccaattttatttctagccattcatcatgggcaatcacgatcggagaacccaaagtacgaaacactcgattattcagtgaagcaatctctgccaactgaaaggcattgatactaggatggatcacagcaccgccgacacttttattatatgctgtcgaaccagtaggcgtagaaatcgtcaatccatctcctctaaaactttcaaacagctcgtttttgatgtatacatcggctaccatcgtacgattggcccgtttaatcgttgattcattcagtgctaaaaaatgctggtccggtgtttcatccaaataactgatccgaacatccagcaagggataactaacactttgttcccggttcgttcgtaagctgtctactagttcttccagctcgtaatcccgccaatccgtgtaaaaccctaaatgacctgtatgcacgcccaagaaacgcacatcattcagacaatgactgtagtgatggaacgccgacaataatgtgccgtctccgccgactgagatgaccaattctggctcatgatcatctcgttgaatccctgcttgttctaaaagtgcgttcaaacgttctgtcacttctatagtctttgcttctttattatgaacgatcgctactttcatcccctgcctcctctctttcgctttctttcttcaaaagcgttcgatagtagacatcatctgattttcctcttccatgggagaataaccgctgtgcttcttggatttcttcacggatactggacatctcttcatccaactgataggcagcttctgccgcacgctgaagtcgttcactcatttcttctggaaaaacgccttgatatttataattcagcgaatgctcaatcgttgcccagaaattcatcgcaagagtccgaatctggatttccgccaaaattttcttctcaccgctgatcagctgtacaggatactcgatcaccagatgataagaacggtagccacttgcttttttatttgtgatgtaatctcgttcttggagaactttcatgtcttttcttttacggatgatctcaacaacttgatggatatcttctacaaactgacacatgatccttaacccggcaatatcagacatttcttcttctaaacgtcccattggaatatgccgtaattgtgattttgttacaatactatcgactggcttgactctcccagtgacaaattcaatcgggacatgtcgattttgttcacggaactgtttgcggatcccccgcagtttcactttcaattctgatacagtttgttcatatggtgctaaaaatgcttcccaatctcgttccatagctgatacctctacttcattaacattcattgtttattctaccatatatgcaaagttttttcgtactcttgatttatgcattgaccaaaaaagaaaattaggcaaaatagacaaaaaggagtcgatcaaatgacacaaatgcttgaaatcgaatataaatctatgctgacaaagcaagagtacgagatattcatcgctcactatcaattaacagataaagatttccgtgtacagactaatatttatttcgataccgttgatgaacagctgaagaaacaaaattgtggcctacggatccgtttcgttggtcatcaagctgaatatacattaaaaacacctgctgaaaaagggcgtctcgaaacaacggatacctttataacagaagaagcagaagcatttatcttcgaaaaacgtctgcctcgttcaggcgcagtttttcaaaaactttctgatttgaatatcgatcctgcttcattaatccaaaccggaaagcttacaacaaaacgagctgaattccctattgaagaaggacttttagctattgatgaaagctggggagacaatctacacgattttgaactggaactagaggtaggggatgcatctgtgggaaaaattgcttttataaattttttaaaacgtttttctttaccttatcgtcctgctaagaacaagatccaacgtatgcttgaagctaaaaattagaaacctttcattttcacaaggcacttgagttcatttttttacttttttctgttaagttataggatgtgaaagaatctagtcactagttgtatagaatctattttgggggagattcatatgatcgaaatctatttatttgttaatcctttaggggaatactgtttcgaaatggaacaacagttattacaatttatcgaagaagagtacgggacaccatcaaaagaaaagatgcaatttcgctttcttcctttggtcaatttgcagacaattggggatgtcatgcaacaaaaaggaatttctcagaacaatcttgaggaacgtaatcacttattctcaatgacttattctgcagcattggactgcaaagcggcgcagtttcaaggaaagaaaaaaggccgccgttttttgatcaaattgcaagaagcagtcggctgtaatgacataccatattctcaagaacttgctgaatccatatttgaagaaatcggcggcgatttgaatatgtttaaagaagatcgtcagtctgacttcgttaaagaagtattcttttctgatcaaaaaattgctcgggaaatgggcatcacaaaacacccttctgcagtcgtttacaattatgcctgcgaccgtgattttggtgttttagtagaagtaaaaggtacaagtagcctttggagaatcacagagctgtgtaaaacaacagataactcatatcaagtttttaatggtgaacatttacatacaaatgattctcagttccattcaagaactagccatttacacttgctttctaattaaaaaaggctctttgtcaaatgatgttggtaaagagaaatcttagaataatttggacagaacagaaagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcaaatagtgactgatctcttttctttaccgcataaagaatgtcttggtataactgatagccttggcgtaagttgggacaagcagctaacagtcgatcggcaatctcactttcagtcaaataatctttaaaactggcacgccaaacccgtttttcatagtttaactttgcttcttctttttgtaggagtttccaatagcgcttcaattttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaatgaaaaccgagaaaaatagcgttctaaataaggcaagcgtcgattttcgacaatatccaataatgcatggctttgtccgtccatcatgataaaactcattgcactggcaacacttcgaaccgatttgaattcatcaaagcataagacctttggcaaagtctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatatttttttatacaaaaaagatgttggtgaagttcaccaacatcaaaaagtatagagccttaaaaaaatacgtcgactcccttacaagagagccgacgtatttttttcgtttctattcgagaaaatcaaaaatagaaagccttataaacgatcgatcaattcttctaattcatttagacgttgttcaaacatcgacattgcatcttcaatatatgcagcctgtgtcatatcaactcctgcttttttcattacttccacaggataatcgctgttacctgcttttaggtaagccaagtagttctctagtgcctctggttcctggtttagtattttcttcgccagtgctgaagcagcagaaaagccagtcgagtattggaaaacatagtaattataataaaaatgcggtatccgtgaccattcgaatttaatttctgggtcttcttcgactgctggaccataatattttgcattcaatttaccataactatcacttaggtattcactagtcaatggcacacctttttcatcttccgtatgcatgaaatgctcgaattcagcgaattgtgtctggcggaaaactgttcctttaaacccatccaagtaatggttgagtacataagcccgtacacgagggtctttttctgtttccaataaatactccgttaggatattttcattcgttgtcgaagcaatttctgctaaaaagatggagtagtcgccgtacacataaggctggttcgaacgagtgaaataactatgaacactatgtcccatttcgtggacaagcgtaaatagctgatccagcgtatcatgccaattcaataaaatatatggatttgtgtcatagcttcccgaagaataagcaccgcttcgtttccctttattttcgacaacatcgatccaacgttcagagaatgctttttctacgatggccatgtattcttcacccattggtttcagtgcttctaaagctttttcttttgcttcttcgtacgtaaaggtaattggagcttcccctaagaccggtgtataaagatcatacatgtgcagtttttccacttctaataaacgtttccgtaattccatgtatcgatgtaacaaaggcaaatgcttgtttaccacgtctaccaaagtatcgtatacactttcaggaatatgattattgctcaaagacgcttctctggcagagctgtaattacggactttcgctttaaaattatgtccttttatatgtgtgcctaaagtagaagcaaatgtatttctaaattgttcgtaaacactgtacaaccccttaaatgctgcttcgcgcacccttcgatccgtgctttctagcaactgaccatacacgccatgagataattggactatttcaccattttctccttcaatcgttggaaaaactagatctgcattattcaaaacagcaaatgtatcacttgaagcatcaaagatttcacctgctccagcaagaagagattcctgctcagcagataagacatgggctcgattatctactatttgctggatataatggcgatagacttccaattttggttcttctttgaaatattgccaaatctggtcatctgacaattgcaatatttctggttcaaaccaggaaacggcttcactaactttcgaaaacagactgcttgctcttgcataaagcgcttggtaatctgtatttccagtgtcttgatcgtttttaaggtgcgcatatacataaatgacttcagtttggcgataaaccctcaatacgaattcaatcgcatttaaaaattgagaagcgccttgatcaagtgttcctttgtgtttttcagattgttttaactcttctgataattccaaatatttctcatcaaactcttggtcgcttgaaaagatcttggtcaagtcccaagttaaattttcaggcaattcttctcgttttggcaactgctttacttccatgaaatccactccttttcttcccttagctctatctatcaaaatagatcatagtctaacatccacatgtcacagcatctaacttttctactcattcatgtgtctgcttccatcaattttagcataactaaatcttgttttacatagaaaaccgattcctagcctatttttatacttactattttttcaaagaagacaagtgtatgcattcgttaaaaaactgctgatagaccatctcttcatcaatcataggaaaaagccattcccttttatgttcttttatttggcaaagccatgagttgaaatcaggaactttctggttttccaaggcttcttcgtacaacattcgataaagaaaaacctgttcttgtaaataaaagaaaaaccgacttttttgatagatccacgatgatagatgcaaaagatgtttatgacgcaagtagcattgttcttgtatggatactgtattcttttgcttgtgaataagttggcgtgtcagccatttcttcccatcttcactcactttttctatttttttcatttggttcattttaatttcgttactagtgaatatttctttaaggtccctactagaaaaagtccagcagctactgcaaaaggaaatatgccctgatacagtctctgtaatatgatgatacaaataaagcttttgtttcttgagatcagctttccagcaatgcactcctctttttctattatagtagcagcaacttttttctatcaatgagaattgcgattgtccaagaaaagaattaccaagtatccaccatacttggtaactgttattcaaataattttgggttctttcaataaatctctggtgagacagtctagaacattggatttctattgctagattcgccaacaaaatatccggcctttgccgcaacctcggcaaataggcttccaaaaatactggttctactgactgtcccagccaatccatgaagcattcctttaactgtaagtgctcttttgattctctttcactaaagaccgaacagttatctgatttttgatgggcaaaatgagcacattttttctttccctttttcaaaatcactctttttcgacagccacgacaataatatttctttcctttttctgcatgtttagcaaaacagcacttattatattcattcattgcaagcagcatttttctccctctgaacttatttacgtctaagaatttatttacacgaaaaaagagggcgtgaaaaagctattctgcatcaagtaataagaacagctaaacaaaaatagttcccaatatttttcgtttggttgggcttgttaccgcagatgcaagcttttgaacacatttatacgaaaaaaagactgcgacacaatttttgtcacagtctcttactataatgctgatttatacaaaataaaatttcgttcgctcgatagcattacgcgccatcagacattgtccatattcattcaatgtttctggtgtacgatcgctcttttcagcaaactccaaaattcgagcaatctgattctctacatccgcttggttgagattttccatccagaagtgaacgactaggtaatagcgctcttcgaataaatacaaatcagtccaagcagactctagttcgacatctgttgcaagttggatcacttgttcaaaatcttcaaaagcaaaagttgcttgtctttcctgttcttctagggcgcttccagataattcttcctccggatcgctgccaataatctgctgacgaagaaagtcactcacatcttctgaatcaacagtagaatcttctgattgagaaatttcttcatccggaagatttttactgataaacagttctaatccgtctccttttggcaaaacttggaaagtgacagcttcgcttcctcggaactcctcttcgatatcaacttcttccaaaatactataaaagaaattttcgatttctttgtgattgccaagtaaatccaaaaatgaaacgccccgttcctctaaatcttcatgaccaattagtacacggatcgtattttcattaatatgttccatttccattttgctacacctcactttgccacaatgtttaatatagattcattgtagcgaaatcagcttaaatgtaaagaaaaaaaatctcgctgttaagcgaatttaataaaaccagcggatttttcaacctttcaagctatcttatttaactataacatttttggcagacgaatactatatagccgacttttcagctaattttccctctctatttttcgtgcaatcatcatcttctactacctttttatacatctaatcaagaatactttttgtaaaaacaaaaaaacttggaaaaactatctttgtaatagtcttttccaagtttcgtattatccttctataatccagccatcaattgtgcttgacgtaattctaattgtcgtacatcgcgcggtaggaaccgacgaatttcatcttcattaaaaccaacttgcagacgtttatcatcaatcatgattggacggcgaagcaatccaggattgttttgcacaagttccaataattcttgtaacggcagatcatctaaatccatgttcagtttttggaatactttggaacgtgtcgagatgatttcttctgttccgtcttctgtcatttgtaaaatcgcttttaattcagaactgttcaatggttctgaaaaaatattacgttcaacaaatggaatctgatgttcttgcaaccacgcacgagcctttctgcaggaagtacaacttggggaagtatataatgttaacaacgtgcaccactccttttcgtgataagaatcacttttttgtaacagaagatcataataatctcccatctgtttctattatacataatcaacttttaaatagctacctttttttcataatttttttaaaaaaatgaaagttatctaaggttaatatacagtaaaaccagcattctcgctttttttatcatttaaaaattagagttttcaaatctaattcaaattttctaaacatatgaaacagcgtataaaactgtactattattttatctcaaaagctaaatgaaaccgatttcttaagattttttatgttttttatttctttaatagtaatgttttctgtcattttaaataatactgttctttattataacgcttattttctctgttatataagcgtagtattttaaagcaatgattactaaataaaatttactataaacaaataaatcaaataacgttattttatgtttgaatagttatattgagactgtattaaaaaaataaatctttcgaaaattccacagagattgcattaaaataaatcaatcgacttctaccataatgattaatttgttcatcaaacttattgacgtgtttcacgatttttagtgaaaaaaactgaaatataaaaaccttattctgtcaaggaaatagaaatatagtaagaaaaacctttatttatcagcttttttagacaattttttctgttacaatagtcaaggatttgtgaaaaaatcaatgaaaaccgaaaggcgtgtaaaattttgattaaatcagttgtgtttgatgttgatgatacgatgtatgatcagcagcagccatttcgaaacgcggtcaaaagagtcgttccgcttgtttcagatgcagatatgcatccactatatatccggttccgccatcatagtgatgaaaacttcccaaaagtaatggcaggagattggacactagaatatatgcgagcacatcggatcagccaatcactaaaagatttagactaccctcatattacggaagaagatggcctcttatttcaaaaaatttacgaggaagaacttgataatatctgcttgcatgaggaggtcaaaaaaaccctcgatttcttgaaggaaaagaatgtcccattaggaattatcacaaatgggccgactgaccatcagacaaaaaaactgaagcaacttcaattgaacaattggattccttcccgcaatatgctcatttctcaagcaacaggtttccaaaaaccagaaaaagagatttttcagctagctgagaaagaatttcatatgcttccagaagagaccttatacgttggcgataattacgacaatgatgttctaggtgcaaaaagtgctaactggcaagcgctttggttcaaccatcgagaacgcaaaattgaacagactccaatttgcgatatcgagatttcttcttttgatcagctgttagagacaatgaagacaatctttgtataacctttaaaaatagaaataaaaaaatgatagcaaggaagctgggataaaatggaatcccagcctccttgctattttttaaatcaaataaacaatcgcttctttagaaaggctttcttacccattactgaacgctttttcgagtctcttactcctcgatttctcctacacttaaaatcatgcggatgtcttcttcagtcagtttcgtcaactgttcttcattaccttggatcactttttggaacagttcgcgtttttcttgctggagtgaatccatgcgttcctcaatcgttccttcagagatcatacgccacacttctaccacatttttttgtccgatccgatgtgcacgtccagcagcttgttcttcaatggcaggattccaccaaaggtcatacaagatgaccgtatctgctcccgtgagattcaatccagttcccccagcctttaaggaaatcagaaaaacatctttttcgccagcattaaatgcgtctaccatacttaaccgatcttgtggtttcgtactgcctcttaaataaaatgtcgagatccctagctcggctaactcttcttgcaagatagtcagcatccctgtaaattgagaaaacagcaaaactcttcgtttgttctctttggcagctaccagtagatcttttacttgttcgagcttgccggaaccgccttggtaatcttcaataaacagacgaggatcgcagcaaatttgtcgcagtcttgtcagaccagcaagtatcccgatccggtttttcttgaatgcttcagaatccattgatgtgatttcttcacgcatttgacgcaagtaagctaaataaacagttttttgttcttctgtaagtgcagaatatagattcatctctgttttttccggcaagtctttcaacacagtttgtttatctcgccgtaaaataaacggtcgaatcatttgcgcaatttcttctgcggcaagttccctgaattttgttttagtcgggaaaaatcctggcataatcgttgcaaacaatgaccacaattcttctaaattattctcgattggtgtcccactcagtgcaaaccgctgaggtacagctaattctctcaatgcttgtgcagttttcgtactgctatttttgaccatttgtgcctcatcaagaatcaaataatcaattttttgcgactgataattagctagatcctgtcttaagctggcataagaagtcactcggatatctgtgtctttagccagtaattcttcacgttcttttttattcccattgattacttggatacttaaagaaggggcgaattttctcacctctgcctgccagttgtaaattaagctcgcaggcgctacgatcaaagcagagaagcttttccgttcttctttttccgaaagtaaaaaggcaattgtctgtagtgttttcccaagtcccatttcatcggctaaaataccgccaaactgataatgacctaacatcttcaaccatcgaaaaccttgcttttgataatctctcatcgttgcattcaatcctttgggaagctgtgcctggtatctttctggatgaatgagatcttgtaccatcgtttggaacgattcactaaaagtagcattgcttttttccaattgattttgaatgatcaatccttgatttttaggtacatggatcgttccttcttctgtacgtatcgattcccgtaattgttgcaacacttggcttgtttgttgaaattcttctgaatcaaaagaaagaacctgaccattttctaatgtataaaaagcatcatttctcagcaagctttgcaggacatgatcgatttcttgctcctctatccctgtcacatcgaatcgaatatcgagccatgaaccggtctcggttacttcgattttcggttgatgtttatgcgcatctaaatacaactctcgcaattttcttccaagtctgacttcaccaaactgacggaagacagatagttctgtgcggaaaaaggcatatagttcttccccgcttggcaatggacgttcataaccagtttcatttttctggtagcgatacattctgaatagatcaagtactcgtttctcttctactgtgtcacgtaacacctgaaaagcctgttctgtcgagacctcatgcttcgggtcagtcgaatagatgacttcgccatagacgaaatcgactcgagcttggatttttccttttgcttttcggaaaaagaaaataaattcgacggggatatctgctacttcctcttctactgcaggggcaatagctacgtcgccgatctctgacagcagagggataatctctttaaacaaagacggtaattcttttttcttgaacactacttctggtttctccaatcggcgaatcaattgtttccaagtttgataaaccgtttgttgatatttcgtcagagaataaaatgtcccttggataactccccactgataatgcataaagaaaaaatcaaaatcattcaatgcttgcagcaaataatcttctccaaatttttccactttgaatgataaaggtttgttttgatcggaaaattgtattccttgatcgttttgttcatttatctgcagatgcaaacgtgtagtctgattcatctgctctaacaggaagcgggcttgttctactgggagaagcagatatcttttatctagttttcctttgacttgtaagccgttcgtacctaataattgatgcgtctgagcacttcctgcaagatgcgtgagtattttttgatcttctttttgaaacgcccgtttatctagacgaaactggtactgtttattaacagtgtaagtttctttttctgtgtaagcttgtaaaaaatcatagatgttttttacgatatatgtttttttcggtgatgccaatgaaccgatacgcaagtaaagtgccaaaatagaaagctctgggtgatactgattagtctcaatcgtttctacttggtattcaataatcaaaggttgcaccgcttgaggattgttttgtgtttttagacgagaaaaaccttttgcaatgatttctccctcacttgttgcttttaccggttctagcattggctggtcttttttcatgatacgagatagatttttcgaccgtaaataaagttccacagcaactgtatgcttacaatatttatgttcctcccaatagggacattggcagtaatctatctcttttgctgtaccatccaaatcaaccatatacaattcactgcccaagacttctgcatgccacacgttttcttcttggtcagggacaaccgataacactcggccttcttgcaagtattgacgtccacgtgcaatgactttttctggaatactccatttcatagttaccaatctccctttttatccaagttgatagcgtattttgctttgtccgctaccttctgtatcaattcttatttgttgtaatactcgttctttcaattctcttacatgactaatgatgccgatcattcttccttcactttcgatcgtttctaaagcttccattgccatttccaaagcttcttcatctaatgacccaaatccttcatcaataaacaatgcatcgattgctacaccaccagcttgtgtctggatcacatcggcaagagctaatgctaaagaaagtgctgcaataaaactctcaccgccagacagggtatgcgcacttcgagacatacctgcctgatcatcatagatattgatttctaatccggttttccctcgataactgccaatggtatccgctagctcaaattgataacgatttttcgttaaacgttggagatgatcatttgctacttgtaacacttcttgaagataaacctgaagcacataccgttccaaactagtcttcttaggattttctccgttgaatgtttgcgaaagctgctgtaattgcgtaagctcatctaatttcgtctggcttgtgtgataaatcgaaagacattcatcgtagattttttgattactaattttttgttcttgtaaaccgtatatcttttcttgctttatttcgatcatacgtcttatttcttctaactgttggctgatctcttctgtatctgggaatgtctcagttagctggatattttctaattgacgcagccggtcagctgtcactaattgctcttcatgataagaagtaactgtacgttggttttctttatattgtgcttgctgttgtgcaaatgcacagatttcttcaattgttgaaaaatacgactggctttctaactttttagctattctttcttgttccttttctattttttcatctattttttctatttgttcatgttgaagatcaagctgtgtccgaagcgtatgaagatcttgcaacaattgcactcctgctttctgctcaacagctagttgattcgagtcttcttctaactgtttttcaagtcgtcgtatctcctcttctaaacagttactatccgtatcttgcaattgttgttctaaacttttgatttctccttgcagttgctggagctgattatttttttctgtctgctgctgtttgtagacagctaattgttgttcgagcttttctgcttgttgtcttatttcttccagctctattcttgcattggccatcttgctttttcgtctatctaaagattgttcgattactacaagagttgtttttgttttttgttctgttatctcaggaaatgcctttttcaaagcctgttgcaagtgttcttcttgttcagccaattgtatattcgttgccatgattttttgttctaaatctgataattgttgttgaagattattttcatgtgcttcacttttggcaatgatttgctgagttctttctacagcagactcagcttctgccagttgttgttctacttttaagatatcttccttatttggctgttcgtgttttaattgttgtatggggtgttccgttgatccacaaacaagacatggctcccctggacgcaaaaaaagctgaagacgagcaatttgctgctttgcccattggcttttcagctgttctgcttgttctgtctgttctttcaatagctgactattttttgttatttcttcagttgcttttttgagttcttctcttatctgtgcgagcgacccagtgtcttttgctttttgtttttctatttcttgctgcttttcatctagatattttaactgtccaaaagcaagacgatcttcttgcagtttttcctgatccagtaaattttcttgaagaattcgagttctttcctgatagatagcgagattttgatacagcttctcggcattcaattcttctttatccaatgaaattgttaattgttctgcgtcttgttttttactacgtaaggattcgacaattggcaccatcatctgtttgttttgcagtttttgagcagcttctttgatttttgtttgtcggcgtacgcggtttgcttcatttttttgccactcttcataattctgcgtagtcatcgctagtttctttgtttgctcactacttttttgtgacagttctattttttcaacttttatttcttgtaggcgctggattggttcgactaatcgttgcgtaaattcataatacccaatccatcgtttcttttcctctatttcgtctttttgagcagctaattccttttgcttgtttattaatatcgttttttcttcataactttttttcaagctttcaaaacgatagtaggaattttctagttgcttttgtttttcctgaagttccgttagagcttctttttcttccgtgatttgtttttcgagtattgcctgatggtttgtccattgggctaaaacggcttcaaaccctgctgctggttcctcttctttgactaaaacaaaccttttttgcagaagatgcagctcttgctctaaatgatccaatttttgttgctgttgttttgctttttcttttaatcgctcattgaactgttggaaaaattgagtaccgaataaatgacgtaaaacagtctctttatcactgcttgatgaaaccaaaaaattacggaattctccttggggtagtaaaacgatttgagaaaactgtttcgcatcgagattcatcagttctctgatcaactgatctgcttctgtacgttttgtgatttgttttatttcttttcctttcccatcaaaaatggtcaacgttactttggctgcctgtttttttgttccgtttccttttcgttttgctaaaacttgttctggttttcgttcgatttcatagctcatctgctgatgttcaaaagaaaaagtcacgcttgtttcttcgtctggtgtagcaaacaaagaacgcatctcttttccagagcgaagtcttccggaagtttcaccaaaaagtgcgaaggtgatcccatcaaaaatcgtcgttttgccagctcctgtcttcccgctgatcaaaaaaagcggtgcttctgtcaaacgtgaaaaatctacggtctcattgataaaaggaccaaaatttttaagttgtaattttttcggtttcattcttgatcattccatttccatgatttcttgcaacgtttctccgagccatttttcttggtttgcagttagctgctcttccgtcatttcactaaaaaatgcttctgctaatttttgaggatctttcatttctagtacttttcgtttgcgctttgtttgttctgctcgaccgtttgcccgttcaatccccaaaatacgaggatatatttgccgaagctggttcatcatattcgggatgatcgttctatcagtgagatagatatagatgtaattctcccgattgacggactgataaaaggcaggatccagcaattctttgaaactcgctgttatttcttcaatatcatgcaggggttcgatctccctaaaattcaactccaggcctgttgtcaggtcaacgatccatacgccttttttttggttgatctcagataaagagaatttcaatggggaaccgctatagcgagcattatcctgtctcaaagcagcttgattatgcaaatgtcctagtgctacataatcaaacggtgtaagtagttcaccagggatcgaatccaacccgcctacttcgattttcgtttccgaatcagattttacacttcccattacaaaaaaatggctaatcaatacttgttttttttctgaatcaaatagctcctgcattttatctatcaccttggctaccgcttgcttgatcgttcggatattgtcatcttcaaaatataatctcgctgcaattggttcaaagtaaggaagaaagaaaaattgtacgtttttaaactcgactggttcaaatgcttctgctagctgtgttcgcaaaaaatagttcgaataactgaaccatggcgtacccgctgaaagtctcgtactgctatcgtgatttcctgatatagcaaaaatcgggatcttttcctttaaattccaatcgaccatcaattcattgtataattctacggcatcaacagctgggacactcctatcatataagtctccggcaatcacgattgcctctactttttcttctttcgcgatatctagtatagaagatagtacatgacgctggtcttcaatcaagtcataaccttgtagtttttttccgatatgccaatcggctgtatgtaaaaaacgcattcaatcacctcaaaaaatgtccttctaattattataacactttgatccattacatgacacctgtcttctattttacatattggaacgcaaaaagagggcagacttgacgtctctccctcgttttcattgaaaaagtctgaactgaacaggacagtagattcaaaagaccgcccacgcataaacttatcattttatttttttttgacttcatatttgaaatcagggttcacttctttgtccaatttgtcaaaagctgcttgtgttcgtcgttcgatctccgccataccttctttatccgttttcttgatatctgataagtcgattggttcgccgaaacgcactgtcactctctgacgcttgaacagatccccaagtgtcaacggaccttgatatacagctggcacgattttcgctttagacattctggaaatcaatgccattccgcctttaagttctgtagcatgtcttgtcccactgggaaacatgatcaaactcaaatttgtcgatttcaaaatctttacaggtgttttaatgacgcttggtcctggattttctcttttaactggaaaagcattggatcgagttaatataaatcgcagaactggatttttgaacagttcttcttttgccataaagctgaattccttgggtgctgcagctaccgccagatataatgggtcccaccaagtacgatggggagcaactagtatgtaattctcatcttgcggtaaaacttctttattctcatagcgggcatttccattaactaaggctaatagtactcgaactaccccgcgcataaatcgataaaacatagtctcttcctttcccttcttatggtcatagtatgcataaaaaatagaggtttgacaagccaccttggttctttttaataaaaatagtataatacagacgactatttttttcattttggagggaatccatgcttcacgaagacgaacgaatcgaccaattatacgcagaagatatcaagattatccaaagttccaaagtgttttctttttctttagatgctgtgctgcttgctcacttttcccgtgtacctaaaaaagggaagattgttgacctttgtgcaggaaatggcgcagttggactttttttaagtaaacgaacccaggcggctatcgacgctatcgaacttcaacctcgtctagcagacatggcaagacgtagtatcgcgcttaaccatttaaatgaacaaatgactgtccacaccatcgatctgaaagacagcttatctgtcgttcgacataattcttgtgacttagtcgtctgtaatccaccttatttcaaagggctgccaacaaataaaacgaaccctaataaacacctggcaatcgcccgtcatgagattcatacgacgttagaagaagtgatcgatatttcaagtaagctactaaaaacaaatggacgctttactatggtccatcgtcctgatcggttcttagaaatcattcaggtcatggaagactatcgaattgcacctaaaaggatccaatttgtttacccaaaacctggaaaagaggcaaatattttgttagttgaaggaatcaaagaaggcaaattagacggattcaaagtcgctccaccattgatcacttacaatatggatggagaatacactgcagagattcgtgagatgctctatggcaaatgaacattatttttacgtattattctgtaaagatcagacattttatggtggatatacaaccgatctttctagacgattagaggaacataacaatggtactggtgctaaatatactcgtcttcaaaaaagaagacctgttaagatgatccatgcagaagtattttcttcaagaagcgaagcaacaaaagcagaagctgcattcaaaaaactcacccgaaaacaaaaagaacgttatttacagacacactcaaccgttttgcttcctgaatctatatgaatgttaaaaacacggtaaatataaaaaaacttcaggcaaaaacaaatgttttgcctgaagttttttgtagctatcattctgtcacgtttgtctcactgctgttcgtacttgaacttcctcctagcaaggcttcgctgactaagtgaatgtaatgtgtcatcccttcaggatttggatggacttgatcatcataaaaccagtcactatggtcattactgtagctgtaccaatcaatcagcgtcatattgtcgtattttttcgtcatctgttcaagcatcgcattcacgtcattttgccagcgcttcgtcggtactcggacattgacccagtatacttttcgatcaccgattgcatccatcacactatcaaactgagcttccgagaatgagccattcgttcctagtccgatcagaacagtgtctttcaacaaatcttgttcctttaatttttcaatgtacggtacactggcatataattgtcgtccgacatctccatctaccactacttttggataaagttcttgtagatccgttgcagcatccaacataactgaatcaccaaatgccgttagttctaatttttgtgccttattcccttgtgccttggacaactcgtacttatcaaggatcgcttggtcaaccgaactagtggtgttttctgaattgtttctggtttcttctgctaattttttactttcagcgatttttgcctgcagttgtttttgatcggctgttacagcgtttttcggtgccgtaacgaaaccaacgagtgcaattgctacaagtaatgtgcctggaacaacccatggtttgctcttactgatgatcggtttgctgaaccatcctttcatcacttggaatgtacgaccataatcaaaacgtgctagcggacgctccacatatcgataagaaagttcactgatgattagaatcaatgtgatttccactaaagtatgcaacaaaacatgatcggcaatatcagtcacctttgcttcataaaaaatcataactggaaactgatacagataaatgccatagcttcgtttgccaatccaagtaaatactggatttgtcagccatcgattcaaacttgctccggggtgtgctgtcactgcaactagcactacgcataacagactcactaggagcattcctccgtaatagatgaaattgtaatgatcatctaaaaagaagaagcaaagaatcagtgccaaaagcgagattcctccagcgatattcagaatatttttcgcttgtttcgggatgtttttctttaaacgcgtacttggccaaacaaacgcaagcgcacttcccaaccatatagaaaacagacgagtgtcggtaccgtaataaacacgggttggatcgcctcctggtgtatacaagatcatcatcaagatggcggagaggaaggatgtacctaacacagtataaaagatccattttcttttacgaacaaataccatcaacaatacaaacaagatcggccaaaccaaatagttttgaccttctactgctaaagaccagatatgcgtaaacggtgactcattagcaaatcgatcgaaataagataaaccgttattgatttgccaccagttgttgacatacagtaagctgctgaccacaactcctcgaagattgtttaacagccctcgctgaaacaaagtgatataagccgaagctgtcacaagcataaaaacaagtgccggatagagtctcttcattcttctgacataaaattgccaaatattgatttttccattttgttcccattcctgccgcagcagatccgtgatcaaataaccagatacgacgaaaaaaatcggaacgcccaaatagccgcctttcatactagttggcagaaggtgatagaagataacacccaccacagctaatgaacggagcccatcaaacccagtgatgtagcggctgtttttaacctttttgtttttccattcaatattccaacttttcataaacttttttcattcgtaatatacgggtattaagtgaaaatagcaagtagaatcgtgtcctttctctactatttttttctatcatcccataaatttaaaaaataaacatgctttttttcaactttaagaaaatttcaaataaaaaagcagtttttctttgctgattctactatggtagaaaaaaactgcagacaaacgaacgtctgtctacagcagtatttcatgaatttttgtcaaactcgatctaaatgccatcctcatagaaacgaccaagtatctggacgttttctgcaatacttacaaaagcttgtggatcagaagctttcattgcttctctaagtagaggcagttcgtatcgtgtaacgatcgtcatcaatactgtctgcttatcatgcttataagcaccttctgcttcattgatgatcgtgatccctctacgcatacagttttggatttcatttactactttttctggatgtttcgttacgatcattacctgcatcttcttttgtttagtataaacgacatcagttacttttccactgacgaaaatagacaacgtactgtaaaacatatattgccagccaaatagaattccggcaacaaaaacgatcaatgcattgaagtagatcgaaatagaaccaatcgactttcctgtttttttacgaatcgtgatactcacgatatctagaccgcccgatgataggccgtttctcaacgctagcccaatacctagtcccatcacagcccccccaaacaacgcacagatgattggatcggtagataggactgtttccggtaaaatatggatacaaagggaggtcaaagtgactgtgataaaagtgaaaattgtaaacttcttcccgatttttaaccacgccaatacaaacaaaggtatattcagtaaatacaaagttgttgataccggtacttcgaatcctatcagtgattttgacaaagtcgtcaaaatctgagctagaccagtaataccacttgaataaatatgtcctggctgataaaagaaattcaatgcgactgatgcgatcaacgcataaacgatagataccgaaagcttggtcgtgtaatcatgataagcccaattttcgaatgtttttttcatggaaaagccccgctttatatgttatggcttcattataaagtgtttttcaattaaatcaaggttgtcaaaagaagcgtattcgacaaatcctttttacctttttatcggctattcttctatattcgttacatcaatattcaattcgaacaattgtaaaggcgaaaccatacttggtgcatcactcatcacatctgctgcttttccgtttttaggaaaggcaatgacttcacgaatattatcttctccggctaataacattgcaaaacggtccaatcctaatgcaataccgccatgtggagggaatccgtaatctaaagctgttaacaagaaaccaaattgttcttccatttgttcttttgtaaagcctagagtttctagtactttttcttgaagctcacgagtatgaatacggatagaacctccgcctagttcataaccgttcaagacgatatcataagcttctgcatagacttttgcagggtcttcagccaataacgggatatcttcttcttttggcatcgtgaatggatggtgagcagagacatatcgaccttcttcttctgaaaattcaaattgtggccaatcagttacccataagaaattgaatttcgattcatcaattagtcctaattcttttcctaaacgtgtccggatagcacctaatgcagcagcgacgatttcacttttatctgcgccaaacatcagcaagtcacctggttttgcatctgttgctttaatgattgcttctgttgcttctcccatgaatttagcaattggacctttcaatccgtcttcttctactttcagccatgcaagccccttagctccgaattgtcctacatattgacctaactgatccatgtcttttcgtgagtagcgatctgcagcgcctttagcattcaatgctttcacgacaccgccgttttcaagagccatttggaagactttgaattctacttctttgactgtatcgcttagatcgatcaattccatatcaaaacgtgtatccggtttgtcgctgccgtagcgagccattgcttcatcataggtcatacgaggaaatggcaatgtgacttcgataccgcgaacttctttcattaccttcgcaatcaatccctctgtgtaagtttggatttcttctgctgttaagaacgttgtttcaatatctacttgcgtaaattcaggctgacggtctccacgtaaatcttcatcgcggaaacaacgaacgatttgataataacggtcgaatccagcattcatcagcaattgtttaaacaattgaggagattgcggcaacgcatagaaatgtccagcatggacacgtgaaggaactaggtagtctcttgcgccttctggtgtagatttccctaggtaaggtgtttcgatatcgagaaagtcattatcatctaaataatgacgaatcgcttttgttgtcgcatttcttaatttgatgtttttagtcatttttggacgacgcagatccaaataacgatatttcaaacgtatttcgtcactgattgcttgatcatcttcaatttgaaatggcggggtttttgcttgattcaaaatcacgatttcacttgcaatcacttcgaattcaccagtggccattttaggatttactgcattttctccgcgtcttctaacttccccagtcacttcgatcacgtattcactgcgacatttatccgcgatttcccatgcttctttgttgatttcaggattaaagacgatttgaacgattccttcacgatcacgtaggtcgataaagattactcccccaaggtctcgtcttttttgtacccatccttttaatgtaactgtttgttctaattgttgttcggaaactaatccgcaatagatcgttctttgtgccatttatttttttcctcctactcgaataaagtcatttcatcatagacttcatcaaaatgttcatatatctcttctaatggaaaacttttttcttttcggcttgccattgctttgacattaatcgtttgactagcaagctcatcttcaccgatcaccaatactaatttggcattcgctttatctgctgtcttaaattgcgcttttgctttacggttcatgaagtcgcggtcagctgaaaaaccaaagtttcgaatcgcttggaccactttcaatgcttcgatatttgtttcgtctccgagtgcgaccacgtaagcatccaactcattaaatgcagggataactacttcctctgcctccatagtcaagagtaatcgctcgatacccattgcaaatccgaagccaggtgttgaaggaccacctagttcttccactagattgtcataacgtccgcctgcgcaaatcgttgcttgtgcccccatttttggtgcgtcactcatgatttcaaaaatcgtatgtgtgtaataatctagtccgcgaaccatattactgtcgatttcataaggaacagccaatgcatccagcatggaaacaacggtatcaaaatgtttttgagcaggctcgcttagataatctaagatagatggagcttctgccacaaatttttgatctcgtttgtctttactgtccaatacgcgtaatggattttcatgaaggcggcgtttagagtcttcactcagctctgattcaaaaggtaaaagatagtcgatcaatgcttgacgataggcttgacgcgtttctttatcacctaatgaattgatgactagccggatttgcgtgatccccaactgtttgaagaaatcaagtgccatcaccatgctctccacatcagttgcagggttttctgatccaaatgcttctactccgatttgatggaattgacgtaaccgtcctttttgagggcgttcgtagcgaaacattggtcccatataaaaagttttgaacggtttcgcatactctgggccgaacaatttatgctcaacaaaagaacgaacgattggtgctgtaccttctggtcgaagcgtcacatggcgttcccctttgtcataaaaatcatacatctcttttgaaacgatatccgttgtatcccctacacttcgggatatcacttcatagtgttcaaaaatcggtgtacgcatttcattatactgataatctctgaataataaacgtgctgtttcttcgacaaactgccatttttctgattcgcctggcaaaatatcatttgttccttttggtctttggaaactcatagttttctctccctttcttagctatgtaaataaaaaaatcacccttgttcatcatgaacaagggtgaatgaaattcatacacggtaccacctaattttgaaagatttctctttcctcttacgaataacgctcgtacgcgggacggcttttcactcgtccatctccagagtgtctttaggctaatgaaactttagatcattttcagcctcgatgatcctctcttgtaaagtttcaaaaacttactcgctctttcattgacattcgatattacttataacctactaaaaaccagtctcaaagtcaagagatatctgactatttcccctcacaaaaacgttttagttcagctttttggtattttgttttagactagacaaaaaggaggaatcagctatggcagaaataagaatcggacattcacaagtctacgcagaacagcttggattaggagcaaatgccgttggaggacataatctttttgacggtttggaagatgagacaggaaaacaagtagttcgtacagctttgaatagcgggatcaatttgatcgataccgcttatgcttacggaaacggccgttccgaagaactgattggcgaggtactgaaggaaaaagaatatgatcgctcacgtgtcgtcatcgctacaaaagctgctcatgtaccaaataaagggcgaacatttgataattctcctgagtttctcaaacaatcggtggaagatgcactaaaacgtctgcaaactgattacatcgacattttttatatccactttccggatgaaagcacaccaaaaaatgaatcagttgctacattgcacgaattaaaagaagcaggaaaaatccgagcagtcggtgtgtcaaacttcacgttagaacaattgaaagaagcgaatgcagatggatatgtcgatgtagtagaagataaatacagtttgatccatcggcaggctgaaaaagaattattcccttatcttgaaaaaaacaaaatcagttttgttccctattttcctcttgcttccggtttgctgacaggaaaatatgaacttggtgaggaaaaacaatttggtgaaggagatcctcgaaaaagaaatccagatttccaaggagaacgtttcagagaaattttaaccgctgtcgatgtacttcgccccattgctaaaagataccaagccactcctgcgcaacttgttttagcttggtacatgaagaatccacgagtgtctgtagttatacctggagctaagcgtccagagcaagtatctgacaatgtccaagctttagatttgcatttatccaatgaagattatcaaaccattgatgaagcatttcgtggattttgatcaattgaccttatcaatttatagtaatatgaaaaaaggaagatcagcactgtttgatcttcctttttttcgataagtttatgctaatctaattcttgtaaagtagcgctcggctattcggataagtcggaaactgattgaatggaatcgtccaatcttgttcaggtacagagaactcaaacttatttactagctgatcggaaaacacacgtagactatgaagagtgatccattctcctgcacagcgatgcatttgtcgaaaatttcccccgccttgtgcaatcatctcatattcttctttataggaaatatcttttgctttccctacataccgtttgatcataaaggaatctggcgcttcaactgttcgttcatcatggtctgttccatataaatctaaaataacccaactgccttctggtatacgataaccatctacttctacttctttcagcgaaatcgcaggtagcattgggaagaaaggataatagcgtctcatttcttgaataaacggatcttgtaacgtcgaaaagtcattttttaattgctgatacaaatctggtctactgaaaagtgcatgtcccatcaatgccgcccacacagttagagcaaccgttggacggatgatgttcaataattcaacagctgccacttccagaggtaaaagctgaccatctaaatctgtggcattggcaaaagcatataatgccacattttcttttccagccacaggattttgtcgagcttcttcaatcaagccttgcgcccatttttctgattttttgcgattttcgacaccttttatgtgatcaatcggagaagtaaacgttccgctgatcatagagatttgatattctgctaatttttcgacctcatctttagaaatcgctgataaattgatacctgcccactcgcaaatagatgtaaagaaaaccatcttacttaaatcaaatagttcaaattgaccatgctgtgcttcaagtgcttgtgtcagattcttatctaagatacgatgataatcttccattctttccggtgtcattagatccataaaaatatttttccgatggtgatgagcagctccatccaaagtctgtactccaccttgaccaaaaagtgtcttcaatactaattttggcatagcaccttttcgtttgaaattccttggatcataaaatacttttgctgctgatgatccgtagatcgtgatagcttctttattgaaaatctttgctttgacgacgggagcgtccgcttcatggcgtaactcctccaacatgttgtatcctttttgatacaatttttttaaatctgtgattttgatatctactactggtacttctttcatcttcagcaacctcctataaaaaataacttgtataatttaagcttaactttttttccgactgctgacaaaagaagcgctttttgcagacaaaaaagccacttaagttagagtttatcagtctaacttaagcgacgtgtttcatagtttttactagtgaaaaccagattactttatttgtttttagaatcaataatgatcgttacaggtccatcattgacgagagaaaccgacatatctgctccgaattgtccggtagcgactgtgatgccgcgacttctgattccttcattgaatgattcgtataaaggaatagctgtttctggtcgtgcggcttccacaaagcttggtcgatttccttttttcgtatccgcaaacagtgtgaattgagagatacttaaaatttgtcctcccacatcttctacactaatattcatttttccttgttcatcttcaaaaatacgcatttgtgcaattttttttaccagatagtccacatctttttgcgtatcggtttcatgaatgcctaataaaacaagtaggccgtagccaatttttccaatttcttgctgatcgactgacacagcagctttacttacccgttgaacaactgctctcatatctgtcctcctatccattcgtccggcgtacactgtagacatcaggtactgctttgattttatccacgatactctttaggtgggataaattctggataccaaccgtcaaatggatcgtcgccattttatctttattcgtccgtgcttcaacgctgttgagatttttcgttagcgcattgactgtttgaagtacatcattcaataagcctgaacgattatagccgtaaatttccaaatctgcatcatactcttttcgtgtattcgatgtatcttcccattcgacttcaatcaaacgttctgctacatttggtttgtcaggctgaacattcggacaatctcgacgatgaatggatatccctctgcctttagtgatataaccaacgatatcatcaccaggaatcggattacagcagcgactgatacgaattagtaagttttctaccccttgaatgacaacgccaccttcatgacgtactttcattttgtcaggttcttttttcggctgattcatgatttcttctgcttcttgcttttgctgctcgattttttgttctttacgttctttttcagtcagacgattggccatcgtcaaggggctaacttctccataccctacagctgcatagagatcatcttctgtttgataattaaaacgatcgagtgcttcttgcagtttgttcttcgtcaaaatatctttaggcgtaaatcctagatctgtaatacatttgaccacggattcgtggcctttgatcacattttcttctcgatcttgggctttgaagaaacgtttgatcttatttcttgctttgctagtagcaactaatttcaaccagtcgcgacttgggccaaatgaatttggagaagtcatgatctcaatgatatctccgtttttcaatttgtaatcaagctgcaccattttgccatttacttttgcaccagtggttttgttaccgatatctgtatggatactgtatgcaaagtccaatggtccggatccttttggtaactcagtaacgtctccttttggtgtgaagacgtagactttatcactaaagatatctccttttacgccttccataaattcagaagcatcatagctttcgtcttgaagttcgagtatctcatggaaccagcttaattgtttcgtcataccatctggttctactttttcattttttccttctttataggcccagtgtgcagcaaccccgaattcagcgatttcatgcatttcctgtgttcggatttgaatttctaccggatttcctgccggaccgatcacggtagtatgcaaagattggtacatattagcttttggcatggcaatataatccttaaatctgccgggcattggtttccattttgtgtggattgctcctaatacagcataacaatccttgattgaatctacgatcactcgaatagctagcaagtcataaatttcgttgaactgctttttctgatctttcattttacgatagattgaataaatgtgttttggccgtccatagatttctgcaaaaatccccagctcttctgtcgctattcgaatatcttcaacagtaccacttacgtatttttcacgttcttctctcttcgtctgcatcaagtggacgatacggtaatactgttttggatttagataacgaagtgctgtatcttctaattcccatttgatccggctgatccctagacgatgtgcaagaggcgcatagatttctaaagtttcctgagcgatccttctttgcttatcttctcgcaggtgcttcaacgtacgcatgttatgtagtctatcagctaatttgaccatgataactcgtaaatcttgagccattgctagcagcatctttcggtggttttctgctagctgctcttcgtgggatttatattttattttccctaatttggttacgccgtccactaacatagcaacgtcatcgccaaattcttctctcagatcttctaaagtgatttctgtatcttcaacaacatcatgtaagaagcctgtagccactgtatggggatccatttttaaatctgctaatatacctgcgacttggataggatgaataatgtagggttcgcctgattttctaaactgtccgtcatgtgcagcagtcgcgtattcgcatgctttctcaacaaatgctacatgttcgggacccatgtattgactaacgagctttatgacaccgggtcccgttaaaatttcttcttttgtcacaggaatcgatccccctttcttttttcggtaaaacgggaatcgggacaaatatctgtttgataattgtcccaaaatccgtgcagttatacgtttttttacggaaatgttcgctttttaaaagctttttcaaacgatttttcgtatccattgtataaataattgtttctattatacaaattgttgactattttttcaattctttctgtcgatactcttttattaatgaagaacgttagctgaaagaaggattcattaattcccattgatagctagcagcacttaataaataaagaggtgctgtttctgtacgaaggattcttggtcctaatccacaaagtatccctttgtgttctacaaaataatcgacttcatcgcgggataatccaccttctggtccaaagacagctaagattcgactatctggttttgtttcactaagaattttggctgcatttgatttttcgccttgctttgctgattcctcataagcaaccaagaccacgtcataatcatctagccgctcaaataaatcttgtttcgtttccaataactctactgatggcacgatctgccgatgggattgttccgctgcctcttgagcaatcttttcaagccgttgttgtcgtttcatacgtttttttgcatcccatttaacgacagaggctgatgccgggaaaccaagaaaagcttgcgctcctaattcagtggatttctgaacgatccaatccagcttttcccctttaggatagccactcgctatggtaatcgaacttggcagttccttttgattttcttcttttttaatttctttcagataaacagcctcttcagtaatctccgtgatttctgcaacaatggctatttgatcattgaatgccaaaaaaacttcatcctcgggttccatcctcataacccgtacaatgtggtgatagttttccccttctaaaacaaaatagtcttttgattcatatgattcttttaaaaaataccgctgcatctattccacctctggttttttcaaaataattgcataccagtctttttgctggaaaatttgatccacgataaacccttgttctaacatggcatccagaaccatttgcttcttctcttcaatgattcctgaaacgatcagcgtgcctgtttgcttcagtaaacgccaagcatctgggatcatcaataagatgatatctgctaaaatgttcgcaacgattacatcactttcaatctcgattcctgtcaaaagatcgttagctgatacatggacatctttggctatttcattcatatccatattttctttcgccgaacgaacggctacttcgtctaaatcaaaggcatagacatcttttgcaccaagatattttgctgcaatacttagcacgcccgacccagttcccacatctagcaatgtttcaccaccacgcaagactgtttctagtgctgtcaatgtcaaggaagtcgtgggatgagtgcctgtgccaaatgccataccaggatctagtgtgataattttttctagaggatcttctgtctggtagttttcccagcttggcgcaaccgtcagcattcgcgtaatacgcaccggatgatagtatttcttccaggctgttgcccagttgctttcctctacttcactaactgttactttattttttccaatagctagaccaaactcaggtaattgtgtgatacgatctttgataaaaggcaagatttccggtaagaaagtcgtttccggaaaataagccatgactagtgcgccttctttcagcgatgtaaaatcatttttatctaaaatctcaccatattgatccgactgaaaatgttcaacatctaaagaatcttcaatcgcgacaccactcgcccctgcctccatcaaaatattagcaactgcttcgactgcttcactttcagtttctacttttacttcattccatttcatatctgtcactccttaataacttgggtacggtaaataagtatctgcttcattttgctgttttacttctactaattctgctagttgctgattatcccagtgaagctcgaatacagcttcgtcatcgtcttcatccaaaaaatcaagcaaatcgctttgcccttgagctaatacttcatttagatattccactaaagaatcagctactgattttgccaaccctttttttccttcataagggattactgctagataattgcgttcatcaaaaacagatttctgaggattaaaaagaagtacgccgtcttcaaattcgataattggttcttgcgaaacgatcccttctgcatcatcaatctcaaattgtgctttattttctgcaaacaagcgaacaacgatctcgatcgtatgattttttgtatcccaatctaaagctacatcatagtctgtcacttgtttttcaattatttcatctaaatatgttaatagatccttctttttcattttctttcctccaaccccaatctttctcgatttggttttttctttgtaaagagatataaggatttcccgacacaacaaaacgcaacggcttttctgtccatacacctttgtttgggataccgattctaggcaaagcattgatcttttttggtgtcttttttttctcaaaaactaagcgtaacgaactatctgctatagactgaccataaagttcttgaggaattgctaatgcttccactaattttcccggaccgttgctgatatctggaccagtttttccgccacgatttttactcatttgatcaatcattgcggcgggttcgattgcacgtatcattactccttgaggaatcccttctggctgagtaatgatgttcaaaatccgatgagtatgcatcgtgtaaaggtagatcgtacctggtttttcatacattgcccgcacacgcggtgttcttcttaaaccatagctatgggcggcctcgtcttctggacctaggtatgcttccgcgtctacaatatatccagctaatcttccttctggtgtgtcatgctccaaatacatccccaataaatcccgtgccacttctggcgtcgttttattccaaaaaaattcatctatcttttgtttatccgtcatttttctcacctactttatcatacacaatattagttggataagctatgaaaacaaaacaacagaaggctgttctttctaggcatcttgctaaatatgatataattaagggacgtaaaaacaagaaggaggaaaatcctatgcaacagccattggcttatcgcatgagacctcgaacgatcgatgaagtcgttggtcagcagcatctagtcggggaaggaaaaatcatacgccgcatggtcgatgctcgcatgctctcttccatgattctatatggacctcctggtactggaaaaacgagtatcgcaagtgcgatcgccggctctactaattatgcatttcgcatgctaaacgccgctacagattcaaaaaaggatctacaagttgtagcggaagaagcaaaaatgagtggtacagtgatcctcttattggatgaagtacaccgattagataaaacaaaacaggattttctgcttcctcatttagaaagtggccgaatcatcttgatcggagcgactactgagaatccttatattaccatcaatccagcgatccgcagccgtacacagatctttgaagtcaaaccattaacagaacaagacatccagttggcagtcgaacatgctttaagggataaagaacgcggccttggacaacaagcaatccagttagacgaagatgctcttcttcacctttcgcgtgcaacgaacggcgatttgcggagtgcattgaatgggctggaactggctacactatcgactccttcagataaagaaggaaggattcatcttacactgtcgatcattgaagaatgtgtccaaagaaaagctcttacccatgacaaaaatggagatgctcattatgacgttatttcggcttttcaaaaatcgattcgtggaagtgatgtggatgctgcacttcattatctcgcccgtttagttgaggcaggtgatctggcaagtatttgccggcgtctgatggttatcggttatgaagatataggtttaggtaatcctgctgctgcggctcgtacagtgaacgctgtattagctgctgaaaaattgggattgcctgaggcacgtatcccactagcagacgtcgtcgtcgatctttgcttgtcgccaaaatccaattctgcctacatggcattagatgcagcacttgctgatattcgagagggcaaagctggagatgttcctgatcatttgagagatagccattacaaaggtgcgaaatcactcaaccgtggcgtgggttatcagtatcctcatcattttgatcaggcttgggtcaatcagcaatatttaccagataaactgaagaatgctcagtattatcagccaaaagatacagggaaatatgaacaggctctgggtcaacagtattaccgtataaaagagtggaaaaagcatcctccaaaaaactagacaagaaaacggttctgtttctgcgagctctctcattgctctttttaaattcatatgctactatagaggtgggaaatctgtgatgttcgaattgtcctctttgtgtgttgaccgaacatttttattgatatcttgggacccgtcttgtgtcactgctggtaacatgccttatcatttggtagttcgaagctacgaccatgggacccacctgcttgaattcgcgggatcaatactacaggacaaacaacggcattaacggagattaccatcttttaaagaataaagcaatttgctcttggcaaattgctttttctatttgttgcttattttggaggatttgttcatgattaggattttaatgattatcgccactttagtattattattcgttagctattatttatttaataaacaggatatcttttttgtattgatcaacaaaaatgataaaaatcaaggattcctacaattttacggagctgcatatgctgttttaggcgtaatgggtattttaacagcttttttcaatcaacgctttattgccttggtctttttactgatcgtaattattgtttctgccaccttcagtatccgatttgcaaaaaaaattgctgaaccaaagcagtaaataattctctttttccctaaagtgttctacaataaaagagtacaatacgattgacttgaggagtgaatgcttatgttacaacaatacaaaaaaatcatggttgccgtagatggttctgatgaagctgaattagcttttaaaaaggcggtcaatgtagctatccgaaataacggagaacttctattagcacatgtcattgacacacgttctttccaaaccgtttcatcctttgatggaatgcttgcagaacaagctactgaaatggcaaagcaaacattggcagattatgaaagcaatgcgaagaaagctggcttgaataatgtaacctctgtcgtagaatatggctcaccaaaacaaattattgccagagaaatcccagaagataatcaagtagatttgattatgttaggagccacaggattgaatgctgtagaacgtttatttattggttctgtttctgaatatgttattagaaacgcagcttgcgatgtgcttgttgtccgaactgatttagaaaaccaattgccagctaaagaccacaccaaagcttaacacgtagacgacctgccaactatcggcaggtttttttgcacaaaaaaccgtgataaaaacaaaagacgcggcaagcactcatcggtctttataatgtttaaaataaagggaaaacagtcaatgagttcaagtaaaataaaaaaaagtgaacaccagggcgattagtcgccctggtgtggtttaaaacgacctaagcatgccaaagcttattggttcgtcaatgtggaagtttccgatgaatctgatacgaaaaaatatgaagtatcgatggcggataccgattttatcgccaaactaaaattttatttcgggttcgggtaccgcgagaaggcaagtgctacattcggtaaatcattcaagaattgatgaaaggctaccgcttgccattgcaaccacaacgatactcctgaacgcgatgttggtgagatttccaaagagaagagctgtttaatgcaacggtattaagcaaatggcaaaaggaagtcatgtagacaaagttttttatcaaacaccatatgatttcgcctgaacgctggtttagctcagaatacaatgatgtggtccacgagacattaccctcagtcagataaaaaaagctctctgacagaattacacatcgataaatattaagtaaatgtcagcgctagttgaactttctgacactttcaggtacactggaaaagacaactacacgaaggagggaaaatactatgatgcgcatgactaaaataacaagtaatgaaaattaccaacgataccatatcgcatttagccatgcaattggttttacagttgctgttgacgggacaagtttgtccaaaacagttgaattcacgtaaaatcaatggccatctcaaggtatttttctcatgataatctgagtttaaataacacaggccatggataaccatggcctttttgagtggtctcaaggagagagatcatgatcatacaagcaatttctattaaaaaaacaatcggcgggaatccattatttgaggatttatcctgtcaaattgaagctggtgaaaaaattgccttagtcggtatcaacggaactggcaaatcaacctttttacaaatcttgaccggcagagaaggtgtcgacagcggtgttatcagtcgcaaaaaaggcttaaagatcgggacggtcgaacaagaacttacagtttccgaagcgaccgtcaaccactacttgctccattctgccgctgagatacaggacctcaaacagcaaatgagtcgctacgaagcattgatgacagaaccagatacaaacttagagaagtgtctggcccgttacggtgagctgcagcatcgctttgaagaactaggcggttacgtattagaagaccggattgcagcgatcttgcaaggcttagggattccacaccgtcaggaagcacggttaacagaacttagcggaggcgaacgagttaaagtcgctttagccaaaattttagcagccgatgccgatttacttttactcgatgaaccgaccaatcatttagatcttaacagtattcgctggttggaaaactatttacagaatacaaaaaaatcggttctggtcgtttctcatgatcggcaatttctcgatcaagtcaccacaaaaacatgggaactggaagaaggtgcattgattgagtatcccggaaactacagccgttttcgagtcttgaaagaagctcgcttggctgagctgacaaaaaattacgaactgcagcaaaaagaagtccagcggttgaaagtcatgattcgtcgttttcgtcagtgggcacatgaaggagacaatgagtccttcttcaaaaaagccaaagaactggaacgccgcctggcgaaactgacactcgtcaaaccgccacctcccccgaaaaatcggctgcaaagcttgtctaatggtggaaaatctggcaaagaagttttcatcattcaaaacttgcaccagcagtacgctgatcaagtactattcaaagacagcagttttgcagtctatcgtggagatcatttagccatcatcggcgacaatggtgcaggaaaatcaaccttactcaaattattactcggtgaggaaaagccttacggtggcaccatcaaattaggtagtagcttgcaaatcggttatttgccgcagcagctgcagtttgccgatcccgatagccgtttgctggcttacgccatcacattgactggaaacgaagaagtcgctcgacggcaattagccaaaagtggcttttatcaaagcgatgtgggtaaacggatcaaagatttatccggtggtgaaaaaatccgtttggcgttgctgaaactctttttagaaaaaatcaacgtcctgattttggatgaaccaaccaatcacctcgacagctatgctcgagaagaaattgaagaaatgctgcaagactatcaaggaacgctcctagcagtcagccatgaccgctactttttgcagcaacacttccaagaagcactcgttattgatcaggagcagatcagccgccagccgctcggccaactgattgactaggacgttttttcgcaacaaaaaacttgattttcatacctgtgctttcacgattcaggcaaagtacaggtggaaaatcaagtttttattattcgatcaatgaatgtttcggatcggttttctagctaaacataaagcgaagaataaagtcgacagcccacgaggctgatctaaaaatgttttttctttttacatatgtaatgtcccttataaagatgaatgaaaataaaatattgggattttcctgaaaatcaataaataaaatgccagtcttttcccttttgaccacttttccaagcaaaattccctaagaagatcctgtaaaaaagaagggaaattgaagttaaattaccattttgcggtcttctccgcaaaaaaaaacacatgcaagaattccctcttgcatgcgtttcatcttttatcctaacgaatgctttggcttagccgcgcagacgctccacatcacgggcaatcattagttcctcatctgttgggatcactaatactcttacttttgattcttttgtagagatatctacttcttcaccacgcaattcattcaacgctggatcgatttcacaaccaaaccaagacatacctttgatgatttcactacgtacatgtccgtcattctcgccgataccagcagtaaagacaattgcatcaacaccattcatcgttgtcacataaccgccgatgtattttcggatgcggtccacgaaaatgtcataagctaaacgaatatgttctttttcatagttcttttcaagatcacgcatatcactagacaatcctgttaggcctagcagaccagatttcttgttcaaaacattgatcatttcatcaatatcaatctctaatttttccattaaatatgggagaacagctggatcgatatcacctgaacgtgtacccattgtcaccccagctaatggtgtgaatcccatagaagtatccatggatttacctccatcgactgctgtgatcgatacaccatttcctaagtggcaagtgatgatttttagttcttcgatcggtttgttcaataattttgccgcacgttccgacacataacgatgacttgtgccatggaagccatattttcttactttgaaatcttcataataagacaccggtaagctatataaataattttgctttggcattgttgagtggaaagatgtatcgaatacagccacactcaaaatgtcaggtaaaatctttttaaacgctttgatccccattaagtttgcaggattatgcaaaggagcaaattctgctaattcagcaatgcggtccattactttctcatcgatcactactgaatccccataagtttctcctccgtgaacaacacggtgccctactccggtgatttcatcataagagcttaaaatttgcagttcaatcaactgatctaacagcatttttactgctacttcgtggttttcgatatccatgatttgttcgaatttttgattatcgccgtacttgatggtaaaaatagaatcttgtaaaccgatacgttcgacgatccctttcgcaactacggtttcttctggcatttgatataattgccatttcaaacttgaactcccagcattgattgcaattgttttagacatatgactctccttctcgttgaatgattacagagcagatgatttccagtttttaaactcgttgaaaaattccgtcaccttctctggttcttttaatgaagcaagtttcacaagcaagacttcttttacttgttgtgcttgtggtccttttttctgtaagatcaaaatacttttttgcgattgtttattacggaacaattcatctggcaattgaatcattccttgaagataaccttcttctttaaaccattttttgatttcttcactttgatccgtttctaaaaatccactcggcatcaaaaacaaaccaaaaccatccggcttcacatatttcattgattgctctagcaataaatgatgtgcataactatggccttcttcggtacttgttaaaaactcttttgctttttcgtcattcggataataaccgattggcaaatcgctgattgcaaaatcgacaggatctattaataattcctgcaacccgtcttgatgaaagtattgaacatttgcttgtgtcaaatcacttgtagaagctgcgacagccaacaatgtatcatcaatatccacaccaattccttctgtttggtaccccgcattcgataggtttaaaagaactgttaataacaagttgcccattcctgccgcaatatccagaatcttaaccggtgcttttttatttgtgtatagttgttcaataagaaaaacaaataaaaaaccgatactatcaggagtgagttgatggttcgcctgcaaatgttctgtctggctgcccttcaataaaagtaattgagacagtctgcgccattcttctggctcgaaagaaagtttcttcaactcttcataaagagctgtgatccgttgcgttgtctcttttgtcggcactccatccaccacacgtacttgataatcatctattaaattttctgcattttcgacataggcttctaaaaaggaagttcccaatgcattctgtaaaagctgaatagcttccaggttttgattaaacccttgttccattttttctggtaacatggtgcacctcatttctagatatattataacaattttttcacctgtttaattctatcgaacaattgacaaaatttcaatcgttttcactgttttttatttgtgaaacggcaaacatttttttattaaaaacagtgttataacagaaaagagggcgttttcacgaacattccatcattctgtactagtatctgtatcattttttacttcttctgtgaaccgaaagataaacggtgagacttccacctctaagaatagggactgttgtacccactgatatgttacagatccagttgtgtagtaaaaaactccttccgaactttcggcaagcgtagactgttccgataaagccatctgcttcattatttttgctatataataatttttgattcgtatattaagatccattgacaaacggtagctttctaatgctgccatcaataaaaacgtacataaaagaaataaaagcaagacagaaaataaaatagagcccttataacattttctactgatcgttttttgtccatatggcatatccatcttctccattttcaaagtgtacataaaaagaaattgtgtgttctttttccaataattgaagctcagtgatacttgttaacataggttgatgtccgccggaagttcttcttttacgtatcattgcctgatatctttcgatgatatactgtttatcctcgatcgtgtagtgcagttgctgatttttcacagagacattgtgactgctcttgagttcttcttctaattgtgctaaaaatattagccactctttttgatctttacgctgcaaaaattcacttacttggatggtttgctgaatcaaaagattgaatgtgagcaatagactgctcaatatcatcagtccaattagacattcaatcagcgtaaatgctggaattacttgttttttcaatactgatcgcttctttctccatattgacaaacactttttcgattactccattattatcgacaatttggatatcgtatgggatcatttcttcccttcgctctggtcttttgtgatacatccgctgcgtcttgatatcttcataaatcattcgaataaatagcagttcctccccacttttcttttctgcctgaagcaaaaacagctggccaaagctcactaagtagacacagacagaagcgatcataagcgctgtaagggactccaacaaaacaaatcctgttttattcaattctttttgtatagcgaccactccctatctggaattgatacgtaatcgtccgctctttttcttcccaataaaattgataagcttttagtgaactttcattcccggttctagcagcaaaagtaatagaagcatggcgtttcaaggtaatctcatcaggaatatctaatacttcccaatttattttatctggattcggaacatgaaaaatgatttgattctcttcactattccaataaaagcctgtttggatctgattcacaatagcgattttttgcgtagaatagattcgtttttcaaattggccgaaaaattgatagactgccaattcattcttccatgcagaaaatgcgagaactggaaaagaaaggatcgttgtaagtaataaaatcagtaagagtgattcaaacaacgtatatcctgatgctaaaaccttaccttcaaggccgctgatagatttctgcatgttctcgtttgatatagccttcattcaacaattcctccacagtaggaactcttccattattttgaagcgcatagagctctttttgtgtgtctaccaactggatgatcgcttcacgactttcttggtctacatgattcctataacgcgacaaattagggacgaacaacaacactaatacactgatgatcagtaagacgattagcatttcgatcaatgtaaaaccgctataataagatatttttctctttttcatggcaaaacctcctctatgcttccgtaaacaggtaataaaacagcggcataaactaataaaatcaaagccgctacgcccaaaaaaatgattggctgaataaaatgcatccagtgatgaagacgtttgaaaagctgttttcttgtccattcgctgtaaaaaatcagttctttacctaaacttccctttgcctctccctgtaaaacaattttactgaattcttctgatagaaaacgataattctggaactgctcagccaatgacatacctgcctccaatccttgaatcaacttagaggcaagatgctgaatcagactttcttgtttcgtttcctttaagcagactatgatttgccttaattcgaaaccttcatgaaaaagctttccaatctctagtgacaaataagccgattgatacaaggaatatatcggtccaatcaataattgtctgcttatccattcactctgatcaacaggagacaacttcatcagacgataccttactagtaaagccaatagagtaaccgctaggatgaatagtagaacataccaatgaaagacttgtatcagctgaataccccaatgctcttgcatgaccattcctgaaccaataagctgaggcaaaacgaacaaccgcatactaaacaagatacctagcaaaaaggtgagcaatagcatcggatatgcaagcagctttttcaaatcattgcgaaatccttcaacaagccgaaactgtttggcaatttccaacaaagttgtcggcagattcccatgacgttcagctaactcgatctgtaccagttgctctgctccatatcctatttgcgaaagtacctcactaaacgcttgcccttcctttagctgatgttggatatttgccaaaataacaggtggaaacgaacggatcgtgagtaataaataaagggattcttgcagactaaaaccagataaaagcagttctcccatggtttgtgcaaactggttttgctggcttcttgttaatcctttagaatagttctgactgccaaatattttcctgagcttcttcataactttcctcccatgatttttttactgattcttcctccataaattgataactccataaaacagaaggatggtgattggcatcttccaaaagttcttgataaatgacaccagctaaacattcagatagctcttcttttttctttgtcagttcatggattctgaccaatgtaccttcaagattgcgtgcatgtacggttgcaaaaacccggtgccctgttagtgctgctcttaccgcagcatgtgcagttgattcatctcttatctcgccaatgattagcaagtctggacgatgccgtaatgcgagtctcaaaagtgtatcataagtctgtgctattttcggattgatctgtagctgcagaaaaaacggttcttctatctctacaggatcttcgatagtaatcacttgcaatttttcttccaaagccaaccgatacattagagaagtcttgcctgatccgactggtccgctgaaaaggtataatccacgtctgacggttttctgtaaaatagttgcaaaatctcgagaactaaagcaacgatggggtgtttcaaaagtaccgtataatagccgaatcactaaactctctcgttgaaggtaatctcctacagaagacaaccgcagacgaacttcctgtttttctaaagaataagtaaatgcacctaactgagcttttcttttttctccgatatccatctgtcccaaatacttaaatcttgagatcagttgctgtccatctgccgaagagactttcttccagaatgttcgtttttttccatagcgaaaatagatgtaaaatacttctgaagctggcaatatatatacgtcttgggcatgtttggcaaaactttcacttatcatttgatccgataatcgttttatttccattattctcccctccacaaaaaacatacgtctttttgatctttttgtttcaaataaaatgaatttacaaaaaaatattggcaaaaaccgaatttatgttatacttataaaaatttatcttgggaggcactccattggaaacaacattaaggaaatatatcgaagtagcaagtaaaaaaaagcctgctgacctagtgatcaagcatgctaagatcgtcaacgtctttacgaaagaaatcatggaaaaagatgtagcaatctgcgaaggaatgatcgtaggaatcggtgaatacgaaggaaaaagcgtacataatgctaatgggcaatatctagtgccaggattcatcgatggccatgtgcatatcgaaagctcacttttatcaccaagcgaattttcaaaagtatccttgcttcatggagttactactgtagtgacagatccccatgaaataggaaacattgctgggagtacaggtcttgagtttatgatagaagatgcaagacaaacactcatgaatatcttttttatgctaccttcttgtgtacctgtaaccccttttgagaccaatggtgcaaatttaaatgcaaaaaaattagccccttttttacaaaaacccgaagttttaggcttagctgaagtcatgaactatcaagcagtagcaaataatgaaacagacatcctagaaaagatccaattgatgcaccagcataagaaaaaaattgacgggcatgcagctggtatcggcatggaagagttaaatgtttatcctgcagcaggtattcggacggatcatgaagctacaactgcaaaagaagctaaagaacgtttggatcttggtatgtatttaatggttcgagaagggaccgttgcaaaagatctggcatcgctactaccggcgatcacacctgaaaattcaagaagatgcttctttgtcaccgatgataaactgatcaatgatttagtaaaagaaggatcaatcgatcatatcgtccgtcaagctattgcacttggaatcgatccattacaagccattcagatggcaacattgaatgcagcagaatgttttgatttgaaaacactaggtgcgattgcccctgggtatcaagctgatttcttcttaacagacgatcttaccaagctgccaattcatgaagttttctataagggaacattagttgttcaatctgggcaactccaagaccatttatttgctgatcattcaaattcatatacgtgttgtctgccaaaactaaacgctcaaccattaaatccacattcgttagagctgcttctttcttcttcacaagcccatgtgatcgaaattatcccgaatagtctagtgactaaagatttggtagaaaaagtggaccgacaaggcgaacgattcattccttcaatcgaaaaagaccaattaaagattgcggtgatcgagcgtcaccatcaaacgggaaacattggattaggcatagtgaaaggatttcagctgaaacaaggagcgatagcgacaacgattgcccatgactcgcataatctagttgtcgttgggacaaacgacgaggatatgctgtatgctgctaatcttttgattcaaaaaggtggcgggatgaccgttgtcaacaaacagcaggaaatagcttgtgtttctcttcctataggcggaatcatgacacaggaacctttttcgatcgtctatgaacagttgaatgaattaataactaaagcacatcaactaggagcagctaaaacctttgatccttttttgacactttctttcttaacattatctgtcatacccgaattgaagatcaccgacaaaggattattttcattttctcgcttccaattgattccaccttgtggaaaaaccgatgaaataaatacattttaaatcaaataaatcccagaaaatacattacatctgtaatgttcattttctgggatttatttatggatattaatgtttttatgaaagcagaaagttagtttcacagacttttctttttggtcttatcttgaaattgagcttctactcgataaatacgttgaccttttgaagaaaatttttcttcatactccgtcataatattgccttcaaattgactttgatgtaaatctaaccatacctgtttgaggatcatgccatattgagaaaaacttgccagagaatactcaaacaatccttgattatctgttttgaaatggatttctccatttggacgaagaatctgttcatctacagcaagaaaagtcttatatgtcaatcgccgtttttcatgacgtttttttggccatggatcggaaaaattcagatagatttgatctacttcgctgtcagcgaaatactctgtcaacgctgatccatccacatgtagaagtttcaggttaggaagcggttgttcgatcaacttgtctagtgcaatcgaaacaacactgacctgcatttctactccaatataattgatttcaggatgggcttttgccattccagtgatgaactggcctttccccataccaatctcaatgtggattggatgatcgttttcaaacaattcattccattttcccttccacaatgttggatcactaattacaaaattcgggtgagccgctaacatttccgctgctcccggacgatttcggacacgcattatttatctccattcctttcctctaattaaaaaggtctggccaaatctccgcagagtttgggccaaacctcagccactgaaaattcgttttaattgtaaaatttcttcgttcatccgtcgatgatcttcacgtttgcaatatctggtgatttcttggagcaaattcatggccgcataccaatgaaatttttcaagcatttcgtcagtcgggcgtatgccataactgatcagccactgattccagctagacagtggcacataatttcctaaaatcgttgcaatatccaccgcagggtctgcaaacatgattgaatcccaatcgactagatataaataatttttacatactaaccaattacgatggtttacatctccgtgtactactgataagttttccttatctattgacgggatctgctcacgaagaaaacgatggacaatttgcagaaattgatttttctggagttcttccggtaattctttttcatatttttgcagcatcttctccggcgtcatgacacgaccaccgatacgggtcagcatggttttaagagaatttgaatgatgtaaatggtacaaaacatcaatcacgtcgtttctttgaccaatctcattaggagtcagcaagcgaccttccagccactcttgtgctgtcaaagtatcgccattccccgttcgttttgtccaaacaagttttggtgtaattccttcccttgaaagagcagccaacatcggagtcgtgtttcgtttaataaagactttgtcctcatcacgcatgcctatgtatgtttttcctgtgtcgcctttgatgggacgtaaccgccactcttggtctaactgaaactccatcatgcattctcccgtcctcttactctttgttttgcagtacttattattctagtcgcctgaacactacacgtcaagcacatatacgttctttttcatttaattgccattcaaaaaaccagcttttctcaaaaaaaatagaacgaacagcattcttactgtcaacgctctatttttcattctcatttttaccctacacagctttgttttcagtctgacatcttcttcaaacgagttggtacatatagtttaacaaagagcatagtaacaatcaaataagccgctagcggaacccatcgctgctgcccatctaatacgactgcagcaatcaaaccaaaaataaccgacgcgataattaatacccatgtgagtagatactgaatcgcctgcttcttctgattcttatggattggataaagctgaacgagaaccatatagcggaactggttcgctaaaggtaacagttggaaaccgatcaaatataaaaataagaaaccgataatcagactaaaataaaagtcgactactccggcaatcaataacccacctataattactaatcggaaataaagaccactaaaatcagaacctcttgccaatcttcttgcaaacaagtaaagataagtgttttttgattctcttttaatatgagtcaatataggatccaaatagcgtcttcttttgatctttgccgtaatttcaggaacatctgtgaataaattgataaattgatagatctgatgcaacctatgttcttctacatgcaccattttctcccaatccaatcctttttcttgttgcttccacaaaaaccagtaatatagacttgcctgtactaatgcacctgctattcctgcccatattagccaataaaatgatagaaacaaaaagatcagagaagaaaaaaaccagcctaatttccaataacgaataacttgttgatctagtcgaaacaattctgctctcttgatttgcagatgactgaatttcaaactccataatatgatcagatagacgaaaaacatcgaaaaggattgctccgtactaaccaccactaatggcatggccaatccgcatgccaatatcaaaaagatcaacggaaaaatgcaagaatagcgaaaagctcgttccaaataggtttgcatttctttttctttaggaagtaaaaaaacaatatctgctgcctctgcaaaagtagccatcttacccacgaataaacagagcatccaaaatacagagattatgagccctccaattgcaaacggtggctgcagggttttcaaccaattagaataatataatcccacaccgccaatcaagaaaagacaaactaaaacaaaatgatcgttcaatacataacgcatatatttcatcattttcttttgatgtcttgctaaacgtttttgaaaaaaactactcatgtgcctgctcctttgttaaagcaatatagatttcgtccaaagaagaatccggcagctgaaattcttttctcaacatctcaagagaaccgtctgctcgtatctctccgttatgtaagaccacaaaacgatcacaatatttttctgcagtagctaaaatatgcgtagacatcaaaataccggctccttcttttttcatttctaccatcaattcaagcaatgcattgatagctagtggatccaagcctaaaaatggttcgtcgatgatatataaagaaggctcgatcaaaaaggcgcataagatcatcactttctgtttcattccctttgaaaaattagctgggaaccagtcaagacgattagataaccgaaaagtctccaacaacttttctgctcttttcattgctatatccataggtatatcgtaggccatcgcagtgacttcgatatgttctctcaatgtcaattcttcatataaagaaggagtctctggaatatacccaatttgtttgcgatattcttccgtatttttctttaaggatagatgattgatttctatcgttccttttgaagcttccagcagaccgataatgtgcttgatggtcgtacttttccctgctccgttcagtccaatcaaccctactatctctccaggctgtacatcgaaactgatatcttttaacacagggagatgtccgtacccccctgtgacatgatcgataattaaactcattctttttcctccgccatttatttttatttattataccacgaagaaaatgacggtattttgtttttttccttacaatagctttaacttatggtaaagttaagctgaagtatttattctttatagaaaggatgttttatatggaaaactgtattttttgcaaaatcatcaatcaagaaatcccaagctataaaatatatgaagacgacaaggtctatgcttttttagacatctctcaagcaacgaaaggacacacattagttgtgcctaaacgtcatgtagcagatatttttgaatatgatcccgaacttgcaggagaggttttttcgcgtgtgcctaagattgctcaagcattggaaaaagcttttccagaaatgaaaggtcttaatatcttgaataacaaccgtgaactagcctatcaatctgtttttcattcacatatccatttagtccctcgctacagcaaagaggatgatttttctattcactttgtcaatcatcaagatagttatggatcggaagaactaaaagctattcaagaaacaatcgtaaagcaggtgtcctgcgatgattaaaaactttttcaaaggactgttatttggagctgctgctggcactgtcggaggtctgttattggcgcccaggagcgggaatgaaacaagaaagaaactgatcgaagaattggaagaagcaacaactctgacaaatgatttaaataacagcctgaatcattttaaaagcgcattgatcgaaacaaaagaaacagctgaatctgtgattcctgctttccaagaagcaatcaaaaaagatatcgaagattttaaattccaagccgaaccacgtatcacacaaatcaatgaacaagtagaaaaactaaaagctgatctgccagagtatcctgaacaaatataataatgattattttctcaacagatttaactatataagtgagaaaagtttgcgtatttcctaggaatgtgatgaaattttgaattttgtttgaaactaccacgacaacgtttttaaaggaaatgggatatggtatagttaatatataaaaataataactaattacaggagtgcaaattttaatgaaaaaaaaatcaattattttggcagctactagtgcgttggctgttttaactctagcagcttgttcaggcgatactaataaagatatcgcaacgatgaaaggcggaacgatcactgtatctgatttctatgatgaagcaaaacttgaatcatcgaaccaatccttagtacaacggatgatcatttataaagtattcaataacaaatatggcgataaagtaaccgataagcaagtggatgcagaatacgacaaacaagcgaaatcattaggtgatacttttgaatcacaattagaagctgctggatatacgaaagatacttataaagaatatattcgtaacaatttagcttttgaagctggcttgaaagctcacgtagatattacagatgacgatttgaaaactgcttggaaatctttccatccagaagtagaagcacaaatcatcaaattatcaagtgaagatgaagcaaaagatgtgaaaaaatcagcggatgatggagatgatttctctaaattagccaaagacaaatcaactgatacagagacaaaagaagatggcggtaaagttaaattcgactcaacgacaacaactattcctgcagaagtaaaagaagcagctttcaaattgaaagacggtgagatctccgatgttattactacaacaaatcctacttcttatgcgacagaatactacgttgtcaaaatggtgaaaaaccaaaataaaggcaatgacatggataaatacaaagatcaactaaaagatatcgctactgaaactaaactaagtgacaatgcattcacaactaaagtaatcggtgaagaattaaaagatgcaaatgtaaaaatcaaagatgatgcctttgaaaatgtgttgagtgcattcacaacaacttcatcaagtacgaaagactcaagtgaaactacagcttcaacaaagagttctgacacaaaatcaactgattcaacaaaagaatcttcaactgaagaaacaactgattcatcaaaataaaagaaaacaaaaaaagcgaagacttatgtctcgctttttttgttttgaatgaaaaaaataaatttttgctataaatcttttggtacatagaaacttcggttgtccataccgaaaatccgatcggtgtattttcctggttctgtttgacgaatcgaagtcaacatcatctgcatcgaagcatcgatattgtcgatttgatgtaatatttctgcttccattattcttggacgtacaggtgagccatattctaataagccatggtgtgctaaaaccatatgacgtaatacgagaacatcttcgtcagcttcgctgattttcaacgcaagacaggctttagttatttcttcgtcaatcaataccagatgaccgatcaaatttcctgcaagcgtatattctgtcgacataggaccggaaagttcaatcacctttcctaaatcatgcaaaatgataccagcatacaacaatgctcgattcagctcaggatattcatcggcgattgatttccctaagtgaagcattgtcaaagtatgataagctaatccactggcaaatgcatgatggtttctttttgctgccggaaactcaaaaaattgtttttgatatttattaagtagatagcgaacaatacgattccaatgcgcattggtgatctcaaacaacaattgattgatttcttcttccatttcttctttcttcaaaggggctctttccatgtataaactaggctctcctggctcatctacccttgttaagcgcatatgaagaatctttacttgagggtttccttgataaacctctcttttaccgtttagaaaaacgactgtgccggctgtaaatttattgatttcctcctccgaagcatcccagtatttaccatcgatagtacctgaagtatcttggaaagtaaaagcaataaatttttttccgtttttagcgattcttacatctgcacttttgatcaggacaaattgttcaaactgctcatcgattactaaatcacgaatttttttcattatttgctccttctaattgttttacgatttggttcatctcatggtaatagcttaccatttctttatcagaagaaaaacaaattatttgatacttttctccaaatttagctaaaagttcagctaattgatactttcgctgatgatcataatgaagccagccatcatcaatgatgatcgggcatatcgaacggttagcttctaatgagaggtaagcaaatctcatcgccataatcagctgatctttcgtacctgtagataactcatagatgggaaattctgtatatccgtctgttaaagtcagtgtatcatttttcagtaatatcttctgataatttccttttgttaaaatacctaaataatcacctgctgctcttaacaactggggtaattgtctttcactcatctctgttgaaagatcacctaagaatgtcccggcgatttcaagtgctccccattcctccagtaattcctgtaattttgctttttgccggctagcttgttgataaagttcgtccaatgtgccgtctctttgcaactcttctacttgaagttggagtcgttgccgattttcacttgcttctttttcttcttgctggagttgggattgcttttctttcagttggcgcagtcttacagataatttctcttttgtcagctcttcaggaaatagtggagtaagcatttccgataattcattgtatcttttcatctgctgttcggcttgtttggctttttgtaaaaagacaggtacttccgaaggataagataagcctgcttgagtcaattgttcgctgtattcttgtatccatactttttgtttctttttcaattgattgatttcttgcttcaataaagtattttgctgatagcttctggcaaatttcatctgttccatctcttgtataaaacgggaaagcaataccattttttctgaaattgtcttatcttgtatcggtaaccattctttaacaaactcaaatttttggtcgatttgtcgtagtttttcttgtatttcctgttctcttttatgtttccgctcaaatacgccatataatttctgataatctatgacttcctgtccatattctttcatgagtttgagcgtatccatctttcctaagtgccgatgatccgcaaaacgatatacttcttgctgaagaatctgtttttcttctccagttctcttttgtttttcttctgcttcagctaattgagctaaggctagatcaagttgtcctagtttttcttgccacattccttttatctcagagaaatcatttttagttttaatttttggttgccttttgtagaagaaatagccaatcatgcctgcaccaattagtaaaaggatcactttcaagggcattggtacaaatatacctgcaatgattattgctccgccagccatcagcatatacggtttagatgaagagactggtgctatctctgactgattttgtaataatgctggataggtctcttccaagtcattcacttctgcttcaatcatctcttgctgttctttagctatttggagacgcacagaaatctggctttctagatcagcaatccttctttcttcagccagaagatgcttccattcttcttcatataaaaattcttccggtaacggatttttctgccaatgccacctttgttccaaaatcttcaattctgaatttgtttctctagtctcaatttgtaatctttgccattcttcgtttaattgttccgctgtaaattgaagttgctggagatcttttagttcctgctcctgctctaaataaaaataatatctggctgactgctgatccatcccgctatgcttttccagtgttgcttctaattcttccaaacgctcatttgtttgctgataccgtttggagaaagactccagatctaaaagaagttgctcatcaggaagacctgtagtgctgttttttttgagagattgccattcttcatataaagaaaaattaagttcttgctgtctggctaatgaaaattgtttgttcgcctcttttaattgtgccaataactgctgctgttgcgactcgtattcctgttcttgttggatcaacttgccaaaataagcttcctgttcttgtttttgatgaattttttcttgcagctctttccattcatttaatttttgattgattagtaatttttggccttttttcttgaataattgttgtgctttctgataatattcttgccgcttttggaatacttgagaactgcccgtgatgcctaaagaaatcagcgcatcatgtagctctttttctctcaaatgatctagttccatcaactgctcttgctggaaagtaaatacctgctggaataactctttcgtcaaaggtgcgatcagtttttctagtaactcatcacttcccacttgatcccccagccacaccttcgattttccgcgattttgctgcttgtagcgctcgacagcaaattcaccatatacaggatgtttaagccatattttgccgccataggctgagccgtcttttggtgtataatccttttttttacggccttttgaagggaaaccaaataatattgcttgaataaattgataaatcgttgattttcctgcttcgtttcccccatagatcagctgattgcctgaataaaagtcaaaacttttttgacgccattttccaaaagcagcaatctcgatccttaaaatcttcattcctgatcctcctcaaataaaaaatcttgattaagcagctgcttggctttttcaagtgtttcttcttgatattccggcagttcgctcaatattctagccgcttcttgatgactatatacttcatttaaaatttgttggaaatcttgaggtgtctgatagtattgaaataactgttccatcaatttagcagaagcagcaagtggggtcttcgtataaaaagtattctctatgagagaaatacgccaaataaagaaatcatttatcctatctgagaattcctctaacaaatagtctaatagctctcctgattgtatccgttccaaaacatctgtattgagatggtcataatcttttaattttatctcaattaaactaaatccatcctctacttttgaaagctgctgacgaatgtgaacaatgacctcttttgtcgttcttgctttcctcaatgatatttcctttgtcttccaatagacctctgctactttaatcggatgtatttggcaacttcctttacttaattcaactagtagaatagatgtagaagcttgttcctttttagtatgaccttgaggcgcacctggataaacaattgtttgcttttcatttaagaccgttggcacatggatatgccctaaagcccaataatcgtatcccttttcttgcatctttgagggttggaaaggagcatagtttcctttttgagagacgccaggttccccgtggtacaacccaatatggtaatctgtgagttctctagaaggaaattccatcactttgtctttttgaatccacggttgacgataactaaatccactgagagagacagtttctccactttttatcgttattttttttgtctctaccgtttcggatgtaaataaatggacatttttaggaaaggagaaccaataccgctctttttgatagaaatcatgatttccgaatattataaatacaggtatatggttcttttctaaccgtttcatctgttctgaaaaatgtttctgtatttttaatgaaggacgattttgatgaaaattatctcctgcaagtaaaacaaaatcaacgttatttattattgcctgttcaatgatatttgataaaacggtcagattcgtcttcaatagtttttcctgtacagttttatcaagagttgtcagtccttcaaatgaccgatccatatgtaaatctgccgcatggataaatttcaccattaaaaatttcctcctttttttcttttatcataccattttcaatgttttttttcatcaataaccgaaaatttgttcgtattatgcaaagaaattacgataaatggccgacttcaaaaaataagtttattcgaaaaaaagattgtgacatgatttttgtcacaatcctaaatatctatgttatattcgcttcgtttgacactgaagaagtactatttgtactggaatttatgctccatttttccgtatttagaattctatgttctatactaccttaattagtttatatggtaagaattctttcaaatgcttgagatactccgtctttatcatttgaaacagtgacataatcagcttttttcatgatttcttgatgactatttcccattgcaaaactaatatctgcactttcaaacatagataagtcatttaaactatctccgatcgcgattctcaaaggtttctttaaattgtagattgattccaaacgatcaaacaccacacctttagatacattttgaggtacgatttcaatatttacaggtgccgattcagtaacagacacatttagcatctttttcaaatggttaaatatattagctttcaattgacgattaggaataaaaataaaaaatttgtaaatgctgatagcatccttttctataatttcctcaatattattataagggattgaacaaatagatttttcatactcaagctcatagtttagctctttgatagaaaattcactccctacctcgtgaaaaatttttttcattttatttttataattctgagattcataacttccgagatttgtatatattttggttggaaatttcgataggacagaatcaattttttttacatcatttttatcgaaggaagactcaaatatctttttttctccatcaaatccaacagaaccatttaaccctactgctggtatccttaaaccagattttttgagaatattattaatgtcttctacttctcttccagaacaaatgaatggaaaacagtcttccggtaaatgtttcattgttcttgcatttttttgactaatgctctggtcagaattcaaaagagtaccgtctaaatctataccaattagtttcatttcatccatgtctcctatacgttgattataaattcactgcttattgtaagtctaaatttctcacaaaacatatactaattatacctaatttaagtaagtacaaacatcattttaagaataggaaaggacatttatatactattctctgtatttttgatttataaataaatatgaattgaatccaaatcagctatattactattttataataaccaactataaaaaacgaagttaggtgaaaaactaacttcgatattcataaaagactctattagttcaacttagcaaaagatttaaacaaaaaaagatgaactatttctagttcatctttttgcctttgcgtggcgacgtcctactctcacaaggggcaacccctcactacaatcggcgctaagaagcttaacttctgtgttcggcatggttacaggtgtatccttctcgctatcgccaccacactgtggtgttatcttttattgagtaaattttgttcactcaaaactggatttgaagtcacataagtttttttccgagttcttttcttttaacctattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgattagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctgtcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcgacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaactaccatattggagtcctacaaccccaacaagcaagcttgctggtttgggcttttcccgtttcgctcgccgctactcagggaatcgaattttctttctcttcctgcaggtacttagatgtttcagttctctgcgtctacctcgaatgtgctatgtattcacacaatcgtaacatcctattaaagatgttgggttcccccattcggaaatctctggatcatagcttacgtacagctccccaaagcatatcggtgttagtcccgtccttcatcggctcctagtgccaaggcatccaccgtgcgcccttattcacttaaccttatcaaccttacggttgggttttgatccttcttctagcgatagaagttagatcaagaaaataagcaattgaacttattaaaaaactctatccagctcacaaatcagcctgtacggcaaaaagatcgatcgtctcataaaatcaaagattttatggccgtccgcctattttgcttcaggctaaacaatttgttcagctttcaaattcaacgcggtgttctcggtttgtattacttacatttacttcaaatatccagttttcaatgaacaaaagtatttgagagtaaacctctcaaaactgaacaaagtaaaaacaaattgtgtagtctccgtaatattccttagaaaggaggtgatccagccgcaccttccgatacggctaccttgttacgacttcaccccaatcatctatcccaccttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcgactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgcatcgtggccttggtgagccgttacctcaccaactagctaatgcaccgcgggtccatccatcagcgacacccgaaagcgcctttcaaatcaaaaccatgcggtttcgattgttatacggtattagcacctgtttccaagtgttatccccttctgatgggcaggttacccacgtgttactcacccgttcgccactcctctttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaaaaatgtttattgtcttgaattgaatcaagacgccctacacatttggtttgtcttactttgttcagttttcaaaggtctacttcatcgagagtgtttcccgattcatttttggctgccgtagcaacttttatatcatatcagagagacaaacgattgtcaactcttttttaaaagtttttttcgatttcgtttttcgaaatctttcagcaactcatttatcataacttatcgtttgttatttgtcaagaacttttttgaagtttttttcgatagaatcaagcttcgcaagtggttctttttaacgacttagttatcttatcacgtctaaaaacatgtgtcaactcttttttggaattttcataaaatgtttcaatgaagcgcgacaacgttgtttaatatatcattaaaaaaataaaggtcaagctaaaatattatttaagcttgaccttattataatttcaacgattgtcaaaagtattgtttgcagctgtgttgccagtttctatagataaatcacagcttttgaaacataagttttgtactgcttcgattcgcccgaattcttttgcagttatttggcaatgagaaaagcagacatcttctataggcttttcaggaaatgctactaaatcaaaagctcgggaaggaagtgagtaacctggagaaaggcatgcctgtacgtttttgatgtgtatgtctttgactttcgtcatttgctttgattcaggtatttcttcagccactgcttgccaactttctggcatttgagcaaggtcattgctattttttctattgtattcattatgccagtccattatccaagaaaaaggaaatgtacatcaatcatattcagattttctaccctgatattttcgatcactccccctctttcttttgaagatttcattcgaataccacagtctgactgaaaaaaatcgatatcgtgaatatatacgtcactaactccagcactaacttcgctaccaatagttacaccgtatcctgaacggattttacatctagcaacctcgattcttgatgattttcgattgactcttgcaccattgccatctctgccagacttaatagcaatacaatcatcaccacaggccaaatcacattcatagacacgcacatttgttgaagaatcaatatcaatcccatctgtacttggtccatcattgttgcggatgattactttttctactaatacatcgttagaataagtgatttgcaagttccaaaaacctgatttctgaaaaatcaaatcacgaacaacaacatgttctgcatgatacagtaaacaagcgcgtggacgtttaatagcataatccgcaatccaacgaagtcccttttgatcgtattcagctcttgtcccgcttttttgatcttttccccaatacagctcccaccaatggtctccttgaccgtcgattattccttttccttctataagaatatctttcgccgagagaacattcaaaatcgctgctggccatttcatttctacgccggctactcgtgtatcgatttctggaaatgcttcgatatctgttctccccttgaggactgcaccttcttcaaagataagatgactcttatcttttaaaaaaagggctccgactaaataaatgccttttggaataaatacaggtaagtgttctttcgcaccttgatcgattgctttttgcagtattattgtatcatcttgttgagtgtcgtttgttttaaagttcaaagcattgataatccctttttttgtccgcaatacgtttctccctatctttcattgatttttttcaattcttcaccaataaatacagtttttgaacgattcagtgggtaacctactagcaaaatgattgcggatacaaataagcagaatgctggtaacaagtttgccatcgtataaatcctttcttgtactaaaactgattggatggctccacctgttgtagacgattggtaaccaatgagtgccagcataaatccgcctaccgctcctgcacatgcttgtcctacttttctcgcaaaagaatttactccatatactgttccatcttctcttaagcctgtcttatattgatgataatcaatcacgtcagtaatgaatgcccagaccatcaaattgaataaaccagatcctaaagtagcgataaataaaagaatcagatatacccatgcatttgttatatgaaggaaatacatcagcaagtacatacatgaagaagcaagtaacgcaaatacgcttgcttcctttttaccaaataattttgtcagctttgtagcaaatggtgctaaaactactactgttccgtaagtaaataaaagagcaacagacattgcttgtttattatggaagtaatcattgaataaataagtcatattcgtcccagctaaaatctgattgatcacaatgaaaatgtcaacaatgactaaaataatcagtgctcgattagctaacaaaccttttaccaactgagaagcagatactttttcgtttttgacaactcttactctttcagtagtcaatttacaagttaacatatatgcgacaaatgctattgcagcacatccgattgaaatccaaaagaaatgattccctgaaacgacttgttgtccactcttgttatgggtatacattaaaatcggaatgaagaatcctgtagttgatccgccaatcgcagaaccaatgcttcggaacgtggacaacgaggtgcggtcattaggatttgagctaattgctgctgccattgctccatacgggatattgattgttgagagaaaaatcccataaacaatgtatgaaacaaaaatataagcaatcttcaccgtcattggaagatgttggacgaatggcaaaaacaaaatgacagtcactaagcaaaatggatacttcatttttctgatccaaggaataaatcggccagtttctgttaactctgagacatcacataatcttccaaccatcacatcagcaaacgcatccaaaattctcgaaatcaagaataacgtacctacgattgcccctgaaacgccaagaacattcgtataataaatcatcaagaaactattgactaaacctaaaataaaacagttacctagatcaccgaacatgtagcctatcttatcggaaatcccaaattcctttttttctttttttattgtatttgctgtaacagcattttgtgaaagcatttgaattcctcctacctcttctagtaaacgttttcaaaattataactctttttttcttgtttttatattcacaatgttggctttttattgcattatcttgacagataaaaaacaaaaaataatctaaaaacattgatgcataagattgataactttttttacataacaatatatacaaacaaaaaaattcactaactagtgaaaataagttagtgaacctcatttattaaagaattaaattacagatgatcttttccatcatacttgaaaaactcaaaatcagcataacttcctctttttttatttagatcatgcactgctatcccgataaaatttccagtaaaccctcctgagagtatacacatgtttttttgcggacctactttcttccattcttcagttgatacgtctttcaaatgaaactgtgctgtctctttctttacagtgactttcaaaaaagtcttcttttctgtgagtggaatcgtccaatcttctatttgtgctactccgttttctgattctatcatacgtaggcattttcccttgtcctcattccaagtaacataacaataaatataattggattcatttaagtacagtaccagtccagccatctgattaaaattattaggcatgtattcaaatgctgtctccgcatcaaaagtaaaatccgtttgccgaatagctaacaaatgatgttcgaaggtagattgaagagattcaccggaaatcagacgtaaaaaacctggtctacattttgtatcacaccaatcagcatttggcaaaatgcgtctggcattccagttcttctttagctctccttcaaatgtatccataaactgatgatctttttcttgttgtacctcttcatttgtctcaatcattatttcttccatcggagttgtctggctatctttaagtcttaaccaatcgtcggacgtccaatacacttcttgaatagcggtttctcttcccaaaatagccgcaccgtttaatggtctggtacaaagatatgtcatgtaccatcttcctgacggggtttgtactaagctcccatgtcctgtacattgcaatgtagaagcaggtttgtcactagctgtcagcataggaaaaccaggatcaagctcgtaaggaccagtaatattctttgctcggcaaactgtaactgaatgtcctcttcctgtaccgccttctgccgtcatcaaataataatacccgttacgaaaatacaaatgtggtgcctccgttttcgctaattctgtacctgcaaatattttatagatgggaccatcaagcttcttcttctctgcatcatattcttgtaatacgataccgctggatttattcggtgtgtccagacgataatcccatagttcattgacaagccatttttttcccgtttcaagatcatggaacaaagaaggatcaaagccgttactatttaaataaattggttcggaccaaggacctgtgatctcagatgcagtgatcaaataattgtggacatctttaaacggacggcctgcacttttgacatctgtgtaaacaagataaaacaatccatcagcataactgatctgtggcgcccatatacttccatttgtaggatttccttgcaaagatacttgagtggtcaaaatatccgttgtatgtgaccagttgactaaatttttcgactcatatactcggattcctggaagccattcaaaagaggagacaataatgtaataccgctctttcactcttaatatattaggatctggattgaatcctcttaaaataggatttttcactttgatagtctgcatgattcaggctccttttctcattcttactcgatataaactgaatgccccagctgcgaaataaaaaaatgcaaaaggaaacgcaataaactgagtgccaatcaacaatatgaatcctgttataaaatacaaaccagtggcagttgttaagtattttcctttagcagtcaaaaacaatgctactgctaaaaaagcaagtgaaataaacaacacaacggcaaacagaccagtcatgtcctgtaataatccaaatgtattttctaaagacaaagttgaatgatctacagcaagcgactgataactttttttaaactctgacgcagacatattacttaaagtaactgctaacccgccaaagaaaatcaaagatagactgccaccgaccattcctagcaatagttcccattttcttttcatttctgaaccccctgcttttctaaatgtatccattcaggtcttttgatcgatgtttcataattgttattacgttcagagaatttgacagtctgttcatttttcttgtcatcccaattatcccaaccagttgggtgaacatgcccacctatcttacacgcttcaaataagacatttgcatacggacgccacggtcttcctaaatagacgtttctagtatcaggttctgcagtcaaggtacagctttcaaaacgataccctgttttttgatttttcggcgtagatgctgctgtgatgtatccaggatttttactggctaagctatggatatgacactgatgaaaaacggcatctgccccaccaaatatgaaatccaccgttccttcaatccagcaatattcataggtctgacgacaatactcaggattggcagaagccggtgtacaaaaaggagtaccatctttttgcaaatcaggcaacggacccgtgcataaggtatcctgataaccagatagtcgacagttttttaaagatacgcgatctcctgaattgaataaagcaacagcctgtcctaccttttctcctggacctgctgtattttcgatgtgaagattttctaatacgacattcgatccttctaagaaaaaagtagcacttcggaaagtccctaactggctaccgtcaagatactcctgttttgcaaaacgattaccggagataactactgttcctgctcccacaagtttaaaattggataatctgctttctatatattcatcatatcttccttcttttactatcaagacctttggatggctatccggcaggcctgccaaataatcgattccttcttggatagtttcaaaatccgtcggggtatctatagcattctttccaattatcagtttgtctttcatcctcataaatgctcccttatgaattgtttccaaatatttctcatttcttgtgtttccatatgaccgcctgttaaagaaaaagaagaaaagttttctggactacccattgattgatactttttgtccagcccttttctcagcttcagtacgccttcgtccaagcacatcgtatcgttttttccaactaagctaagacgagggcgcggagcgattttttcttggattgctaacgttgtataagctgtcaatagatttggcacatagtaataaaacccatgatgatctaggcggcgatgtagcaaaagtatttcgatgtccacctgtgccgctagatcaatacaaactttgacacgagaatccaatgctgtcacccaccagcttaataagcctcccatagaaagaccaatcgttgcgagccgttgagtatctgtgtcttcccttgtctccaaataatcgatcaagctgatcacatcataaatacgcattccccataacgtttttcctgttaataaaaattgtttgaacaactcgctttcagaaatacctccgcgttcttcaaatccccaagcatcaatcgaccaaacagcatatcccattcctgtcagtacttctgcaaaagatggagaagctaagtaaggagcaccatggatcaattcacttttcccgactgaaaaatctccgccgtgagaatgcaggtaaaggaccggcggaaacggtccttctttttctggataagcatagagggctggtactgtttccaattcatttaagtacaattgatagtattcaagcataaaaccgttttgtttttctcggtataatcgttttccactaggggtatgtctgctagatggagcacctaaaaaatcattcaactgcataagcaaagtttttacgaacaaccagttcatccatattttctgattgatttgattggaatttctcaatactgatttctttagtattttctaatagaaatgctggtccctcgtgattttcaatcgacatctggttaaaggaaaccttacccgcaaagccaatataaaatccttgtctgctcatttcctctattcctgtcatcatagcaggaacaccgggaactgcatcttgggccatcgagacatcgatattgtcaaatgtgatttcttgtatgaattgttccgctaatccataaataaaacctgcagaagcatggacattccttgccgtgatattcgaaaaatggatccttctgaatgctggtgtccgttcatctatcggataagcctttttttcccatacatacggttctttccctcgcggaccacagaaataataaagattcagtataaatggacacatcacattatccatgactatattggatactcgaatatcttcaacgatcccgcctcgacctcgtctagatttcaatcgtattcctcgatcagtttcttggaagatacaatttgaaatggtaatattacgaatactaccactcatttcacttcctaatacgacaccgccatgtccatggaccatcgtgcaatttgtgatcgtgatattttcgcaagcgatcctttcgtacgtatcttcagtccctgccttgattgcaatacagtcatctcccacgtcaatatggcaattactaatacgcacatttttgcatgattctggatcaattccgtctgtatttggtgaatccgctgggttcaagatcgtcaagttatcaaacgttgcattactgcaaagaatcgggttgatcgtccaacttggtgactggatcaatttaatatctttcacagtaattcgatgacagttatggaaactcatcaatttaggacgaggataagcgagattatctggttcatttctaaaagtatgccaccatttttttccatttccatctaatgtaccgaaaccagtgacagagatgttctctacattttgagcatagatacaggaagcataaacttttcgatggactccttcccaacgtgaatgaacaacaggataatcttttggatcgtcagagaatttcagaaccgctcctgcgcttaaatgaagttcgacattgctttttaaaaataaagctcctgttagaaattcacctgctggaacaactacggtcccgcctccgtcacttgctgcagcatcaatggcttgttgtattgcttcagtattcaattcatcaattgatgcgccaaatgtcaaaatatcatacatatttataatgcctccacttcaatcaatgcttgcaagaatgcaccaacgcctttttgatcattacaaataattggttcactgatgtagtaagcatatgaaccatctcgctgatctgctccgcctaaccctgctacttgacagtttttattcaagttcagccagccttcttttgtttccagaacaaattcatcaagtaatccttgatgtgatttcttcacttgtggaagccattcttctttgttcagcagtcccaaacgtattcctttagccattgcgtaaacaaacatactactgccggaagcttccagataatttcctttccgttttgtttctgttgttacttgataccatgtcccgctgttttcttcttgatatggaagtaatgcagccagtgtcttttctagaatttctttcagcaaagaacaatctgtttcttcatgaagtaattcataggtatctgctgcagccatcaaataccagccaatcgatcggctccaaaaatgatgggatagacctgtttttggatcagcccatggttggaccttcttttcatcccatgcatgaatcagcaaatttgtttttggatcgaatagatgtttataactgatttcaaactgtctcaaaacatcttggtaatctttttcttcactaaaattctggataaattcagcataaaaaggagaacccatatataagccatccaaccaaatttgataaggataaatttctttatgccaaaaagctccttcggatgtgcgtggatggtttgccaactgctgggaaaggagttctgctgcttttttatatttttcttcgcctgtttctttgtacaataaaaagaaaagctttcctgtatttacatggtcgatattgtattcttcaacgctgtagccacggatcgttccatcttcttgcacgaaatagtcgatattgtcttttatgaaatcaaaataaattttttcttgggttcgttcccaaagtaattggaaccctttaagtacgacgccatagtcataagaccattttcctttataccacttttcttcatataagcgaggtgttctttccatgatactttttgctaatttctttgaccagttttccattatttgctctcctttaaaaattaaaataggatttgggacaaataccaagaagtatttgtcccaatcgtctatattactgtgccgctgctttgtatgcttcctcgtactcttgtgtgattcgatcgcctccttgtgctttccagtcttctacagcttttttgaatccatcttcgtcaagctgtcccatgatgtattgcaccgtagcatcaatgacgattttttcaatttctgatcctacttcattgttcgtcggtgaatccaatggcacagaaggatccattacagcaaattcttcattttctttgatcaattgattagagaattctttttcagggtctgtatctttgaaagagaacgtcacttcactaggacgagagcttgataacggttgcacctcttgttgccaaagatccatatcgataaattcgatagaaccatcatcattcaattcataatgcgttccttcgataccgccagtcatcaatttatacacatcttcttctaaaagatcatcaacaaattgaagtaatttcttcaattgtgcttcgtcttttacttgagatttgggaaatgctagcaagccgccaataccatttccttctgaccaaacatgataaccgccgccttcaccatctgagatcttgtttacaggcactaattccatatcatcttgaataccttgacccatcgtcttcagattcttgatatccaccattccagtgtagattccagttcttccttgtgcaaattgttcttgctgatcagtcttttgggtaactgcaaagtcttgtgccaaatagccattctcaaatagatctcttgaaaaattcaaagctttcatatactcttctgtatcaaattctggagtgaatttgccattatcgtctacagcccagccatttggtgctccaaaataagaagtgaaaagtttaaagctggtataacgaatatcactaggcgcacgatcgccaaaaccaactgtgtcgtccacaccatttccatcaggatcgttttctgtaaattgtttagctacttcataaagctcatccatggtagttggaacatctagtcctagattatccaaccagtcttttcgaatgactaagccagcacgagcgtagtctttttgtatcggtacgccgtacaaggcaccgtcgatactcgcagcttcgattctatcttcagaaatttgacttaaatttttatagtcttttaaatattctgatacatcccagaatacgcctgattttaacgcattgcggacagaagagtttttcaacatcgcaatttgaagtgtaacgatatctcctagttcatcagaagccaatgcagttgttaatctttcttcttttgaagcatcaggaatccagttgaatgtcagttccgtatcggttttttcttcgatcaagttcacaatcgtgtctgtaggcggtgaagcatgatgcaaaatatttaaccaagtgattttagcttttccatcttctgtctctgaagaactgttacttgaactgctgccgcatgcggcaagtgctagaattcctgcaaaactaagacctaattttacgagcgttgcttttttcataaattttctccttcactgttttaataatatttttgttttcttctgttttttctgtatatgagttcttccattccaaatggcaaaatatagaatttgctgtccacgtgactgcggaaaagaagagactgccaccgataaaggttaaaacacctggcattgtttggatgatcatcagataaatccctaccatacttaatatcaacactaatgagtaatgaagatgtgagaatccgaataaaaatgccattttcattttgaaaaaatatcctttccaatcataatgagccatgattgggaaaatatagagtgctgagagcacatatatgaacgcagcaatatacaaagcgatcctaagataccaattgtgtatgaaagaaagatccacaagtaaaacaatcccgatggcgccatatatccagctcatcagcaaggtttcacgatagttttctttaaaatatgtgaagtacgttttcgtcaaaggaaacgtttcttttgagcgcagccattttctaatcactgcaaccatcgcatacgatgcaggaccgaaagtaaaaactcccaaacctgcgatgactaaaccgccccacagaaaattcaaataaaccaactgtaaaatacgatttagccttccgtttattttatctaatgactgcagcatatctttccctctctttctatcttagtaaacgccgtcttctcctagctttttggcaatcttattagctaaaattaccataaacaatcctacgacccctttaaacaatcccattgctgtactgaaacttaactgtccattcttcaatccagctgtataaatataggtgtcgaaaatttctgcaacgcttcgattcaatgaattcaataacaagtacatatgctcgaaccctaagtctaatgtctgaccgatttttagaatcagcaaggtaatgattactggacgaattgccggcaatgtaacatgccatgttttgcgtaagcgtcctgctccatccatttctgcagcttcatacaactgtgtatcgactgcagttatcgctgaaaggtagatgatcgtagaccagcccaactctttccagatcacttgtccgatatatactgtgcgtgtccattcaggggatgttagaaaactgattttttcaaatcccattgttgcaaggaattcattcaatacccctccgtcaacattcaaaaatacataagtaatcgaaacaatgattacccaagacatgaagtgagggatgtaaatgatcgtttgaatcccgtttttcaatcgtttgttcgttacttcatttaatagtaaagacaaaatgattggcatcggaaaaaacacgaagatatttaatccgaacaagatcaacgtatttcttaataatgtaaagaatgtcggttctgtaaacaaacgaatgaaatgtttgaaaccgacccaaggacttcccattattcctaaaaatggttgataatcttgaaaagcaataacgagtccccccataggaagatacctaaaaatcaagaaataaaggactcccggcagaatcatcacatataaaaatttattcgttttgattcctgcaattattttttttcgtcttctgagcttttcttcttttttcgatagcgtcagttgaaatggttcttgtttctttacactttccataagcccctccttagttttgtgaatgtttgctgcttatgacttcatgatagataactatctgaattacgtatataatcatttttaccgtaagtaaaaacgcttacatagcaatgatttttgtgctatacaaaacgataaagtgtattttttcacaaataaactacgcatagcaaaccttctatttttttctatctgacacttagcataggaaatgattatatacgtaatctttcaccgatgataaattgaacatatagaaacagaaacatttaatttattttgaggaggagcctatctatatgaaaaagaaagtctctataggagaaagaagttttacacttttcaacaatacgtttctaattttgctagctttgatctgtatcgttccttttttaaatatcatcgctacatcttttgcttctacacaagaagtcgtcgcgaaaaagtttatcctttttcctactaccttttctttagacgcgtatcgctacattctttctacgccgaccatttttagagcacttgctgtttcgattggtgttacaggtgtcggaacgatcgtcagtatgtgtgcaacttcactgatggcctacggtctttccagaaagtatttgtttggtcgaggtttcgtcaactttcttgttgtattttctatgttgttcagcggggggatgattccaacgttcttagttgttcgttctctagggctggtcaattcttactgggccatgatcctgcctgtggctgttaatgcaatgaatatgatcattatgagaaactttttccaagccttgccggatagtttggaagaatcagcaaaaatggatggttgcacagattttggtgtatttttcaaaattatgctgccattagcgttaccgtctattgctactatctcgcttttttatgctgttacttactggaacacttatatgactgctattttgtatatcaacgattcatctaaatggccgatacagattcttttacgccaaatcgtcattgtatcaagtgggatgcaagcagaaagtagtgccgttgatgtgattccaccagcacaaacagttaaaatggctgttatcgttattgcaacagtgcctatgctgattgtttatccttttgttcagaaatattttgtcaaaggagcactcgtaggttctgtcaaagggtgattatgtactgaacgcaaaatggtagttgtgtcagaagtggtcagcttcaagaaataagaaggcatttacgaaaattgcttcttaaatttttgtgaaatttcggcttatttttcgaagaatctactcctggaacaccgtgtatcagaggttgtgaaagagacgttcagccttgagcgatgataaaaactctcacaaacattgcgacgagtaacccacaggagcaataagaagcgattttgaaaaatagcttcccatatttcacaaaattatgccttattgtcgatagcctgtctcttgaacgccatttattcgtaaaaaagaactgtgacaagacttttgtcacagttctttttgcgtgcttagccttgaaatttaactatccataaatacaaatactagggttattctaacttcttttattgcttgaatcagtccacaagaaaaacagcctcttgattcacaaatatttttttcgatattctcccggcgtaatcgattccttctttttaaagaaacgaataaaattttgcggatttcgatattgcaatctttctgcaatctcttttacggagaggttagtctctttcaaccatttttttgctacctctaaacgatgattttgaacaaaatcaccaaatttttctcctgtttcctttttaaatacattacttaaatagttagggttataatgcaacctatcagcgatcacatctaaagacagatcacgatcatattctgtgtagacgatatgcataatattctccgacaaatttttaaattcatgatcagtgattgcttgagagcattctgtgattggcagaactaattgttctaaaacaagtttttctagttctttgggatgataattgttcagtgcttttacataaatttgtttcatgttatcaaagttttttgaatctactcccaataactgtcctaattgaacgagttcattgatcaagcggaccgaaactacttcccgactcaaaggatttttattttgtgcaaacaatgcatcaatcaattcatgtactaaattcttcacttcctgatttccagaacgaatggcttcaaacaatcgattttgttcttctatcggatatctaataagtgttttttcatgagcagcaggaacgatttcctgataaaaaataattgaacttggaccagtatttacacgataatacagggcttcttttgcccgatcaaccgattgcttgctttcattcagcgtttcgaaccggttactgatgcctatactgatagttaaattcaagtattcttttacacgtttttgaatgagtcggcaatactccatgacttttttgcttgcttctgcatcatctttatccattcgataaatagtggcttgcatttcttcattcaaaacgatcggcagcattcgattttcctttggcacaatttccgtgatcatgttgttgatcgctaaaagtagcaaatcacgctccccaccgtgactatcttctaacagatcgatttgaaccaaagctgtataatagcagtcattttgagaactataaccaaattgctgcaaccgctgatctagttctcgcctttctactcgatttctaaataaactaagtacaaatagcgtttccagctgtggcttttgggtaactaagtgtgcacttaacgcttctttttctcctatgatccgactgactgattgagcgaccaaatctagttctttcccactgaatccttttgatttaagattcagacgttcctgtatttgagaaatcggacgggcaaatctgtccgaaaataagtaggaaagaagaccaatgagtcctaccagtgttaaagacactgcaactagcccgattctcagattgcggatcattgcgccaattgcactagagtcaacttctaatctgtaaatccaattattataatctgatttcagtactatatacgttttatctttttctcttatcactttcagctgattgtaatctagatccacgtccgttaatacagttggttgctctttattttttactgtctgagtagtaaaaaggttgccaacttcgttttcaatagaaagtatgtcttctccactttcaccaacaacttgttctattgtatgtttctctatcgtagcaattcccaatgcatatttttctttttcaaacattggcaaagaaatcaccatttcgattcctttgtttttcttttgccaaaataaattatttttgttatttatgtacttctgttgatacttttcaacttcctcttcggtcagttgactcaacgatccattgattactccccatttaccagccaaactgactaaatcataattattatcatccataacaatcgtttctataaaatttagttctttcctgatttcagaataagtggagtaatctgtatatgtcagcggatgcttgaatatgtccgagaaatttttggtcgaaccatacgtagaaaacgaatattcaatcgttctaattttccattcaacgttagttttaacttgcctgagcaaattctttttgtctgttaaataactcgattcgatcgattcataggtattctggtaaatgaataaactaaatcctatgacaagtacggctcctaataaaaacatcggtaaaaatattttataaaatactgtacttttcttcattttcttcctctcctccttttaaaataaaaggctttcatttttctgtaaaattgatactcatctaattaaatgagcattccccgctttcaagaatagcataattaaaaataaaaatccaagtaatttttaacgtgtgcaatcttttcatatcaaagatctattgacttatcgtagttatcgtaatatgatgaatgcgttaacaaaaagtgaaaaagtaaggaaaatgatggaatggtaacgatcaaagatatcgctaaagcagctggcgtttctcatacgacagtttctcgtgctttgaataacagcagtttaataaaaaatgaaacaaaacaaaaaatacgacaactagctaaggaaatgaattattcgccaaactatagtgcaaaaggtttagtgaatcaaaaaaaatatctaatcggactatttttctcaagtttgcataaaggaacttcatcaaatttcctagcagattccattgcaggcatccattcagtattagacacaaattacagtttatctgttgaaagtatcgatgttgttgatttaacagaaatcaacctgcaacgctacgatggactgatcgttatgagtcaaagtgatgatgatcagcctttcatcgactatctcaaagaaaaagaatttcctttcgttgttgtcaatcgtcacatcaatgatccagcggttatcaacgtcactgccgatgatgcggccggtgttatgcaggcagtagattacggtattggatgcggacatacgaagatcgcttatattggcggaaagaaaaattttcgttcgacaaaagaacgggaaaaaggggtattgaaaagtctaaaaaaagcgagcatccctgtcaatccagcctattttttaacaggagattacagcttagaaagcggcctccaaaacatggaatacctattatcactttctgacctgcctactctggttttttgcggcaacgacgacatagcgattggtgcattgagagctgtacatttagctggcctccgtgttccccagaacatttctctgatcgggttcgatgattctccagtcgtctcctatctcaatccgccgcttaccaccgtacgtaagcctttgaaagaaatgtgtcaagaaggaacaaagcttttactagatttgatcgaaggcaggacgatcgaacaatctaaaattgagctctccaccttgttgatccttcgtgagtcgatcaattacttgtaaactacaagtaattttatataaaaatgttaacgtgtgcataacacagaaaggaagtttatatgaaaaaactgacaaaagaattagtgaaaaaaaacgaagcacctgtaaaagttcttcagtttggtgaaggcaattttatgcgtggatttattgattggcagattcagcagctgaataaccaacaattgtttaaaggtaatgttgcaatcattcaacctttagaacaaggtcttggaaatatgatgaaccagcaagataatttatatacggtcattttacaaggactcagcaatggcgaaatcgttgatacttccgagattatcaccgtagtagaacaaatgatcaatccttatgatgaatgggatgcttatctatctctagcagaaaatgacgacttggcctatatcgtctccaatacaacagaggcaggaatccaattcgtggagactgataatttaacagatactcccccacagagcttcccgggcaaactgacagcctttttataccgacgtttcaaattaaacaaagctggctttaccatcattccttgcgaactgattgacagaaacggcgaacgtctaaaagaaatcattttacgctacgcagaaaaatgggatttagaacctgcttttgttgagtggttagaaaaagaaaatgttttctgttgtagtttagttgatcgcatcgtcccaggttatcctcgcgaagatgcaggtgttttcaatcaacggcataactatgaagatcaattgatggtcaaagcagaaccattcatgctttgggtgatcgaagggcctaaagaattggagaatcaactaccattcaaacaggctggcttgaatgtcatcatcacagatgatatgactccttatcgtgaacgtaaggtgcatttgcttaatggaccgcatacagcgatggtccctcttgctttgttggcggaattggaaactgtagaagaagtaatgaaagatcctttattctccgcatatgttgatcagttattcaatctagaattgattcctatgctttctttacctaaagatgaattagccatttatgctgaccaaatcaaagaacgtttcttgaatccttttgcccatcacaaattagaagcgatttcattaaatagtgtttcaaagttcagcacccgtctgcttccagtgttcaagaagtatatcgaagaacaaaatcaggtaccaccgttaatcactgtttcactagctgcgctacttcttatgtatcgaggcgatcaagtaaagccacatgatgatgaaaagacgataagcgaatttactgatgcttggtctgataatggaacagctattcctcgattattgcaaaacgctgcgctttggggagaagatttgtctcaaataccgaatgtgacagatacagttcaagaaatagctgcaaagatcgatcaaaaaggtgtccggtcagtattacaagaaatgaaaggaacgatggtccatgcttgaaaccctgcaaccaacaatgaaattaaatcgacgagacagtgtggtcgtcgcattaacccctattccaaaacaaacacaactgacgattgatcagcaaacgatcaccactcttgaagatatcccgcaaggtcataagattgcattgggtgatttgaaagctggagacaacgtgatcaaatatggctatccaatcggtcatgtgacgacagacgtaactgccggtcaatggctgcacactcataatgtaaaaaccaatctttctggtgaattggattatcgatatgaaaaagatgtccatccaagtcattacctttttgagaaccgaacatttcaaggttacttgcgaaaaaatggaaaagtagggattcgtaatgatttgtttttagtacctaccgttgggtgtgtgaatggcattgctgaactgatcgtcaaacagttcaaggaaaaacatccagatctgggacagtttgaccatattacgattttaaagcatccttatggctgttcgcagcttggaaaagatcatcaaaatactcgagaaattttagcggacgcagtaaatcatcccaatgccggaggagttttagtatttggattaggttgtgagaacaatacagttcctgaattcaaaaaaattttaggtgaatatgatgaagaacgagtgaaatttctagtggctcaagatgtttacgatgagatcgaacaaggtgtggctctattagaagagcttttaacagcggcggaaaatgaccagcgcatatcagtcccgctctctaagttgaatgtcggtttgaaatgcggcggttctgatggtctatcgggaataactgctaatcctttacttggtgcattttctgactacttgattgctcaaggaggcagcacgatcttaacagaagtgccagaaatgtttggcgcagaacaagtattgatggcacgagcggaaaatgaagaagtttttgactcaatcgttgacttgatcaatgacttcaaacagtatttcttgtcttacggggaaccagtttacgaaaacccatctcctggtaataaagcaggtgggatcactacattagaagataagtctttaggctgcacgcaaaaatcaggaagctctcctgtcgttgatgtgctacaatatggcgaaaaaatcagaaaaccagggcttagtttattgcaagctcccgggaatgatcttgtagctgcctctgctcttgcttcatccgattgccagttggtcttgtttaccacaggaagagggactccgtttggctcatatgtcccaacggtcaaggtatctacgaatacaactctttttgaacgcaaaggtcattggatggattttaatgcaggcgtcttattagaacaaccaatggaagtaatcttagaatcgtttgttcaaaaaatcatcgctgtagctagtggagaagaaacgaaaaatgaacaaaatgacgttcgagaaattgccatttttaaaaacggagtaacactttgattttcataaaacagtataaaaagaaagaaggaagatttatgtttttatctgatgattttttattaaaagacgattgggcgaaaaagctttaccattcctacgcaaaaaacatgcccattattgattatcactgtcacttagatccaaaagaaatttacgaaaacaacaatttcagcaatctgacagaagcttggttaggaggcgatcattacaaatggcgcttgatgcgagcttgcggcgtgcctgaagaaaaaatcacaggaaatgcttctgattttgaaaaatttttagcttggtgtcaaaccgtaccaaaaattatcggaaatccgctttacagttggtcacatcttgaattgaagcgtttcttcggtattgacttgttgataaatgaagaaaatgcagagaaaatttggacacaagcaaatgaaattttggcagctcctgattttcgccgtcgggaaatcgcaaaaaaatcgaatgtagaagtgatttgtacaacagatgatcccgcagacgacttgcactatcatcagttgcttgctcatgaagaaccagatttgaaggttctaccttcattccgtccagataaagcactcaatattgaaaaagaaggatttaatgcatgggtcacactactggaagaagcagctgaccaaacgatcaccacctatcaagaactgatagaagtcttagggcagcggatagaatacttccatcaacatggatgtcgtgtttccgaccacgctttagacatcttacgctataaagaagcggatgaaacagtattagaagagatttttcaaaaagcacgagctaacaaactattatcttcagatgaaatcgatgcttatcgtacagaaacactgatacatttgacccacttctatcattctcataattggacgatgcagctgcacatccatgcttatcgtaactgtaatacacaaatgttggaaaaattagggcccgataccggctatgatggaatgaatgatctttctttgactattcctctgcaaaaattattgaaccgtgcagaagaaacggatcagttgccaaagacgatcctttattcattgaatccgaatgactatcctgcgattttagctttgatgggctgtttccaaaaagaacagaatggaaaactgcagttaggttctggatggtggtacaacgatactcgagctggtatgcgcgatcaattgacacaatttgctgatggtagtgctttggggaattttgtcggcatgctgacagattcaagaagtttcctgtcctacactagacatgaatatttccgtcgtgttctttgtgaatttttaggcgaaatggtcatgcgaggagaagcacctgaagatgaacaacttttaggaagtctagttcaagcgattagttatacaaatgctaaaaattactttggcttttttgcctaattgattaatagtaacagtaacgaatcaaaaacaggatagtgaaataacggaatccgtttatccacgttttagagaagaagacggaccaaatttgctccgtcttcttctcttgctgttctgcttcattgcctataaacctttatgaaagaagagataacatgcctactatccatattgccggtgattctactgcggcagaaaaagatgaaaacaagcgtcccgagacaggttggggagaaaaaatctctgcttatttttcacccgagatccagatcaataaccaagcaaagaatggacgcagcaccaaatcatttatccaggaaggaaggttagcccgtctagcttcacagtttcagccgaatgatttcttatttgtacaatttggacataacgaccagaaaatccaagaagaaagaggtacgcttcccttcggtagctatttaaaaaatctgcagatattttttgaatgcgcaaaaaaagcgaacgtccaaatggtcttactgacatctgtgacgcgacgagattacttagaaaacggaacattgaatccagatatacttggagactatccaaaagcgatgcgtgcatttgctgagaaacaccatattcctcttttagatgtgttctcaagatcacaagaattgttccagaccttctcaaaagaagagacaaaaaaattctacctgcatcttatacctgatacttgtaaaaattacccagaaggactaaaagacaatacccactttagtccagaaggcgctgataaagttgcccgaataattgttgaattgataaaagaatcccgtctgcctcttgctaattatttacaaaaaggagtttgagatgtttccattaaatttaggcatccgtgcccacgatttagatgttcgaaatcgtgaagaaatcgttcaaaaagtatcacagcttcacttgtcccatatccaatttgcaccacaaaaagcatttcctgaacaacttaaattaactgacatgacacttgggagtgctgcctattttggtgaatacttccaaaaaaacaatatcgaactttccattttaggatgctatatcaacctatccagcaaaaatcaagaagttcgtgcacaagcattggcaactttcaaacagcaaattgctctgtgctctgcctatcaagccaagatgattgctacggaaaccggtagtgtctctgtcggttacacaaaagaaaattttactgaagaagcttatcagatcgccagaaattctatcattgaattagtcgctcatgcagaaaattttggcgtaactgttgctgttgaagcagggatcaatcatccaatctataactatcagttagctaaacgtttaatcgatgaagtagcttcaccaaatttaaaaatcattttagattgtgcgaatttgatgcataaagaaaatcatgctgatcaggaaaaagtgatccgaggtgccttggacaatttacatggttatattacagcgcttcatctcaaagactatatcatggaaaatggaaagatccgcatggtacctgttggcaagggctgtttagatttccgcccggtactgcattatatcaaatatgagcgtcctctaatgtacgccactcttgaagctactcctgagatttatgttcctgaagcaatagaacacttgcagtttatttaccaagattgttaaggagaagattatggaggaacgaatacagaaaagttatcaaaaatatcatgcaaatgcttttcagacattgctgcatctttatcagggaaattattggcgttttgccatgtcaggactcttttttattatcaaacatcttccatcttggttaatgccgatcgctattgccaatgtaatcaatgcagcttcatcgaaagattcttctcagttgcaggccatttatttcaacgcttttttgatggcttgtctgattggtcaaaatatattgacgaattattttcatgtaaaataccatagcacttcgatccgtcaagtagaagctggactaagagcgacccttatcaagaaaatccaagaactatctattccttatcaaaaagaattgcaatctggacgaatccagtcaaagatcatccgtgatgtagaagctatccaaacgttgtcctctcaagtatttgtcagcggattaaatatcgctgtcaatttattcgtagctttaggtatcacgctttataaaagtcctgttgttttcatgtttttcttattgactgttcctctcgccgcattcgttactctctttttccgtaaaaggatcagacagtccaactcagacttcaggcaagaaatggaagagacttctgcaaaagtgatcgaagtgatcgaattagcaccgattgctcgagctcatgggttagaaaaacacgaaacaactcgcttaaataagcattttactcaaatctatgaaaaaggattccacttagatatcctgcaatctgttttcggatcagtcagctgggctagttttcagatatttcagctgatttgtttgattttcactgggatattagctttacaagggcgcatccaacccggcgatgtcgtgatgtatcagacgtatttcacgacgatcgtcaattccgtttctggaatgatcacgctgattcctacgatttcaaaaggcatggaatctatcacttctattggcgaactgttgattgctggcgatgtagaaacttatcacggtaagaaaaaaatccaacatttggatggaaattttcgttttgaggatgtttcttttctttatccggactcactcaaaccgattatcgatcatttttctctagaggtgaaagctggagaaacaattgcttttgttgggccatctggctctggaaaatctacactccttaacttattgattggatttatccagccgacttcaggaaaaatttttctagatgatcagcctttggatgaactggatatgcgaagtgtgcgaaattatttagccgttgttcctcaaaccactttgttgttctccgcttcgatcaaagagaacatcacttatggcttgaaaaacgtatcaaaagaacgtttagatgaagtcatcgaagctgcgcaactttcttcactgattgaccagcttcctgatggtctggataccttagtaggcgaacatggcaacaagctgtctggtggccaaaagcaacgtatctccattgcacgagcgttgatacgtcagccaaaaatcattttgctagatgaagcaacctcagctttagataaccagtcagagaaaaaaatccagcaagccctgaattacctgacagaaacacccactacttttattgtggctcatcggctttcaacgatcaaagaggcagataaaatcgttgtgatcgatgaaggaaaaatcgttgaaataggtacttacgaaaaactgttagctcaaaaaggctatttctaccgcttgaaaaatgaatgacaaaaaataggagctatgacaagacttttgtcgtagctcctatttctgaataaacggtgttctcctgccaactcctcggtcacaagtcacaatagtcatcaaacatgagaagctgttttttgaaattgttccttgtaactcagagttaaacggtaggctcacgacctcttggtaaatggtgttcaagagacagcctatcggcaataagaagcaattttgtcatcgctcaaggccgaacgtctctttcacaccctctgttgtttcataaaatagttttattcgctgtaaaggtcgcgaactggtgtcatgatgatacggttcaagtcattgatgattgtactgaagccttgctctttttgcatcaagtcattgattacttcttctgattggattttcacagccatttcttgtgctttcattgcatcttcgtcgctgaactcttgtccactcatttgtttttcttgtaattcgatttgcatcgcttggaagtctttgaacagtttgtgtgcttcttcgtttgcttgtactttctcgtacgcttctttcaacgctttgaattctggtaattcacggatctcacgttcgatttgattcgcgctatcgtagatgtttgacatgttatgccctcttttcttttagtagttactctctattgtaacatggggttattcgttttcaaaggggctactctccttgatatttccgccagaggtctttagccgcttcaccaattccctgaacgccttctttcaccatatcgccgaagtttttcagcccttcttttgcttgttcaccatattgattcaagttatcttgccaatttccagactctccattagaatttcctgtgtttccaacttgatctgcagctaccacttgtcctcctgtggcataggcatctgctacactaaatcctgtttttgaagtatacggaaggatgccttctgccgctgatttgaagactttcccgacaacatttccacttgtcccttccaaatagtgcagcttgctggattcttcgtaacccatccatgtcgaaatcactacgtctggcgtgtaaccgatcatccattggtcatttgcttttgtggcatcgaaattagtttctgtggttcctgttttccctgctatcgtataacctgcaggattcgcagcagccgctgttccatttgaaaatgtaccaagaagcatgctggtcatttcatcggctgtttcctttgatatgacctgttttggttttttgtttgtgttatcgacgatcaccgctccagtcgaatcaacgattttcgtgataagatgcggcgtatacatctgaccatcattggcaaatgcactgtaagcacccgccatgatcaatggagatactcctttttccagtccaccaagggctaagccataatacttatcagattttgctaaaggcaggccgaattcttctgctttatcatatcctttttgtaaaccgatctcatgcaaaagccatacagtaggcaaattcaaactttgtgcaacagcttgatacatcggtacttctccttggtatgtcccgtcaaaattatgcgcatcgtaataactttgcggttcgtctttcaagatactggaaggcttgtatccagcttccagtgctggtgtatatacgcttaatggtttgatcgttgatcctggtgaacgacgcatctgtgtagcaaagctgaatcctctaaagacatgatctcctcttcgtcctactagtgcttgtacaccacctgtattcggatctaaagctactgaagcagattggaccatggcaccatctgaagcatttgctgggaataatgcactgttttgataagtagcttctaattgcttttgataatcctgatctaaagctgtatagattttatagcctttattcatgacatcttcttcatcaagaccatactcgttaactgcttcatcgatcactgcatcaaaataataaggataacgataaccagaatctgaattatcgtatgtgtcattaagatacgcgctgatatctgtctggctttctgcttgttcttgttcttttgtgatttttccgttttcttccattacacttagtactgtgtttttccgatcattcgcattttttgggtgatcgatcggattataaataccaggacctttcagcattcctgccaaagtagcagcctcagacagcgtaacattcgttgcatctactccaaaatactttctggaagcgtcttggacaccccataccccgttgccaaaataggcattgttaagatacatggtcaagatttcttctttgctgtacttcttttcgatctcgattgccaaaaataattccttcgcttttcgatcaaacgtttggtctaatgtcagatacgcatttttggcaagctgctgagtgatcgtacttcctccgccccctgatgttccgccagacaagaccattcggactgctgcacgggcaatccctttgatatcaaacccgtgatgctcgtaaaaattcctatcttctgtcgagattactgcatcttggatatagggagaaatcgcgtttaattctacatatgttcctttttgggcgtacagtgtgccagcttcttcgtttttcttatcataaatgactgtcgattggcttaatcctgattttaacgtttcgacatttgcttgttttgctaaaataaagaggtagatacttgtcactaagacacagatcaaaccaatcagcaaaatcaatttgttcacatgatattttttccagatgcgctttcgccatcgatggaattgtccgagatatggtctgatccaacgccaaaaactgatcaaagcagcttttatcttttctaaaatgctttgaaaatccatttgcttcttctcctgtctatttgattcaatcgtcttattttaccatagtgaaagagtgttttcttcctgcttaagttgtagttcaatatgtttttttacgttagtgcaagtagagtaacataagaatgaacagaaaaatgtaagttttttcttaaatatgttttaaaaatggtacaattagtctgcgattgcactgaaaggagtacacttgtgaaaatcacgatcactttacctatgaaccatcctgaaacaacaattcgcgacttgcttgaaaaggaatggttagttcctagaaaggttcgacactttttgcgtatacgtaaaaacgtttggatcaatcaacaacctgctttgttccatcatgaagtaaagggcaatgaccagatcacattgttattcgaagaaacagattataattatcaagaagttcaattaggagatgcgaagcacatccgtgttttatatgaagatgagcatttgattatagtggataagcctgcaggaatgaagactcatccaaatgaaccgacagaaaacagtaccttactcaatcatttagctgcttatctcgacactaaacagcaacgaccttacgttgtccaccgcttggacaaagaaacaagcggtgccgttttatttgcaaaaaatccatttgtcttgccgatacttggaagaatgttggaacaaaaaatgatctatcggagatatcaagccatcgtatggggagaaattgccaaagatatgaccatcaccaataaaattggacgagatcgccatgatcggagaaaaagggtcgtagatgataaaaatggtcagagcgccttgacacatgtcactgtcaacaaagtactttctgaacaaacacaagtctattgtgttttggaaaccggacgtacacaccagatcagagttcatttagctcataagggacatccgatcgttggagaccctctctaccaaaatagaacagctgaacgactgatgctccatgcattagaactgcacatgatccatccatttactcaagaaaaaatagtcggtaaagctttacctggattatgggaatagaaataaaaaagaacagagtcttatcagcagataatgataagactctgttctttttgtgtaatttgtctgcttacttttgatgttcgtgttctgctaacagcaaactaccgataatcccactttcattcggcagtccccaacgaacgatatattcacttacttgaggtgtttccatataaccacccatcaattcaacaaattgctgacggattttttgaaggagatgatcctgattcattaccccaccgcctaaaataatcttttcaggtgctaacgtcaacgtatagttgatcagtgcttgagcaatataataagcctgaatagcccaaacaggatgatcttgcggcagatcttgccctttgatccctgtgcgtgcctcaatagacggtcctgctgctaatccttctaaacaatctttatgataaggacaagtaccttcataatggtcatctggatggcgtttcacccaaatatgtcccatttcaggatgtgcgatccctgaaaaaatttcttcattgatcacgacacctgcaccgattcctgttcccacggtaaggtaaatacaactattttttccttgtgctgctccttgcttcaattccccatatgcagcagcattgacatccgttgtccaagcagcaggaatattgtagcgttccttgattgtgccaagaaaatcgaattgtgcccacccttttttgggagttgccaaaacgtatccgtaattatcttttgttttgtcgataccaatcgggccgaatgagccaatcccgattcccttcaattcataacgatcaaaaaattcaaatacctgatccaatgtttcttctggtgttgtggtagggatacttaatttttctaaaatttctccaccatctgaaaccgcacacacaaattttgttccgcctgcttctattccgccatacattcgttttcctcctcgaatccgattgtccgaatctcataaggttggattattgggacaaccgcttgcttcgttggttcttcaagcagattcaatatgacagtttttccattgtctttagttatttccaatttttctaaatgactagacatattgaaacctcttactactactttatcactaaacttgctgcgtttcaaagctgtaattgcaaacgtttcactttttatcgttaaatattgttgttttgaaatcaatgttccttcatgatgtttgatttgttgagtggaaaaaggaatctgtgctgcgtatgcatgcaaataagtagagaatttttcttctggtccatgtagttcaatgctgtaattgaaccgatgctcacctagacactgtgcttctggtgttggaaaatatccccaatcgcctagttctcccacactgcgaagtagcgtcactgcgatttgtccgtcttctgttacttcatattcattcaaaccaaagtttccgactgttacaccgtactcttcatcatgaatattgacaaatgcttgctgatgttgcggattcgtggggttttcccaacttttagacacatggtttgggcgcttcaccacttcaaaaatactatctgcttcgtgatgttccacatgtaactttgtaggaaacaagacacgtaagcgatgatctttcatctgattgtcgagagtcgtttcaaagtcgatttttttactatcttttctgattgtcatgattgtttttatttgaaggattcgtttttctttggatcgttctgcttttcgataacgaaattccacaaccatctgctgttctttttctaaacgctcgtctgcagaaacagggatttccatttcctgtagaatacttatttttgctatttccggtgtatctactaatacttttacttcagagttttctttgttactggataggattggctgatcacagaaaggttgtttaaagatatactcatttcctatatcgccgatatcttcaaaaatatgcagattattcaactttcgtttgtttttgcgatcttccattgtaatggtaccatttttttcaatcgtcaaatgtagagggccgttttcgatgattcgtccactctgatgaatcattgtttccttttcttctgctttcgcttccccttctacaagcgcgaatgtttcccaagaaaatgctggcatgttttctaatggtaaagtcactttgatcattcttgccatatatggcacacggaaacggtctttcggcaaatcataaccaaattggacagtttcttcagataaaatagctggtatagtggccccactttttgtttctacatgatacttacgtttaggcaaattttctaactcttgatatagttgttcaggtattccttcagcgaatctttttctttctaattcgatggttatttctgcttcaccagttttatccattcctgcagtatttacaatgacaaatggaaagctgtcttttgggaatccggtcgtatcgattgctgcggtcagctgttctaaggaatcttgtgcaagatactttccaacttcatctgctttttcaaaacgaggtatcatttcccgatggacagaatcgactgaacaaccgcaaatactgtcgtgaggatgattttgcattaatgtcttccaagcataatctaattgatcatggggatagtttccactaacttcataagccatcgtcgcaagtggttctgtaatattttctagctgtcgctggaccttggtattccattgttttaagtaaacccgagcagatgctgtattggctaaagtataccagccatccgtttcttgacttgtcaattctccttctactgagcctaagtcttctggcacatctttttgaactgcttccagatagtcagtaaaattagaatgaataaactcgtaatctggaaacagttcatttgcgagatggattgcttttgatatatctttttgtaccggttgatgatcaacaccattcatcatcaataagtggttcgtagaggcatattgttctgcatccgctaatttttgcttccaaaaggcaagagctgcttctttttctactggaatctcattcccgttgctataccaattggcaaatagcagaccaaagattgctgtttgatcaggtcctttccaccacatctctgagtattgggaagaatagttttctgcttccaaaacttgattatcaaagccaattggttttacaccacggccaaacgctgctgctgaaataccagcttgtttcattaattgaggcgtctgtcccatatttccaaatgtatcgggaaaatagcctaacatgacaggggttccccatttacggctttcttccatgccaatcagcatatttctcacgttcgattccgagctgataagaaaatcatcttgcaagatataaaatggtccaattctcaattttccttcattgattgcttgttggattgcctgtcttttttctggccttacttgaagatagtcatctaaaataatcgtttgcccatccaaatgaaaactgttgaaggacggatcaacttcaaatagctctagtagatcgtctatcaattcaatcagtcgcatgtgatgctgttcgtaagccatgtaccattcacgatcccagtggctatgagaaatgatatatactttctttttcatttacgatacctcctacttttctactctaatatcaaagtaatccatgactaattcgcaaaacatcatatttgcccaagaaaaccattctctcgtataattttcaggattgttcacatcgaatccttcgtgcataaggtgtgttcctgcgtcagttgctacaagtaaattcaatatccgctctttttcagatttgtctgacgttgtcattccttccatagctaatgcaatcggccaaacgtatttttctggcgtatgggaggatccaattccttttgcgtactttccttcatagaaatatggattttctttactcaacaatgttcttcttgtttgcagataatcttcctcttgttcagaacaatatcccaagtaaggtgcggcgatcagattgggcacattactgtcatccatgactgtggcgtttcccattccatctacttcatatgcataaatcgtttgccctttttgattaaccgttcgtccgtgattctgaatcccctcttggatctctttcttcaatttctgtgtttgctgtacaatttctttatcatcgagtatcgtttgaaaaatttcttccacataacctaacacgaccaccgcaaacatattggatggtaccagatatccataacggcaagtatcatcgctaggacggaaaccagaccatgtcattcctgtaaaagctgtttttgcacctcgcccgtcattgatcagcgtatcttcttttcttgtcgtgtctcgtacaaatgtataaggagagtgttcatgatcttgctctgttttgaacacgtccaagatttttttgataccttcaataaaagattgattgaattgatcagtttttcctgtatttttgtaaagaagataggccaactgtattgggtagcataaagaatcaatttcatattttctttcccagatccaatcgttcatttttgtatgatctgtttggtggccagcaccgttagcttcttcgttgaaggcattcgcatatggatcgatattgatataaaaaaattgctttttgactaacccgctgatcatgtcagctaattcctcatcttcttttgcaatcactaaataaggacgaacttgtgcagtagagtctcttaaccacatcgctggaatgtctcccgtcaataaaaaggtggttccgtcattttgctttttgactgttgtcaacagagtattggcaaatgctgctgtaaaattctttgcccagtccgcatggatatccccacatttttgtgtgatatcttccataaatttctgcaccgattttggtatatctttataagccactaataaaaccttctttctatttgatatatctttaaagattatacttcatacagccaattatgtctacgctttcaaaaaatatctttttatttactttttcatccattatggtattatttgaatatgatatatcattaagaggtgtttatatgaatcaaccattgtaccagacaatatttaatgatttgcaaacggctattttaactggtgaattacctgtagacagccaactaccaactgaaaaagaactttcacgtacctataaagtaagcagaatcacttccaaacgtgcattgactgaattagagcaattaggacttatttatcgcgttcgcgggaaaggcagtttcgttaaatccgcttctccggaacagattcttgcttctcctacaaaaacacgacggattctgtttcttcttccatatgtcgctgatttgtctgttggtgattttagcaagggattgaaccctgtgatgcaagataaacagattgatgtcatgatgacgacgcttgactttctacaaaataaaacagcaaaagagctaatcaatgaatttgacggattgatttattatgctcttgatacagaacaacatcttgacttactttttgagctttcattgaaagaattccctgtcgtcatattagataaaaaaatctatgagttaccttttcctaccgttctttccgataatttccaaggcggtgcgcttgctgcctcttatttgatcgaacagggacattcaaaaatcgcttatttgtttggtacgcagactcatccacaatccgttcgacagcgttaccttggttaccttgaagcattggacaaagctggtttgactttccacacttcactggatgacaaaagcgcgacattagatgaattgctttcttatatcactaagtatgaagtaactgcttttgtttgtgaaaacgatgttgtcgctatccagaccatgaatctcttgagacagcatggttatcatatccctgaagatttttcaattatcggatttgatgatatccaagcagcagctcttgttgacccgccactgacaaccatcgcacaagattttgaacagttaggtaagcttgcgggagatgctttggtcacttggttagagacaaaagatcgaccatccgatagtaaatttccagtttcattcatcaaaagacaatcaacaaaggagaaataaaatgaatatcggtcaaatagatactagacatgcaacagcgaatcagccaaatttctctaatgggaactgccagccttatactggcgttccttttgggatgaattattttgcaccgcaaactacggatcaaaacggcagctggtggtttcatcctgatgaccgcgtttttcaaggctaccgtcttacccatcaaccaagtccttggatgggtgatttcagtcatatgctgtttacgccgatcaatggaaaactacaggagaacacccttttccatgctcaaagttcttaccgcccagaagaaagtatattttgcccgactcatctgtcgatctgtcaattacgttatggcatctgttctacattgatacctagcatgtatggcggaatcttatctattgattacagcaaaaatgacagcggtttacttttatcctttccgggacgccatcagctctttgttatagatccttacacagtggaaggaaaaatcacacattttgctggttcagaagatcctgatttttctttttattttatattgagatttgaatatcctttaacaattgatgagttagctgtttccaacaaaaatagcgactcgatcccgttgtattttgaacagacaaaaaaacaaactatccgatttgggacatcttttatcagctcggaacaagcagcttataacctggaactagaacaaaaccaaagcaaagagacttaccttgctcacagtcaagaacaatggcagtcctattttgatcgtatacagctcacacaccatgatcaacaacaattgcggacgttttatcataatttatatcgggtgtttttatttccacaaacattttatgaaattgatcctagtgggcaaaaaatccactatgatacgactagtcgatctataaaacctggtgttctctatacaaataatgggttttgggatacgtataaaacggtttatcctctttattctttgattgctgtagaaaaatacgaagaaatgctggaaggttttttgaacagctatagagaaagtggctatttgccaaaatggctgtctcctgatgaacgtggacttatgcctgggacattgatcgatgcggtcattgcagatgctgctgtaaaagatatccgacgagacttgatgcctgaatttctaacggcaatggaaaaaggtgctacggttcaaagcaaacatccaaattatggacgccaaggaacagaagattacttgacatatggctatgttcctaatcactaccacgaatcagtcaatcacacattagactatgcttatagcgatttttgtattagccaagttgccaaggtactagaagaagaggaaatgacgaagaaatatcagcagcaatcattgaactatcaaaatatctttgactatgagtcaggatttatgcgttcaaaagataaagatggcaagttcagagaaccattttcagctaatcgttggggacaagattatgcagaaggaagtgcttggcaaagcagctttgctgtttatcacgatttttcaggactgatcggaaaatatggtggcagtgagagatataaagaaaaactcattgagctgtgcaatcagcccccaacgtttgacccaggaggatatggttttgagatccacgaaatgagtgagatggccgcgatagaatttggacaattagctatttcaaaccagccaagttttcactatccttacttgttcagttatataggacaacctgaaatggcacagccactgcttaaacagttgatgactcagaccttcgacgattctccaatgggttaccctggagatgaggacaatggaagtatggccgcttggtatatcttcaatagtctgggattttatcctgtcacgcctggaaccggtgaatatgttatcggtatgccattaattgacaaggctgttttgcttttgtcaaatggaaaggaattgacgattgaagcaacgcctaatcggccgcagcaacaatttatccataaaatcaaacggatggacaaagaatatacgaaattatattttacccatcaagatttgctgaaaggcggcacgatctcttaccaattagggatcatccctcaccctaagaaatatcaagcaaaagatttgcctttttccttatcaaactataattaacaagaggttgtgaaaaagctgtcctgcatcaagtaataagaacagccaagcaaaaatagatcctcatatttttcgtttggttggtcttattaccgcagatgcaagcttttgaacaccgtttattgagaggttgtgaaatcagcgttctgacctgagtattagagagacaaatggcaaaatagttcctcatattttgccattttttgagctaataccgagggtcagctgattgaacaccgtttagtggagaggtcgtgaaaaagctgtttagtttcgagtattaagaaaaattttgtgaaaatggctttccacatttttgcataaatttggcttaataccgagaaactggcttttgaactccgtttatcgagaggtcatgaaaaagctgccttgcctcaagtaataagaacagcccaaaattagatttctagacaattttttataagttatttcattacattggctttttcttttatgattctccactgttttctcggtactctttaggggatctgccgacgattttcttgaataatttagagaaatacgtggtgttgttgtagccaatctcacttgctatctcattgatgttttgattactgtgcaaaagcagttgtttcgctttttccatacgtaaatggttcaaataagctgaaaaactttttttcgtttcttttttgaacagctgtcctagatacatgacatttaaatgcaggttttctgacacttctttgagtgtaagtggttcttgataatgctggtgcaggattacgattactttttccacattgtcactgtactttttctgtctctgatgctttttgatgaatgacagaagtagctgctgaagttcttgcaccgtttttgcctgatggattttttcgattccttgtaaatattcctcatcttccagatcaatcaattcccgttgaatctccataaacagtaaaaaactggaatatcgtatatcttccggcatcatggctgctaactgaaactgttcaaaaaaatcagtgatcattttttgagcgacttccaattgtttattttgcagcacgcgtctgaaacttgaaaaatcgatggtttgatcttttgtttctgcttgtactgcgtaaaaaacatgctcgtctttatctccataaaattgatgcaactgtagattgtctttcgcttgttggaatgtttcagggattttgtccaaagaatctgtctcttccccgatactgatcagccattcctgatcaggaaagttttcttgaacaaaacaacagaagccatcaacttcatctgcctccaacaacaacgtgatcaatacacggtctccgtaatttcgttgatagtaaaagatttgttgccgttcttgcaaccatctattgataagagtatcatgagttcttgccagttgaatcaatactatcctatgctgcttctcacttatttgtcctattatttcttcttcacttatttcatccaattcttcattcaaccattgactgaataacagttcttgatagatttcttgttgatttttttgttcattttgctgatctaaccgtgttttgattttcttgaggctttcaaccaattcgaacttattcacgggtttcatcaaataattcacggcgcctaattgcatacctcctttcaaataatcgaattcttggtatcctgataaaatcataaattcaaaattatgacgttctttttgagccgcttcaataaattccagtccatttatttctggcattgtcacatccgttactactaaatcaatctgtcgctgttcaagtacagctagtccttctttggcattctctgctgttgctactatttgaaagcctaaactttgccaatcaattatcttttttaacccattcaaaatcatgtattcatcatctaccaataacacttgatacacgctcatccctccttgaatgtaatagaaacggtcagtccacctgtctcattattctcaagcgacatataataactgctgccgaagctggcacgtaaacgttcattcacgttttgcagaccgatagaaccgtgaagttccactttaggatgagacagtttttcttcaatctgttttagccgtttttcagtcatcccttttccattatctttgatgatgatccttacccgtttgccttcctgcaagactttgacacttagcgcattatcgaatcgagtaaaatcaataccgtgtttaaaataattttcaactaatggctggatcacaaatttaggtacttcgatcttttccaaatcaggatcgatcataaaatgataggctactcgattaggataacgcatttgatacaaatagacatatttttcgcaaaagtccagttcttcttttaaagtgatcgttttctcttgattcgtattgtttcgaagcaaagcggaaaacgcatacacaacatctgctaattcttcacttccttcgctgattgcatacattcggatatattctaatgtattatataaaaagtgtggattgatctgtgcttgaagcgcccgcatatgtgcgtcttgctgtttgatttctaatttgtagatgtcttctacaaactgattgatgctatccaacatttcgttgataccgattgaaagttccttcagttcatattccgtgtttgttatgtcgatccgcgtctctaaattccctgctgctgtttgatccatggcctgcatgacgatagatacttgctgtgaatatcgtttgaatgttttataaagaaagataagcagtatattgtctaaaataatgataccaatgatcagcggggcaagattttttcccgtttcgatttttacactttttttatctagtacagctaatatacgataatcatcagacagttcttggtgttgaacaaaattgtttttttccagatcgtcaatcggcaattgtgaatttttcttcagactctctgtgatgatcatttcttgtctttcaaacgtttctttagctattttattatcatggaatgtgtatagtcgatttgtcgttccagaaatcatgtataaagagagtccattgaatgacgttagattttctaaaatcatatctagttctttcttttgaaaaccaataaaaatacttcctgactcagctcctccttgtgtgataggcaacttgatataaaaggcgtctagtaattttggtgtccccttttttatttccccacctttgttttctctagaagattcataatactccggtagttgattcaacacgatatatatcgcacttagttcttcataatttgcgtagagatctttgatttgatttgggaaagaaactaattcatcggtactgttttgctgttcgtatacatacatcagatactgatctatgggttttgttaagtaggtcgtcacattttcgatcttttcggaattccctacaagctggtttttgatgatcctactcaaggttgttttatcattcagcattctgcttgtgctttgaacggcatcacttgtcatgttttctgcctgtttttgattttgttcccaagtatggatactaaaaataacggtagcagtcatcgttacaccgatcatgataaccgcgtatttccgcaacagacgatttagtaaggttccttttgaaaatagaatccgaaacttattcataactttccaactgtttatctaattcttcacgccaatgtgttgtcatcgtaccattccaaaccgtcaaaagaccaatgacaccaaacaggatcaatcctttgaattgccaagtcacgcctaaaattataccgctaccaataattatttttagaaaagacgaaaagctggaaaaaaccgaaataaaacttagctttagcagattaggaacagagatcgtatattcactatctaaaatcatactgtattgataagtagcaaataggcagagcaaggcaaaaagtaaaataaaatcaatagctaaaaaaatgagccctttgatttgaacagataaatataaattgtaactcaataaagcagtaccagataaaaataaactaaatagcagattgcctcttaaaaaatttcttttatatatattccagcctctttttattgtgatttctttatactcgaatccgtacaaataaaatagttcattgactgttttccatgccgcacctaatccaaagatgatcccgccggcaaatgtatatatccagaaatacaaggttagttttataatgacccagatccggataaataactcttccaaaaccttccctaacatatcttctcctccaaacattaagtttatactttctcattatacaaaaaaaggttgggcaatcagcaccttgacctgattattagagaaacaaacggaaaaatagttcctcatattttgtcgttttgtgagcgaataccgagggttagctgattgaacaccgtttaccaagagtttgtgaaatagccgcttagtttcgagtagtaagaaaaattttgtgaatatggctttccacatttttacatatatttagcttaataccgagaaactggcttttgaacaccgtttattcggaacaagaggttgtgacacgtcttttgtcacaacccctttgtctttattcattattattcttgtcggaactcatcatattgtttttgcatttctttcaataccttatcatagccagccttgtccaaagcgtctttcaatttcggtaatgtttcatctggatcaacagtccctgtattcaatccatctaaatattgattcatgacattagaaatattacttaattctgttttgacactgtcagtgttgaagctgaatcctaaaatcggtgaagtttctgcatcagcaatcgattgatcacgtttggcaatcatgtcatccgtaatagactcttgtgtatatagaatcttgttgtttcctgtattccaagcagacatatgtgtatttggctgataaccatctagcaatttgattttatcatctgaaccatcgactttttcccatgcttctccctcgatcccccaaacaagcccattcaataattctggatcactgttaagcagccctagaagttctactgatttttctttattttttgaagtatttgatacgacaaaatttgccatttgtgcttgagctgtagattttagtggaacagtaattgcttttgagacaagttcttgttttgctgcatttgtcaaaattgtatcgccataatcatacggtccttgtgtttctccacgcattagccaagtatttccttctagtggataatccttattgctcgttgcagcgtcacttggaatgagtccttgtttgtaccagctatgcattgtacgtaacagtccgatatacgtttcattatcgtattggttgatgattttcgaatcatctccatccagatcaatagcaaatggtaacgtattccctaaaggataatcaaagttcccttggactttgaagccttgtccaatggcaaaagctgccgtgtttggttctttttcatggaattccttcaagactttttctgcatcagcgtaagattggattccatcaattgaaagatcgtatttatctagtaaagctttgttaaaagtaagtacttgttgagcaaagacatttccattgactgggaaagcatataattttccattgaccagatttcctttaatatatgcttcatctaaatcattataagctttttcagcgtacttaggcgctaattcagtcaaatcagcaaaggctcctttttgggcattggaaacatagttgttcgcaaaggcgatatcataattttccccggaagaaatgatgacgttcattttcttttcgtaatcgccccagccaatgtaattgatattgacttttacaccgatctctttttcgattcgtttgtttgctacttccatcaattgatcgaaattatctggtttatctccgatttgatacatctgcaaagtgtccgaattgctagcttctgcctggtctttagaaccagaacctccgcatgctgctaatgttcccaacaacaacgctgaaacacctgtaaaggctagtttcttccataacttcatttttcttcctcctaattttatgatttatatttttgtttctttattcttttactccgccgattgttagacctttgacaaaatgcttctggaaaaatggatagctgatcgcaataggcaacgtcgagatgactacgatcgccattctggcagattctcctggaactgaggctaatccgcctgtcaattggcttcctgctcctgaattttgtgtcagatattgaatattactttggattttcatcaaaagatactgtagtggaactagcttatcatcttggatgtatagtaaagcattgaaccagtcattccagtaacccaatgcggcaaataaactgattgtcgcaatacctggaacagctaacggtaaaacgatctgaacaaatattcgcagttcgctagctccatcgatccgtgccgattcaataatcgaatcagagaccgaacgtttaaagaatgtgcgcatcacaataatattgaagggactgacagccattggcaagatcaatgcccaaatcgtatcttttaactgaagaagatttgtcataacaagataattggccaccatccctggtgagaacaacatcgtaatcaaacaaaaaacggtaaaaaaacgacggaatggaaagtttgaccgtgaaatcgcataagcatataaagaagtagccgtgctattgatcagtgtacctaaaacagtaacaagtacagtgacgaaaagcgcttggaaaattttatcctgcatctggtcgaacaagtacgtataaccaaatatactgaacttttctggccaaaaactgtacccgtgagtcgacaatatggactcatcggtaaaagagatggcgataacaaatataaatggcaaaatacaggaaatagcaaagagtgcaatcattatattagagaaaaaattagccgtcttattgaaagagcggacttggactctctccactttcttttttttcatttttttcctccttagaataatgcagaatcgctatcaaaacgtcgggcgatcgtatttgtgatcatcaacaagacaaagccgacaactgattggtaaagtcctgcagcagccgtcataccaaaatctcctgtggatgtcaggccattgtagatatacgtatccaaaacttgagtcacatcatataatgcaccggaattcctaggaatgttataaaacaggccaaaatcagctcggaaaatgtttcctacggctaaaatcgttaaaatcgtcattagtggaataagttgtggtatcgtcacatgtttgatctgctgccatttgctagctccatcaaccatagcagcttcataataagtcggatcgattcccataacagatgcaaagtaaataatgctgttataaccaatccctttccatgtaccaatgaacaccaagataaacggccaatatttcggttcattataccaattgacagcttctcctccatgtccagtgatccactgattgaatattcctttgtcaggacttaaaaaagcgtaaacaaagtaactgataatgacccaagatagaaaataaggtagtaaggacatcgtttgataaactttaacgagtcgtttatttctcaactcgctcataatgattgcaaatacgactgagatcagcagattcaaaaggataaatgctacattatataaaattgtatttttagtgatgagaaatgcttgatccgaagaaaataaaaatttgaaattttcccaacccacccaaggactttccctcaagctagccaagaacccatctgctgaaatatgaaaatttttgaatgctacgacattcgccattacaggtatgtaaaagaaaaaaatcatccaaagcatacccggtacagccatcaggacaagtgctttataacgccatagattcataaaaaaatgattgaacccctttcgttttttcatctaaaaacccctttcgattcattcgcaacgtaattatagcgctttcaataatgagaataaataaacaaagtatagggaaaatgaaacaaagtataggagaggttgtgaaatcagcgttttggcctgagtattagagaaaaaacgggaaaatagttcctcatattttgccgttttttgagctaataccgagggtcagctgattgaacaccgtttatcagaggttgtgaattcagcgttttggcctgagtattagggagatcgtgtccttactatctaactctgagtcacaaggaacaatggggactgtaacaaaagtcttgtcacagtcccttattccgaacaaacggtgttccagaagtagcttctacggaaataagccgaaatttcacaaaaaagccatccgaaagtcagacggacaagtctgcttttcagatggcgctacaactactctgcttattcttttagctatccattcaattatttttctctcacttgttctagctcttctttggtcatgggtcgatattgccctttattcaaatctttaggcagccaaaattttcccatacggattctttttaaatataagacttcttttcctactgctttgaccattcgcttaacttggtgaaactttccttcatgcaaaatcagacggataattgaagtttctgtctcttgatctacttgatcaatttggagttttgccggcaatgtctgctcatcgccatcaataatcagtccttctgcaaataaacggatatcttcttctgtcattataccgctaacctcagctagatattctttctccacatgttttttaggtgatagtaactgatgggcaaacaccccgtcattcgttaaaatcaagaggccctctgtgtctttatctaatcggccgactggaaaaagatcttcccgataatcctggtcttccaataaatcgattacggtttgatcatgattatcctgagtagcagaaatgactcctgcaggtttatgcaaaatgtagtaaaaatctttttgatacgtaatgatttctcctaaataagtaaccgcatcttcgaattcatttacttgcgctttatcgcttttcaccacttgtccattgacttcgatcgttccttttttgattaatcctttgacttctttgcggctgccaagtcccatatctgctaaaaacttatctaaacgcatgcgtttcccccatttcaaaagagcatcaatctagctcttctgattcacttattttatttttaatttatgtcgtaaacgcgctattcctggtcctagtagtctttctgccaagcggattttcaaagctaaataaccatacactaaagcccctatacctgctactacaagaatcaacaatagagactggaatttgctatcttcgtttaaaaaagcaccaaaaatcatctttgtgatccacgaagccaaaagcataatcaaggtaagaataaagatcagcaatgtcctgcgccagacaaaacttggtttaaagcgggctacttcatggattctctttaagatcaaggtacaagacacagcaaatccgatcattgtcgccaataaagggccgtatacttcaaataaacgaatggctgggtattgaagaaggagtttcactagaaacccaataaccaaataattaattgccgccttgttttcaaacattccttgcagcatgttggaaactagcatatatagtcctaggaagagtcctacaaaacttgcttggatcagtacattacttcctagagaatccggtgtataaaataatgtatttagcggataggcaagtaacataacaccaaatgtcgccggaaacataaaaaatgaaaacaactgtaaatttccgcttgtcaattttgccagacctactcgatctttcaacgtaacagcttctgtaatcaacggtaacccagtagacgcgatcgatgttgccaatgcaataactaccatcgtcaacttatctggattggcactaaaaatcgaaaaaagatccagtaactgtgcattggaatactcggtggatgcagacatgatcttcataaaagtgaactgatcgactaatttgaagatcgttacccctgaacccacaataataaacggaatcgcttctttaacggtatctaacaacaattccttcgttgcaatatttattttgttttcgctgtagtgaataaacgccgatgtatacgcttgatgtttcttcaaaaaatacaaaaggacaagaatacttgctagcataccgataaatgccgcgaaagttgattgcgtgaccgccgtcacatagtcaccatccatgactttcatgatgatgaatgtagccaatagcatataaaaaatacgtgccacctgttctacaatctgcgacagcgcataaggcatcatttcttgattgccttgaaaataccctcgtatcacactcatacaaggaaaaaccaatacagcgatactcaaagaacgcatcgttggaatcagttcttctccgccaccagaagcatgagctagccaaggagaggcgatgtacatgaacaaagcaaacaacaggcctaacccgcccatcatctgtaatgcacggataaataatcgtcgtgaagtgccatattcattcaatgaattatagcgtgcagtttgttttgcaatcgcagcaggtattcctgctgtagagatcagtagaaacaatgcatatatattgtatcccatattgaataatccattggcagccttagcattttcgcccatccaagcataccagggaatgatatagacagcgcctagcaatcttgaaatgatattactggcggtcatccaagcagagcctcgtgccattttttcttgcggtgttaattgatctaatgctggttttctttgattatccatcggtcagattccaactttctacaaaacattactatcattttaattggtaaaacagaaactggcaatcgattttatataacttttataagaacaattgtttttttgaattcggtttcgtttttttggtaaagtaaagaaatatacagccttttatggctaacatttataggagatatcaatgacacaagaaataaaaaaactacccgttatatttttaggtcttttctttatcacagttggattgaattggttcttgctccctcacgatatagcttccgccggagtgggcgccatcggacatttagttgaaacggccttttctatccaacgctcagttactgtttggagcatcaatcttatgatgctgcttctagccgctgtcctattaggaaaatcagtattttttaagactgtagcgggaagtctgctttttcctgttgttttagagattgttccaaaagtggaaatgatctcctcacatttcttttcactgatttcaggaagtcttttgttcagtcttggggtttacacattgtacacagtcggggcctcaaatggcggtataacgataccgccgattattttccacaaattttttcggcttccaatgccgcaaggacttttacttaccaatagtcttatcgtctttttgaattattatgtttttggattgttggagacactattcgttctcctatctattacagtcagttcattgtttatgaaaatactcatccgcttgtcccctgtgtcaagaaaatttgaataaagctggattttgtcatagcggaaacaaacgatatattaaaaagagtgtgctataataaaccaagaaattgaataaagcgagggatcaatcaatgagcttctctttagaagacatccgtcatttactattaaaagaaaatctattaaaagaatttgtttcaacaagaggctggcatcttgatgtaccagaaaaagctgaatttcttcagttaagttatgattcaagaaaagctgatgcttctactttgtttttctgtaaaggaatgaatttcaaagaagaatatttggattcagcaatcgaacagggtattcaatattatgtatcagaacaaccatacgaaaattcagcagtaggaatcatcgtaacggatatccgtaaagcaatggcgcttcttgctatggctttttacgactatccgcaaaataaattgaaagtgatcggattcactggaacaaaaggtaaaacaactgctgcgtactttacaaaagcaatcttggatcacacaacaaataaaaaaacagcattgctttctactatgaatacaacgttagatggcaaaacatatttcaaatcccatttgacaacgcctgagtcattagatttatatcgtatgatgtcagaagcagttgaaaatggtatgactcatctagtgatggaagtttcttcacaagcttacaaaacacaacgcgtatacggcttgactttagatgtcggaatcttcttgaatatctcgcctgaccatatcagtccgatcgaacatccgacatttgatgactatttctattgcaagcgacaattgatcttgaattcaaaaacagttgttttaaatcatgaaagtgactattttgatttacttagggaaacagccgatctattccagattccaacgatcacttatggtcgttcggaagaaagcaattatcaagtgatccgttcagataaaggtactcacggttttactttatcttctcatgaagatcgcttagctatctgcgatactgcttatgatattttgctggctggaggattcaaccaagaaaatgcagccagtgcgatcattgccgcagcactaacaggtgcctccagtcaagatgcacaagacggattaaaagaagctcgtgtaccaggccgaatggatcaattgatccaatccaatggagcgcatgtctatgtggactatgcacataattatctaagcttgaaaacattgctgaaatttgccaaaaatgaacatccagatggccgtgtaattgttgtattaggcagcccaggaaacaaagcaatctcccgtcgacatgattttggaaaagtgctatcagaaacagctgacatcgcctttttgacggcagatgacccagcatttgaagatccgaaaaaaatcgcggaagaaatcaatgaagcaattactaatccagatttgatcgttcattatgaaatggatcgtcctgaagcgattcgacgcgctttagcagaaagcgctccgcaagattcagtcgttattgcgggaaaaggcgtggatccctatcaaaaaatcaatggtgtagatgaaccttatgaaggggattatgcaatcgtgaagcggttgattgaagaataatggtatttatatactagtggtttcccatttctaagaaaaaaagggactgtgattttttgtcacagttccttttttcttagaaatcattttaacttttcactagctaattctgctgccttttctctttcttcatttaataatttattatcatagaatttgataaatgggaaccagataatgaatgcgatgattgcacaaatgactgctaacacagcagctttccaatcaccaccactaccaacaaatgctccgatcccgactggtgaaggccacggcatctgtgcaagcatcggtttgacgatttccagccgaatggcaaaataagcgagtgtagcagaagccatcggagctaagaaaaacggaaccgctaaatagggattgtagacgattggcatcccgaaaatgattggttcattgatattgaataatcctggtacaagtgaggcttttcctaacactttcagctgatcagatttcgcgaggaatgcaataaagatgatcaatcctaaagtcgcacctgatccaccaacggttacataagaattgttgaattctcctgccaacggataatttgcgccttgtgcgttagctgccatattagctaatacgatcggggtcaagaaagaagtgatgatattcgctccatggatccctacgatccacaatgcatggatcaagaaataaatcaccatgacaccaagccatgtattcgtcaactgcgtaacaaacccaaatgggatagcaatcattttgaagatatccgttcctagtgcaactaataatccattgatgatcatcaccacaaacgcaatgacaaatgttgggatcagagcagtgaaagaacgagaaactcctggcggaacaacatctggcatttttatgacccaatttctcttgacacacatacaatacaattcgaccgcaataatcgacataataatagctgtaaagattcctgaagttcctaaacgttcgacaaaagagcccatcctaataccatttactacagtttctgtctcattgatagaagcaatcaagctgattttaccatcagtcatgatcaattcagggatacacataaagaatgcaaaaacagatagtaatgcccccgtgagcggattaacatttaatttttgttcatctcgttcaattgacgttaattcataagcaaacacaatggcaaagtaaatagataaaatccccatcgtcattgtattgacgatcatgtacaagtcactaactttgaaaaaagttgcattaaaaaatccttctaaaaatgggaacggtaatggcaaaatatttaaaaccaaaaacatcgagcctacaatcgtgaaaggaatagaagccatccccgctgccatgacagcccgaacgattttaagttgcgcaattttccccataggtcccatcaggtatttctgcaaaaaatcaaacattagttattctcctttcctaaatataacgctttttcatattgtttaatacggatatactgttggtcttggttgagtgaaattttctttaaacgatactgtataaatgcactggcaaaaataccgcttacaacaagaatgaaaacaaataactgtcctccattgttatttgccataaaaggatacaagaatgtaaatcctgaggtaaacaacactggaatcactaataaattaaagacactctggaacaaaaaataccactttgtccatggaacgttcgtttggtgttttcgataaagctttacttgttctcctactgcaggcaaaatagctaaaatcagaatcatcggtaaactacttcctaaacttttagctgatagaagcagaatcatccattgcatgttcatgaaaaagaaaaaggcagtcaggtaacgtacgattagataacgattgaaatacatgtttttcaaactaagttgctttttttctaattcgattttcctttttactgtatcctgcacaatgatccttcctttctatttatttttttgatacaaataattcatttcctgtgcaacttccaataatgtcatcgtcgtcatcagatgatcttgtgcatggaccatgataatttccatttctatttttgtcccgctggcatattctttcagaagttgagtttgtgactgatgcgcatgaagaatctcttcatttgcttgtcgcaacttctcttctacttcttcaaacatctctttacgcatcgagcgaaatgcttcatgtatcagtgtccgtgcatttccgctatggaaaatgatatcaaaagaagtcacttgtagtgtttcactgtttattttttcagccatctgttttcctccttattcgatcagtttgataaatttactgctgaaattctcaaaaataggttcagctaagatttcctgctgtacttttagctggtcaactaacctaacgattgctttagtcacgaccgtaattccttcattttcgacataagaaggcgaaactaaaaaaacaaaatgaatttcttgatattgatcccactgcatcccagaaggaatcaatgcaacggctacctttgtttcgattccaactggaacagcgggatgtgggactgccactgtatcactgaatatgatttgtcccatattttcacgttgctggatctgctttcgcatttctcttatatatccttcttcttcatttatgctcagcttttgcagcaaatcatgaagaatttcttcctttttcggttcgtacgtataagtcttgaaaaatttttcagacaactgttcggtgtaaatctgctttttttgctgtagagaaaatgctggtatcggtctatctgaggaatgatagggtatagattctccaactacctttcgtattttacgaacatcatcttcattcaaaaaaatactgacatgtaaaactggaattttgaaaaacattgtcgaaagatcaatagaagaaataatcaggtcgattccttttaaagttgtttcattgatctcataatagccttttacacttaccactgtaatatttttaccgaattcactgactacgcgattctttaatagttgggcactgccgtaacccgttgcacagataatcaatgcatgtagtttatgcgcagctctttctttttccaatgccgccatgagatgcaaagccaaataggcccattcatcttcattgatggtatagtttttcaaagccggcatgttgctgaaatgcctttttactgcgtcaaagactttgggattttctttctttatctcctcagtcaatgggttctcaatgcgaatacctcggctcaatcgaatcatcatcggtgacaaatgatcgagtagtccattgaaaagctggagatcctctactaatgaaaaatgaaattcctgagacaatcttttcagaactttcgctaattcctttgatagttcctgatcattttgattttctttgtgattcgacttagccatgagatgtaatgtcaaataagcaatttcttcttcgggaaacgatacacctgcgattacctcaatacgttgaacgatccgctgcgccacttgatactctactcgcttagaaacttcttgttcgatgcctaattccttgatttcaaacccttctcggagccgtttgatccccaaagccaagtgtaaagtcagattctgtatgataaaatccgaaacttttaacttagcttctcttgtttcatcgagaatgataatgactagctcttcaaaactgatgtctgggaaaaaacggctttgccctaaatattctttcaatgaatttccataatggtttccaaaaaaagtatccatgataaaatgccgtcgatttctttcttccccttcgatccatgtcccttgaccatgcttagaaacgatttttagtgaatatggaatcaatcgctccttgatttcttgcatgtcctttgtcaaactggaacgactgatataaagctcttctgccaaatcatccataaaaagaatggcatcttccaaaagcaattggttcaatatatacttttgtcgatcttcggactcataaaatccttgcggttctctagcatatccaggtactatttcttgccgactcaaaaacaagtcaaatgtcagtctttgtaaaatatgcagttggtagccataacctggtttagcaatgatcttacctccgtttttttctactaactctttgatccgctgcaagtaattacggattgtccgatcagataataacaattcagaagctaaacgttgactggtgacatactccttcttgtgatcaatcaaatatctcaacagcaatttttccttctgtttcattatcatccactcctattccatcatatgttctcttcgatcacctctgctaacttctggatgcctgtagggattgggacatacgcttggaaagggatactaacaacaggctttccaacagattctcctaattttttgaatttatccaaaaacatcgtcgtttgcgggctgatcagaaataaatcaaaatcactattcttaatcatattatcgccttctgtagctgaaactgcatctacgagtacctcttctcttttttgcttaaagaaatccgttgtctttgaggccatcatcgaggatgacattcctgccgcacaaataatcaatgcttttttcataaatcaatcactccttttatttttataaaccaagcatatcttgtaagcgttttctattcaaaatatatatttccgtagcattgcggaaaaaatgtgtatcatatcttgaataataatttctggcaccgtgatatactagtgatagaattttttcaggaggggatttagtgagtatcacagtgaatattttgtatacaagtacaaatggacaagccagaaaatttgcagaagaaatggtcgaaagaaacattgtcaaagcgattcgtgcagaagaaggaaacgagaaatatgactattactttccactagaagatccagaatctcttttactgatcgaccgttggaaagatgaagaagcaatcgaaaagcatcacaaatccgaaatgatggctcaaataaacgaactccgtaaaaagtataaattaaaaatgaaagtcgaacgtttcactgatttaccgtaaaaagatacacatggaatgatagcaatttatcatccatgtgtatcttcactttttccttattttttattcgatctcatctaatgattcaaaccgtgtttttctcttatttttcggataagtatttcagtcaccccaatatacatgattcctaaacataccccaaggatattctcaaaaatgcggatcgttactgctcctggaaccccgaataaactggcagtgattgccaaagcaccaaaagaattaaaaactgttttatatctataggtagaacaaacacctaaagctagaccacctaatataccgacccagttaaaaggaataaattggctgataccaataaataaaacacatccaatcaatgagccaatgattcggtctactgctcgttctttgaaaccaatcgacatcaatccatagctagatacaatagaagaaaatgcaaaccctgcccacatcaatcgctgaaaagggacatactctcctgcaacgatcaaaagactaatgccaaatgcatagatgagcatccaaattttttcctgcgaatacatgcctttcaaaaaaatctctttaaacaagcttttgtctttgttcttttctcgatgttttctgtaaaggagaactgaaaaccaacaaaaaaacaaaaataataagctacttgtttgtgtaaagaaattcttgttcaacgaatctttaggtaacgaataaacaataaagagatatgaaaagccgtacaaagaagcattccccattttgggatcactagcggttgccattaatatgctgcttagtaaaataaaatgaatcaacatgcccataactgaccatttgatcagctggacatacggtgctactaatagtgagaacatgacgattgctaaacctatgatcgaatgggaaatcttataaccaaagtcaacaaaacgaatactcatcaacatacagaataaaaccacagcgtatggtttatgcttcgattcaaataatgttgtaattataatgataaaacaaatggcaaacaatacgatgaataatgatcgtaaaaacaatgaacaaatatacatgcacttttcttttttagaagctgcttctcgtattttttgttttaaaataaacggatctagttgtagagactgataaaaatccacctgttgtcgtcctttctttttacttttattttttacagtcatctatgacaggttgtaaatactatggaacatcatatggcgttgtcattttcttgtcaactatttttcctattcatgtttttataaaaaaacatatcgttttcttgtatgattaaatcaccacaaaataaacaactgagagaacgatatgctttatgaatggttctatcaaaaaaattctgagatcaatagacaaaaatttgatgattacagaggtctcttacgaaaccttacagaagaaaaaaacattgatcgttgctgcagttctcttccctgctccatgtgtctgtagaaattgtggttctgctgtggtagatggaaataggaaattaatggtggtgaaaaacaagaagaaggaaaccattgtccactttgaataatataatcatatgccaatggttatacgcctaaaaaagcagcgctatacctgtaaaaactgtcgaagccattggaacgctcaaagttattttatccgtccaaggcactcgatttcaaatcatgtcagacataaaatcacttctttactgactgaaaaagtgtcgttattttttatttcgaaaagttgttaggtatctttgacaaccgttattcgcacattgaaagagttgagaagctatttaccaaagtcttccaaaagaattctgtcttgagtgttgagggttgtgaatttcgttctcacgtttccgttgaggataaactgagttttatttccgcggatggcgagacagaaaaattaatcgagaaaatttacctacacaaaaaattcctcgattaacaaactatttccttagctgcactaatcctaaagaaatagaattcttagttacagacatgaacgccacctactttcagctcaccaaacatgttctaccaaatgcgaaattggtgattgatcgattacttggtttttccacgcctttcaaggaggcgtaacctttattcacgagttggttgaagctttccgagacaaaagacccgacttgtttttctccttattgacaaagagccattaaaactagagaaaaaattacaactgatcgctgattatttgtagaaagaaaatcaaagtattacccaataaacttgagtcattaggcaaaaaacactgcgaaactcaagaatgattttcgcagtgtttttgtatattttttattaactagtattactacaaaggtttatttttcacttctcaacgcagcacaaaattgtctttacttatttactggttgggttcaaccttctctactccgatactaatatttgtttgtataccccttctaaaatcggtagtttccattcaattgatgggtactagttgattttaaaaactatgcttattcaattttttattttagctcatatatttcgtttctttctaaattttatactgatgaaaacaagtagcacacccaatattgacaatataaactggctaatgatggtttctccagtttttggaagatgcttatttccactgcttgttggattgtttcctcttatatctgagctatcagcaacttttctattctcttttgttaaaaagatcgccacttcttgttctttttcgatcttgaaagttactggtgtcgcatccaattcataccccgttggcgcttgagtttctaccagctgatatgctcctggtgctaagccatctatcgccagttttccatctgctcctgtggttagacctgactgcagaacggttccattggcatcttgtaactcaaaaacagctccttgcaggacttctccgctttggtcatcgatctttgtcaacacgacaccgcctggtgtaagtcgattttctttcgtcaattctaccaccgctgtctgacttctttcgatctcaaactcgattggtgtcgcatccaattcataccccgttggcgcttgggtttctaccagctgatacactcctggtgctaagccgtcaatcgccagttttccatctgctcctgtggttagacctgactgcagaacggttccattggcatcttgtaactcaaaaacagctcctgcaggatttccccgctttggtcatcgatctttgtcaacacgacaccgcctggtgtaagtcggttttctttcgttaattctaccaccgctgtctgacttctttcgatctcaaactcgattggtgtcgcatctaattcataccctattggcgcttgagtttctaccagctgatatgctcctggtgctaaaccgtcaattgccagttttccatcttctcctgtagttagaccggtttgtagcgtttctccttctcggttctgtaactcaaaaacagctccttgcaggatttccccgctttggtcatcgatctttgtcaacacgacaccgcctggtgtaagtcggttttctttcgtcaattctaccaccgctgtctgacttctttcgatctcaaactcgattggtgtcgcatctaattcataccctattggcgcttgggtttctaccagctgatatgttcctggtgctaaaccgtcaattgccagttttccatcttctcctgtagttagaccggtttgtagcgtttctccttctcggttctgtaactcaaaaacagctccttgcaggatttccccgctttggtcatcgatctttgtcaacacgacaccgcctggtgtaagtcggttttctttcgtcaattctaccaccgctgtctgacttctttcgatctcaaactcgattggtgtcgcatctaattcataccctattggcgcttgagtttctaccagctgatatgctcctggtgctaaaccgtcaattgccagttttccatcttctcctgtagttaaaccggtttgtagcgtttctccttctcggttctgtaactcaaaaacagctccttgaaggacttcaccactgccttcagcatgtttaattagttcaacaccacccgtatcaaggatgttttcaatggttaacgtcacttcttctatggagtattcatttataaaaacatcatgtaccgtcgcatctaaaagatacccttccggtgcttctgtttctcggacttgatagctacctacaggaagcggttcacttaaaaattctccgttttctgccgttataccttcttgtatcacttgtgaatcgcttgataaaatttcaaattttgctcctgccagcctttggccattctcatcagttttaattactttaatacgcccatcgattttccttgttcttacagtactcgtattcaatcgattgtcactattcacaagcgttgcaaagtttaaaatttgatcgccgaccgcatacgcctctacattgaccttaaaagagagggtaaaacttgtcggaccaccaatcgtattattcgcactgaaacgaactattccattattgacttcggcatcaatgaaagagggaatatctgatagaaatgacacaaattccatgccttcttccaaaacatcttcaataacaagcgtatttcttgttccagaaaacatcgagacatgcagagtatacgttagttcattttcattgagattgataacatttttgtccacactttttcttaaagagattgccggaagattactttcagggattctcaagcggtagtctcggctcattacctgattattgtaggtcatactcgctcgattccgagaaaacccatcctcttgtcttccttcattgaacaagtcgacatcggtcacttcaagagcatattcaataaaatacgattgaccctctgctagattaccaaagtccacaacaagtgtattcgtttccttattaaaagatactttgtccacaaattcctcggaaacataatgagttctaacgtttgcttcacctggattcgttacttctgcgatccgaaccccacctgaaataggttctctatttccagtggaactccatgtagtcggattcggtgccaaagttgttccttgcggtagtacatcggtaaccactacaccgtcttttcgtgatccttcataatttacctgcaaaataaatttattactgttggtcacgtcttgcccgtcaatcagcagattcccaagatttccttggctgtcgatttctctagagccatagtataatttcgaaaaaatgggtcttgatgaaggaataggcgtaattgaaaattccgtgtttgctgctcgctcagcataagtaagactcacttgaaagtcattatttggctcagtaccgcctgattgaaagaaagcaacttcaaacgtgatactgaatgtatacgactgagcggcttcatttaatccttcataatcaaaggtaaatggaaaaacaacgtctgtgccttcttggtaaaatgccagtggctttaaaggtgaatcatcagcgacctccactctaatgaactcaattaagccaatcgatgctctaggaactcgtacgaccatctccccatattcttcaagaatatcgccagcgcctccttgaatgtatccctttaacgtttgtgtatgcctgctcggcaaagtggggcgctcagcagagatgccgatgtcataattcaagagctcctcttgtctttcaatctgagattcctgcgttatagatggctcagatgatctggcttcattaaaagattcacttaagctttcttctggtatattaaaagattcacttgtgctttcttctggtacattaaaagactcacttgtgctttcttctggtacactgatttctattgagaccgtatttgattgaatatcaccgcttcttgcggtcaattcgtatttacctgaatgctgggaagaataagtaatcagacgttcgtaatcattgagttgcttcacttccccttcaatcaaatcctcactcttatcaatgaccaatgcatttagcaggtctggtgttcctctgactcgcaactggaactgctcacccaaagcagcctcctcttgatcaacttcgatcgtcagcgaacgctctggctgttctgctaaagactcagctagaaccgttatgttcccaaattgattgatcacaataagcataactagaaacatacttaacagtttatgaaatttgttcctcactattactcccccttataattttgactaaacaacaaggtacccgataattttctaaaaagattccccaactcaaaatggctgcgttacctccctcgtattttcggttcaactcaagcgttgcaatgtaagctgtaaacaaagctaatgattgccgattgtcttctgttgattgattcgatagctttgtatgacttttagttgtccgtgtggcttaaccataattatgatttcacgattcctcctgccagtgccttgcacaagctggagcgtaaccctaatagttattttgttaatgtacttatatacttttatacttttccattagaaacaatcactaaatcgttgataccaaggtcagactctagaatttcatcagtgagtccctgtattggttaaccttcatcaatcccaaaaaaatatatcaatgcttagcatcaaaatgaatatatagtttagaatacttgggattcatcgataactgatcgcttatttggccatattatttggcacttggttcaactaaacgcatttaggatgttccttcattctcgtcatggatgttctcaaaccgtcattactaataaactgtccaccgaatcgatggttcatttcttgcattttccacgtccaattactctttttgctctttatttgggcgtagtttcactttcttaacttgtatcgtcttccatcaactccttaatcatcttcttagctttattggctcggtttccttgtaaaaggtatctacaaatagtgacaatctgtattaaatcttcatcattttctgtaatgtcaataatttctatattctgtaccatatattgcaaagggtttcactaagttcataaccgaagcgaattaaacaacttttgtatagaataactaccttttctatttttccattggtaattctatctattaattggtttaatccttttgttgtagttgattccactaccaagatgattctctcgaattttaaagcttgaagatgtattgctatttttgctaactggcgtatttgcaactatttttcccttctattcttccttcattgattcccctctaaaattactatccataaaaaattgcataaatgacaatagtatttatattagtcatactgctttttaacacagcaaattccagaaaaacattcgttacatatttgtgaatttttccaaaaaataacatttttataaaacgacgaaaaataaatcactaccagtcaacttctataatattaccaaataacaaactaactatccatcaataacgtgttttattttttaaaatttctataaaaaaacaatcattcttaaaaagaatatataaaaataacaataacctttgtgatttttcttgtttgaagaatgttagaagaaaaatctctaaatacttataattattttataagcaaaaaaatgctatcggtagtatcaccgatagctgaggaaagtcacagtagggactatttgattaaaaaatatgtttattcaatccatctatttatttttgccttattaacatattgtaataatgtaagcaacaatgtattttaagtgtaatgcttttatgcacctatttaatttatcattctcatctgatacaatctcactcataacaatatgaatttttcttctcattagtctcagttcaccatgaattatacataacacccaatacaattatttttccatacttttttaagaggacaattacatcgtatatatcgctaagaattgcaaccattccatttttaaagacatatttcctctaaaaaactaaaattctatctatccacgactaataatcccccacattaaacccgtaatcgaaccagaaaatttttctttataactaaaacaaccatcattttcgagttatcttaaacacatatttcctattttttcatttctatccatgcatgataatattcagttctgatattgttttcatccgtattcgtcaatagatactggccgatcacttctcctgttttccatcctttttcatacattctttctctgatttctaaaatattattacgttccgcatggttcatctcggatttcaataagaatcgacgataaacagccgtatcttttttctcccaaatcacgtcttgagtaaataaatgtacttcactagggtcgataaaaaatccatacatcgtctgtgaactggaagctggcatactcatcatcccaaagcttgaatagttaggtagaaattttttgatttccacaatatcttcaaactccgttgagatcatacagtcaaaagggatctcttctacaggaaattcttcctcgtttgtatcgatcatcaatttcaactgtttttttcgctcccttatctctttttgtttttgtttcatcaccaccagttctttatggattcttctttctgtttcatcaagtgtctcatataactccgtcaatgtttttccatataaattcttcatctgtttgatcggtatatctaattttctataaaaaacgatatcataaagcataaaaatatcatcgatatcaaacaatcgataatcattctcttcttgtctacttgaacggattaatccttgttcatcccaatagcggatcgttgattttggcaaatcaaatagttccgatacttggccaatcgtatacatttttttcattttttctcacctctttttcagtttattcttttttctattgaccttcaagttacttgaaggtatagaatcgaaaagtatcaggaaaaaaggaggaataatatgtctatcttaaaaacattcttacagaaaaacaaaggactcgctctccttacctttgtgatgatctgtttacaaatcgccggtacattaggtgtaccaaaattagtagcaaagctgatcgacacaggtatagcaagtggcgaagcctcagttataaaaaaaattggagttgaaatgctgcttgtagcgtttctaggaacaatcgctgcagttgcctctagttacttttcagcattggcttccgctaggtttggattccaaacgcgggagaaatatttccgtaaattccaacagctgtcaatgaaggatatcagtcgttttagttctggatctcttttgacaagaatgacgaatgatgtcgataatgtccagcaaatgattgttttattttgccaaatgatcttaccagcaccggttatttgcgttttcaccattctcatgatgtttcgttattctctattactaacatgggttacattgatctctgttgttttttatgtatggattgtttatcgactgatgaaacgaggggcacctttatctttgagtatccagccaaaaatggatcggatcaccatcacattgagagaattctttactgggattaatatgatccgtgcctttgataatcaatcatatgaagaaaagcgaacgaataagagctttgctgactatgctaatcaaatgatcaaagtgaaccgaatatttgcttgggtcactccaattgcttttttgctcatgggaatcgtttatgcttctattttgtggtttggcggaaatcttgtagcagaaggagcattacaaatcggtgtcgtgactgctgtagtcgaatactctatgctgacacttgcttacttgatgatcgcagctatggtattggtcattatccctaaatcgtttgcctcattacgacggatagaagaaatactgcaagcagagatcgaaattgaggaagagacgatcaaaacagtagctgaaccaacctttgatcagacaaatgcagctgcttttgaacatgtcacatttaaatatactgaaatctctgatccagttctagaagatattgatttcacaatacctaaaggaaaaacaacagcgatcgttggcgggaccggatctggaaaaagtagtttggcgaaacttctcttgagacttagtgaccctacgataggaaaagtaacccttggtggtattcctcttactcaaatgactcaagaacagatccgctcccacatcagttatgtccctcagaaggctttcttattcagcgggacaattttaagcaacttgcagatgggaaatgaatatgcctcaacagaagagttgtctaaagcgatcaagatcgctcaattagaagaactagtggacacccttcctgacggattggacagctttgttgctcaaggcggttctaattattcagggggccagaaacagcggatatgtattgctcgagcgttgatcaaaccagcagagatctatgtattcgatgatagtttctccgctttagactataaaacagatgcagcattaagagcagcccttcataaacacatgtcggagaaaactctcgtgattgttgctcaacgcctcagtacaatccaacaagcagataacatcattgttttagatgaaggaaaaatcgttggacaaggtactcatgaagaactactgtctaattgccaaacttatcaggagtttgcaaaatcacaaggaatatagaaagaagggatacgatggaaaagaaaaaaacgttgaacacgcgtgctttgatacgtttttggaaaatgatcaaacctgaacataaatatttttacggattgtttctatgcagtttattcgggaacctattagtcgtagccatgcccttgatcatgggaatcgggatcgatgatctcttatcagaaataagaaaaacaggtattggacagctttctttcagtgatatcaaacaagcattgttgttccctgtcttattgctgatcggctgttcagtcttaagcagcatcacttcatttattcaggaacggacaatggcagcgttaagcgaaaagatcacattgagggtgcgaaaagaaatcacaaaaaaattcaaaacattaccgatgtcgttttttgacaatcatcaagtaggtgacatcattagtcggacaactaccggtctcaatcaactttctcaagtgttattgacaggtatcaatcaattttttacttctgtcgtaacaatagctgctgctggtctgatgctgttttatatcgaaagcaagcttactttgctcgtcttattgctgatcgttggcagttcaattgttacaactaagattgcgaacaaaaacaaacagatttctgaacagaatcagtatgaactgggtgttttaaataatcgaatggaagaaatcttagctggtaatctagtggtcaaaacattcaatcagcaagctcatgcagaagctgctatacacgaagtaaataaaaagcaatacaacgcttttaaacgtgctcaatttatgaactttgctatctatccggccattcgtttcattaatcaactcgccttcatcataagtgcggtattcggtgctatgcttgttctatcaggtggtgtgacgatcggcttcttacaagcttatcttcagtacatcaatcagatttctgaaccaatttctaccgcttcttatgtgatcaactcgatccaatccgcaatggcagcaatcgataggatatttgagatattagatgaaacagatgaaattccagaccttccagatgcaagacttttagaacaaccgaaaggaaaaatagctttcaaaaatgtacagtttggttacacatcagataaaatattgatgaatcaagtcgatttttcagtaaagccaaaacaaacggtagcgatcgttggtccaactggtgcaggaaaaacgactttagtcaatctgctgatgcgtttttatgaactgaataaaggaaagatcgaattcgacggtcttgatattaccaagctttcacgtggagaactacgtcgttcttttgggatggttttacaaaatacctggctgtttgaaggaacggtagctgataatatcgcctacgggaaaatggatgccacaagagaacaaattatcgaagcggctgaaatcgcacaatgtgatcactttattcgaacactgccagacggatatgatacgatcatttctagcgaaaacggcacgttatctcaaggacagcaacaattattgacaattgctcgagtcattctagcgaatcctcctgtcgttattttagatgaagcaacttctagcgtagatacacgaacagaagcattgattcagcaagcaatggaagctgtgacaaaagataggacaagttttgtgattgcacaccgtttgtcaacgattgaaaatgcagacatgatccttgtaatgaagaatggcgatatcgtcgaaaaaggaacacattctgaactactccaatcaccaacgctttatgccagtctttataatagtcaatttcagatagcgtaacaaacattatctaaaaagctatcgatcatgtatgattagtccatgatcgatagcttttttaaatgtactagtggtgccactagaaacacaaagaataatactaatgatactttttggatagctccttcagtttcgttcggtaagtagtgacaaaagacttgtcacaatccctttttacgaataaacggtgttcaagagacaacctatcggcaataagacacgatcttgtaaaatacgagaagctatacttcaaaatcgcttcttgttgctcttgtcaactccgaatcacgagttacactattcaacaaatatgagaagctgttttttgaatttgtttcttgtgactcggtgctgaacgtcaggctcacaatctctcttctttaatctccttgttctacttgcgatagttgctgaacgaattgccatgtttccccgttatcagttgaacggaagaggcaggcaaacattttccctgcatcgattggtccttttttcaacaaataaaattttgtctctaacgtattcgcgcttatttgagtaacttcatttggtgattgaaaaagatctatcccccctgtctgatagttttccggaatcgacagaactgattctttgaatgagcgtcctccgttgtttgtataaaacaaactttcacgtgtcgaaacaaaacctaaagaagttgtaacgaagctgacattttgtactggctgattgatcattgtacttccactttttatccaagtgattccgccatccatagtagtgtaaatgtacaaagtttctgcagacatcccactggctgatgtacagataaatagaccatcgttgccataaaataccgcttttcgataacgtatcggctgaactgattgggtgataatagacgtttgccatgttttaccattatctcttgaagtcagcagacgtacatcatccccagaagaatagataaaccatgagaaatcggcggaaatatcatatgtgttgtccatccaataaccttcaggaatcagccccgttgtcagggtgtattcgccaaaacgcaaccattgcgaatcaatcggcacaaatacccaattagcaccactatctgttgtcatatagagagagtgcgtctctgtatcaagtttgagatcatttatcttttgtgttgtcaaatttaccttttgcttaggatcagctaacaacccttcatttgtcttttgtatatgcgtatcgttagttgagttcattgtcatgtgagaagcagcatttatatgagaagacatttttggctgagtgtatctcccataatagattgttccagctaaaagaatgaggaaaaaaccagtgactaatgtactcatcttagttgtcaggtatccaccaggcgaagactggcttttttcccatctgggttcgttttctagtaaaaaaatatggaatgtgttcattccgaattttgatttgctttcgcctaagtagataggtaaatcatcaagtgatctcagcaataactggcaatcacttttttgtatccgaaaagcttgactcgtcgaagtcttctcaaaataaagatagtcatcatcttgagaagttggtttattatgtaaaaactgttgtgctctttgactaagccattgatcgaaatgacgcgacaattgatggtaacggagccaaataagtagaagaaaaacaataagcacaacaattgttattccgccaactccccacgaaaagtgatacaaattatttaatttttgcatcccttcagctgaacggactactgcactcatatggcgatataggaacgatacagctccgaaaaaaagcaaaccagagaaaaatactaagcttaaaagcttgaacattattcttttcgctctttttttcgctttctcgataattttttgtttagctgataatacttcgataataaatagttcttgatccatttgtctctccttttctcatacttcattcattatgcgtcaaaatccatacaatcactagtcccactaataaaaaatttatgaatttggtatgtactctcaatttcaggtagtttatacatcaaaaaatactaagattaatagacaaaaatttgatgattacagagatctcttacaagaccattcagaagaaaaagacattgaacgtgtttgagaacatgaaaatcaaaacctttttgatcaatcaattaatcaatttgaaataacaaaaaatctgagacagaatgaagttcattctggcccagatttgattttgcacaactcatcagtccttattgacaaagagccaattaattagcaacgatattgactaacttgtttggtaccgcaataacttttctgactgttttgccttcaatatattcttgcactatttcattggctaatgctgctttttctagctcatcttttcctaagtctcggggaacattgcttttcgcacgaactttaccgtttacttggaaaacaacttctacttcgtcttcaacaagtgctgcttcatcgtatgttggccatggtgcgtaagaaataccaccatcatttccaaggattgcccatagttcttcacccatgtgaggagcaatcggtgcgagtagttgaacaaatccttcgatatattcataaggcagagcgtccactttataggcttcattgataaagaccatcaattgggagattgctgtattgaaatgaagattttcatagtcttctgtcacttttttcactgtttgatgatacactttatcaagcttgccatcattcaatgtagtgatacggtcacgcattttattgttctcatcaacgatcaaacgccatacacgatccaagaatttacggcttccttctaagccattttcgctccaagcaatcgaagcatctaatggccccatgaacatttcgtacatgcgcagtgtatctgcaccgtaagtttcgaccacatcatcaggattgactacattaccacgagattttgacattttttcgttgttttcgcctaagatcattccttgattgtatagtttttggaatggttcttttgtaggaacaacaccgatatcgtataagaatttatgccagaatcgtgcatatagtaaatgaagtaccgcatgttctgctccaccaatgtagatgtcaactggtagccaacgcttcaacttttcataatctgctagttcttttttgttatgagggtcgatataacgcaggtaataccatgagcttcctgcccattgtggcattgtattcgtttcgcgacggccttttttacctgttacaggatcaacgacattgacccactcctcgatatttgctaatggagattctccagtaccgcttggcttgatgttttttgtcttaggcaaccgtaatggtagctcttcttctgggacagctgtgactgttccgtcctcccaatggatgattgggattggttcaccccagtaacgttgacgggagaatagccagtcacgtaagcgatagctgacttcttttttccctacgccattttcttctagccattcattcattttatcgattgcttcttgtttgttcatgccgtctagaaattcagagttgatgtgcgtaccatcttctgtgtaagcagctttttcaacatctccaccttcgataactggaagaatttctagtccgaaagtttgagcgaattcaaagtcacgttcatcatgtgctggaacagccatgatggctcctgtgccgtatgaagataatacataatcggcgatccagattgggatttccttgccattaactggattgattgcataagcaccagtaaatactcctgttttttcttttgcaagatccgttctctttagatctgattttttagctgtctcttcgatataagcttctacagcagctttttgttcaggggtcgtaatttctctaacaagatctagttcaggtgcaagaaccgagtaagttgcaccgaatagagtatctggtcgtgtcgtaaatacggtataggatttatccgtaccagccactttaaattcaatatttgctcctactgaacgaccgatccaatttctttgcatttctttaatgctttctggccaatcaactaattctagatcatccaataagcgatcagcataagcagtgattttcagcatccattggcgcattggttttctgactacatcatagccaccacgttcacttttcccatcgatcacttcttcatttgaaataactgttcctaattcaggtacccagtttaccgctacttctgcttcataagctagacctttttcataaagcttcgtaaagatccattgtgtccatttataatactccggatcagttgtattcacttcgcgattccagtcataactaaatcctaaagaattgatttggcgtcggaatgtttcgatatttttttgggtaaactcagctggatcgtttcctgtatctagcgcatattgttcagcaggcagaccgaatgcatcccaccccattggatgcagcacgttgtatccttgacttcttttcacacgtgaaaggatatccgttgccgtataaccttcaggatgccctacatgtagcccttgaccggatggatagggaaacatatccagtgcgtaaaattttggcttttcaggatcatcatgggtgttgaaagtattcgtttttgcccagtatttttgccattttttctcaatttctttatgattgtaactcatttgctgtcctcctgttctattgaaaacacttgtttctattataaatataacgaaaaaaccggcagaatctgtttatttttatttccttttgctttgttttctcaaacttcacaaaagaaataaaaaaatcctataaaaagattgctctttttataggacgtaatctacgcggtaccacctaattttaccttagtgaaaaggcctcgaacgttgtaacggccgtcaccgccgcttgcttactcgggtattcagcaagggcaactcaaaggcgagttcaaaagcatccgtgcacattctcaccagccatgcgctctctgaaacttcagtctttttactacttccttttcaagtgttgtcatatttaagtagccttatagtaacaaatatttttgtggaattcaatcgttatttcttcgaacagctattttatttagctacaatcaacgtttgacctggataaataaagttgttcttaatattgttccattcgattagttgagccattgtaattccatgactgtcagcaacactccaaacagattctccagatttcacagtataggttttcgaaccagtaactgattgttggtttgttgattgagatgaacctttcttcacaatcacttgctgtcctggatagatgaaattatttttgatattattccattcgattaactgatccatcgtgatatgatgtttgttcgctacgctccaaactgactcgcccgctttcacggtatacatcgtattaccagtggatgatgtacttgtcgtagcagacgtattcggtgtatttggtttcgctgcagaagtagttgaacctgtatttgtatttgccgaagttccacctttaacgatcaattgctgtcctggataaatgaagttgtttttgatattattccattcgattaactgatccatcgtgatgccgtttttatttgccacgctccaaacagattcacctgctttcacggtataagtgccttgagacgaactgctgccagtattaactgaactgctgttatttgtattggttgacgaacctgtattacctgacgtgctgtttgttgatccactgtttgaaacagtcagttgttgtcctgggtagataaagttattttggatattgttccattggattagctgagccatcgtaattccgtatttatttgagacgctccaaacagagtctccggctttaactgtatatttcgttcctgaagctgtattagaagaacttgagctggacgaactagagccacttgtattcccagtatttgagccagtatttgctccagcattagaagaaccgccatttgatacgattagctgttgtcctggataaacgaaattgttcttgatattgttccattcaatcaattgagccatcgtaattccgtgatcatttgagatcttccaaacagaatcaccagattgaacagtgtatttcgcaccagttgtttgtcctccgtttgatgtaccagcatttcctgaagaattggtattgttaccggaattattcgtcgaagagccattttcctggctacctttgattgtcagtttttgtcctggataaatgaaattgttttggatgttgttccattggatcaattgatccattgtgataccgaatttatttgagattccccaaacagaatcaccagattggacagtataagtggtcgaagttgctgaacctgagtttgtattaccagaattgcttgaaccgccagtactacctgcacttccagtattattgccacctgtagtcgctccaccgcctgcgtttccgctagctggtgtatcatattgggtcaatccgtaagttgcgatgatattatttaatttgcctgcgtaaccaggatcagtcgcataacgccctgtcaaacaagctgtcgcatctgtataggatttcgtgttgctcttccaagtaccggcatagtaataaccgttgccaaatgaagtatttctaagtacataggcattgtcattgaaagattcagcaaaagaaggatattgtcggaaaggctcctttttatttacccattgattatttaaaaattcaagcgtatccatgtagacggtttgtccttgatagctgccttttatcccaaaaagattataataaggtgcttgagataacgcactactgccccaaccgctttctacaactgcttgtgcgatcatcactgatgcatatagatcgttggcttgagcgattggttgagcataagtagcaatttctgtgataaatgccgctgtattgattcttgcgctgaactgaacaggtgtttcatccgcttgaacaggaaccggctgtactaatggggcagcgacagaacagcctaccatcgcagttcccacgattgctgcccctcgttttgcttttcgaaaacgtttggtctgttctaaacgtctccgttcttttcttgcaatgttttccatcttctatcctccaacttcaatttatctattattaataattataacttctcttaatatttattaaaagttatttaagagctttgttgttttttgtaatcatattgtaatttaccgtaatgaacaacttctgttcattttcaagttcttcctacgtctacgttcttgtttaaaaggatttcgaaaaacactgattttatttcactaacatttcatttgcattaccaaaaaatgtctttccgattacagttattttttttataagaatattggttattcaaagaggaatcatacattggttttatctctttaccgtttttttcgctggaccaaaaatgctataataagtcattgcttcaaaggaggaattgtatgaaatataaaacatcatttcaggtggctggtagcttctttcttgtcctgtttttcattttgggctggatcgtaaagttccatctgtcgtggctttctggtttcgatcagtggtttacaggcattgtcagagcttcttatcctgatctgaacagctaccaactctttatgactaaattcggtaatcctcttaccgtcatcattttatttgcttgtgcggctttatggatgtggtataagaaaaaaagggcagaaacattttggttcgtttctggatttattgtaattgctggaatcatcaacccggtgatcaaactatttttcatgcgagagcgtccttcattggcgcacttagtagttgaaacaagttacagtttccctagtggacatgcagcaggcagtatgattctttacggttctttactatttctgcttccagcttttgttcaaaaaagaaccttacgcacattgcttcaattgctgatgatgtttattatagtaagtgtcgggataagccgcatttatctgggcgttcattttcctactgatatcatcggcggctacttactcagtctttcttggctgtgcctgacttatccagtgtatagagaaaaaagaaaacaaatagataactcttacagaaagaaggacttttaatgacttttccttattcagaaggaaataaaagatatcattcttggaattacgctttacgaaatgagtttggcgggaaaattttcaaggtgccgatcgatggaggatttgactgtccgaatcgagatgggactgttgcccatggcggttgtactttttgcagtgtatctggttcgggagacatgatcgttgcacctgaagaccctcttccaatccaattccagaaagaaatcgacatgatgcatcaaaaatggcctcatgtccaacaatacatcgtttatttccaaaattttacaaacacccatgcgccagttgaaataatcaaagaacgatttgagcaagtagtcaatttaccaggtgtcgtaggattatcagtcggtacacgaccggattgtctgccagatgaagtagttgattaccttgctgaactgaacgagcggatgtatttatgggtagaacttggattgcaaacaacttttgaagaaacttcaaaactgatcaaccgagcacatgattatcaaacttatttagatggcgtggctaaattacgcaaacataatatccgtgtttgtacgcatttgatcaacggattaccaggcgaaagtttagaaatgatgaaagaaaatgtcagacgcaccattttagattcagatatccaaggaatcaagctccatttgatgcatctgatgcgcaaaacgagaatgttgcgggactatcatgaaggtcgccttcaattaatgagccgtcctgactatgtcaatgtcatttgcgaccagctggaaatgataccaaaagagatcatcatccatcgtttgacaggggatgcgccgtgggattccttgattggaccaatgtggagcttgaaaaaatgggaagtcttgaatgcaattgatgaagaacttcttcgcagagatagcttccaaggaaaatatgatgtacggaaaaaggtgagcgtctgatgttgcaaactgctttgcatttcagccatacattactgcaagaaatcttgcaaccaggggatcacgtcgtagatgcaacgatgggcaatggccacgatacggtttttctagcagaacacatcggaaaaactggtcatgtctatagttttgatatccagcaacaagcaatcgatgctactcgtgaaaggctagaacagcgtcagttagaagaacgtgtctcattgtttctacaaggccacgaaacgttaggagaagtgatagctgaacaacaaaatctcaaagcagggattttcaatctagggtatctcccaaaaagtgataaagcaatcatcactatgccagagactacacgcacagctatggaagaaatattgaaacgacttgtgcctcgcggacgattgatccttgtcgtctactatggtcatgaaggtggagaaaaagaactggatatggttgattctttttgttccaaactgccacaggaaacatataatgtgctgaattatcggtttatcaaccaaaagaaccagccgcctattttatattgtattgagaaaaaaagataaataaaaaacgcaaaacataaatgatatgttttgcgtttttttctctaatactcaggttagagcgttgatttcataacctctttattcacggtgctcaaaagcttatatctgcggtaataagtccaaccaaatcaaaaacatgagaagctgtttttgattggctgttcttattacttgatgcaggacagctttttcacaacctctttattcaaatacaaattgattatgataaagttccgcataaaatccattttctgctaataactcgtgatgactgccttcttcaatgacttccccatcacgcaagacaacgattctatctgcattcaagattgttttcagccggtgagcaatcacaaagctggttcttcctttgattgcttcatccattgctttttggatccttgcttctgttaccgtgtctacattacttgttgcttcatccaaaatcaataaagatggatttgtgatgatcgttcgagcaatactgatcaactgcttttgacctgtactgaataagttattttcttcggatatctctgtatcataacctttttctaacgtcatgatgaagtcatgaatattcgcttgttttgctgcattgatgacttcttcatctgaagcgtccggtttgccgaatgtgatattgtctttgatcgttccggagaacaatacagattcttgcaaaacgattcctacatgtctacgtaatgcatcaagatcataatctcggatatctattccatcgatgactactgaaccatcattgacatcgtaaaaacggtttagcagattcatgatcgtcgttttccccgatcctgttggaccaacaagagcaaccatttctcctttgtccacattgatcgagacatctttcaagactagtttttctggagaataaccaaaatctacgtgctgcaacgcaagacctttttcaacaccatcaaatgctttaccgttttctggtttgacttcatctttttcatcaaatatttcattcaatcgtcttgcccctgtaatcgctaattggatcatgctgtatccagatgaaatctgcatcagtggttggtaatattgttgtgaatactggacgaatgtcacaactaagcctaatgccaccgaacgttccaaatcaccatttaatgctaaccagccgccgaaaaagataactatcgctgtattgaccagtgacattccttgcatcatcggaaatagtagaccagaataagcttgtcctttgaaggttgcttcgcgaacactttgattatgctctaagaatccttcaatcgtttcttcttgtaagccatttgtgatgatgacacgttgtccgctgattttttcatccatataaccatttagtttccccacttcatcttgctgaagatccacatatttccgtgctttgcggataatcaagacagctatcaaaacggctactggagtggaagcaattgtagcccaagctaactctacattttggcggaacatcatgatcaagatcccgacaagtaaaacagcattcgtgatgacttgaagcaaagcttggttcaaactattttgaatattatctaagtcactggtaaaacgacttaaaatttcaccgtcttgatgagaatcaaagaaacggatcgtcaatttttccaatttgttgaatagaccgatacgcattcggttcgttgacttccctactacttgtgtgaacaaaatactatagataaagttggctgcactagctagtacataaaacagcaagagtttccatattacagaaacaaatttgcttttatcgtctacgccttgcatcaagcctcctacgtaattagctaattcttgaaaagcttccccgatgtattgaggtgcctttacttgtagataggtagcaatgatcactgtgataaagataaagaaaaaggagagtttgtaccgcttcaaatagtgatagaaaaatttacttgcttttattagatcagtcatacttactcctccgttcctttttgagtttcaaagatttcctgatagacacggtttccagctaccaattcctcatgggttccttcgccgactaatctgccttcatccaatactaagatgcggtctgctttgacaacagaagcaattttttgtgcgatgacaatcgtcgttgttcccttcaaatctcgatcgagtgcttctcggaccagcttttcagagcgagcatccagtgcactcgtactgtcatctaggatcaagatctttggattaccgataacgccacgagtaatggataaacgttgcttttgaccaccagaaaagttactgctacgttcttctattggtgcttcgtaacgatcagataacttttcgatgaattcttttgcttgagcaatagaagaagcatgttccatctctttttctgttgcattctttttcccttggcgcaagttttgagcaatcgttcctgagaataaaattgctttttgcaaaacaaaggaaaccgtttgtcttaaactcttttcatttacttgacgaagatctacaccacctacttcaactttgccttctgtcggatcaaatagacgagggatcaattgtgctagtgttgacttcccggcaccagtcgccccgacgataccaaccatttctccaggtttgatagaaaagctgatatctttaagcgtatctgtatcctcaccaggataacgaaaagaaacatggtcaaaagtgacagaacccgtcaactcttgttctggaacgtctaaataagtaagatctggttcagcatctaaaatttccgcaatccgcttcagcgatacggctgctcttgaagtcatcatcatcatcattccgccaataatgattgccatcataatctgcatcaagtagttcatgaatgaagcaattccaccaattaacgtaggatcatctttaacaagatcgctcacaaaaaagatcgccccaaccacagccaaattggcagccagcatgaaggacgggatcatcacagaaaataatgtaccgactatgatgttgtgttttgttaagtcctcacttactttgctgaatgacttcaattggttttcttcttgtacaaaagatttcactacacgaatccctagtaagttttcttttgcaatgctattcacacgatcaatcagtttttgaatgatcatgaagtgcttgcccatccttgtaaatgaaagtgccgtaatcagaaataccgtaacgataagcgctacgatgatccaccataattgcggcatcgtgatcatagctaaaatgaaggcaccaataaataagaatggaattcgaaaaagtgattgcaaagaaatcatcactaaattttggatttgcgtgatatcatttgttagacgaacaacaagatttccagcagagaactgttcgatatttccaaatgaaaatgtctggatctttcgaaatgcttcttctcggatatctgcacttacgccttgagctacttttgcagagaaaatcgtgttcgttacacctgcggctaatcctagcaaagccagactgatcaggtaaataccaattgttttcatttcatcattatcttctgtaataatagcttccaatacttgctgtagtaacttaggttgccataatgctgctgcaaccatgactgctacggacagcaaggaaataaaaacagctactttatattttttcgcatgtcgtaagattaatttcattcgttgattacacccctttgtttaaattgacaggactaatttaacactgtaaaattagaccgactaacaatttaccatgtttaaaaagataatgcaatacacgaggttgataaaatggaaataaagctttctcaagcaatcatcattcaggccgcctttgatatcctggctgaaacacaagctctttcgcagctttccatgcgaaacatcgcaaacagaattcatgttcaagcacctgctttatattggtatttcaaaaacaaacaacagctcttgcaaaaaatggctgaaacaatggaagaagaattagcgcttccagatccaactttgccttggaatgaacagttgctgcagtatatggaaaattactatgacctttatacacgtttcccttgtggggcagaattagaaatcaatactgtgcccgcttttccgagtcgattagaacatttggagcaaatgatccaattacttgttcgtgaaggattttcagtcacccaaagtcatcaggccattgcctctctccacaatttattgattggacagttaatggatcagcagcatgaacagcagcttcgacaaaaaattatggacggaaatgaatttttgaaagaaacagttctatttatgcgtaattatgtagttgaaaatcaattagagggatttaaagaaagtatgcagtcccatgcagaattgaatgaaaaagcactctttctaacgagtgcacaaacctatattgaaggcttatgccaacaaaataaaagaagagaaaacgagcagtaaaaaagctcctatagagatcactatgtttgtgatctctataggagctatctttttaagactctttttttatttttcttccattagccacgccaatgcacgttgaatccattggtcccagaagatccagttatgatcgccaggtccttgttcaaaggtgaccgccaagccttgttcctgcatagcagataccatttcctgatttgcctgataaagaaaatcagattccccacaagccatataaaatcttggaactggttttccgctttttactagttctttcaataagtattgcggatcattttttgaaccttcgatttgatccaatggtccaaagatcccttcccaaaaagatgctttacgaaccatcaaaagatcatccattcgatttcctacagaaacagcgcctgaaagagagattactgctgcgaaattttctgattttgcaaggcctagttttaacgcgccatatccgcccatcgataatccagcggcatatgttttttctctttttcttgttaattgcgggaataattcatgacaaatctcaggtagctcttctgcaatgaatgtccaatacttcatgtcataaactgtatctgtgtaccagccaagatcagtagatggcatgatgacagctaatccgtagtttgctacataacgttcaatcgacgtacgtctttcccatacactatgattgccacccattccatgaagtaaatataaaacaggtatatccgttgtctcttgctctgaactggtgccaatcaccttttttgttgtttgcggtagtatcacatttagattgacttccatttctaacacattcgaataaatatttgcttgaataaatgccatattttcgccttccttagtaagaagttatttttgaataactttaaatttgaatgattcggctacgtacatatcttaaccgaaactactgttttattttaccacttttgtcatgaacgaaaagcgttaagaccaaagcaatgatcacgagtaacaagccaactagataaacggaatgtaacccatcataaagtatttttcttaatggtaacaaaatatccgcatcaatatatttagccgtttgtggattcaccagtttattcatgatatctgcatcatttgttaaatttgctgctgcaagttctcgtttagttaccccatttatcaataaaccaaaaatagaaaccatgactgtttgaccaattgttcgaactaacgtattaaaagaagttgctacaccaagctggtcacgagatacactattttgtgcactgacagtcgaggtagtcatggtcacacctaagcctataccgatgaccgttgatatagcaaaaaaccataaatagttacttctgaaaggcataagatacaaccaagcgcccccaatagctgcgattagtagtccaattctcaagacccaatgagttttcatttgagtcatccacttgcttgcaaggaaagaaccgaccatccagactagtgataatggtgctaataccagcccaccaattgctgcattcagccctaatacaccttgcatccacatagggatataaacatcgattcccatcaaaaaaccactagccaatgctgcagccaagttgaccacaacaaatagtggatttttgaataaatgcatcatgatgacaggatctttagctcttttttcggcaaaaacaaaaatacctaacattacgatactacctagcagcaaagcagaaacaagcggactcattccttcgtctcctaataattggaaccctaacagcaatgagacaagcatggccatcaaactaaaactaccaaaaatatccattggtttagactcatgtatgatttttggttcatttaaatatagccaaatcaaaataattaatagaattccgatcggcacattgataaaaaagatccagtgccagctgatcgtttcaacgatgaatcctcccgcaagcggtccaaaaacactggcaatcccccaggctgaactattcaaacctaaaacttttgctcgcttttcaatagaataaagatcgccgatgatcgtcaaagctactggcatcattgccccagcacccatcccttgaatcgcacgagcagcaatcaacccaatcatgctttgagataaaccgcaaaataacgaaccgataataaacaataatgtcccaaaaataaagattggtttccgtcccactttatccgcaagttttccgtaaatcggagtaagcatagcgtttgtcagcaaataaatcgaaaatacccagttcatgatttccattccatgtaatgaaccgacaatcgttggcatagcggttgttacgattgtaccttcaatagccgtcatgaacgttgcaatgaaaatactcactgtgaccaaagtaacatttgtttcttttttcatcttattcctccctttcattatgacaggatctaaaaatagataaataattactatctttttcaagaggttaactgccataaaaaaagctggaacaaccaccacttggcgatcgttccagctgaatataacttattttgctaaacttgctttcaacgcatctactttgtccgtatgttcccaaggcaaatctacatctgtacgaccaaaatgaccgtaagcagctgtttgtttgtaaatcggacgacgcaaatcaagcatctcgatgattcctgctggccgaagatcgaagttttctctcactgcagcaatcagttcttcttccggaaccgttccagtaccgaaagtattgattgagatcgaaacaggttgagcaacaccaatcgcataagctagctgtacttctgctttgcgagcaagccctgctgcaacaatgtttttagcaatataacgtgcagcatagctggcagaacggtcaacttttgtcgcatctttaccagaaaaagcaccgccaccatgacgagcataaccgccatacgtatcaacaatgatttttcttcctgttaatccggcatccccttgaggaccaccaatgacaaatcggccagtcggattgatataatatttcgtttgatcatctaataattcagctggaataacttccttcactactttttcgatgacatcatgacgaattgtttcattatctactgcatcatcatgctgtgttgaaataacgattgtatctacgcgttccggttgtccttgatcatcatattcaaccgttacttgagattttgcatctggacgtaaatacgttaattcatttgatttacgcaaatctgccaagcgtcgtaccagacgatgactcaaagcgattggtaaaggcatcaattctggtgtttcatctacagcaaacccaaacattaaaccttggtcaccagcaccaatctcatctaatacgtcttttttatcttcatcccggatctcaagtgcttcatcaactccttgagcaatatcaggagattgttcatcaatcgcaaccaatacagctgctgtatctccatcaaatccgaattttgcacgtgtataaccaatttcttttattgtttcccgtacgactttttgaatatctacatatgccgtcgtagatatttctccaaatactaaaacaagaccagttgttacagacgtttcacacgctactcgtgctgttggatcttgttttaaaattgcatccaagattgcatcactgatttggtcagcaattttatctggatgtccttcagaaacagattctgatgtaaataagtgtctttctaccattataatgattccccctagttaaattcggttacaaggcatctccgtcctgcggatcctttcgggaacttgcaacgaaccaagtatagcagataaaacagttttctgctcgtattttttcatttttttgcttaaaaaatataaaaatattttacattagaactgtccaaaaaagcttagcacaatcatccataaagataactctgctaagctttttaaaatcattctttcagataaaaagaaaaagatactcaaaaagtatcttccatgacccgtacgggattcgaacccgtgttaccgccgtgaaagggcggtgtcttaaccgcttgaccaacgggccaataaaataaatgggcctaaatggactcgaaccatcgacctcacgcttatcaggcgtgcgctctaaccagctgagctataggcccataaaaactaaaagcgggtgacgagaatcgaactcgcgacaacagcttggaaggctgtggttttaccactaaactacacccgcataatggcgcgggacagaatcgaactgccgacacatggagcttcaatccattgctctaccaactgagctaccgagccaaacggttccgacgggaatcgaacccgcgatctcctgcgtgacaggcaggcatgttaacccctacaccacggaaccaatgtttttagtttttaattgcgggagcaggatttgaacctacgaccttcgggttatgagcccgacgagctaccagactgctccatcccgcgataatatgaaaaaggaggataagggattcgaacccttgcacggttttacccgcctgacggttttcaagaccgttcccttcagccggacttgggtaatcctccatatgaaacttacaacgccacaatggaccttgtaggactcgaacctacgaccggacggttatgagccgtctgctctaaccaactgagctaaaggtccaggctcttaaaaatcgcggcggaggggatcgaacccccgacctcccgggtatgaaccggacgctctagccagctgagctacaccgcgaaaaagatattcattatttaaatgaaatggagcctagcgggatcgaaccgctgacctcctgcgtgcaaagcaggcgctctaaccagctgagctaaggccccgtgtttaaatttataattatcgggaagacaggattcgaacctgcgaccccttggtcccaaaccaagtgctctaccaagctgagctacttcccgtttaattaacgcgcccaagaggagtcgaacccctaaccttttgatccgtagtcaaacactctatccagttgagctatgggcgcatatttgaaatgccgaggaccggaatcgaaccggtacggtgatcactcaccgcaggattttaagtcctgtgcgtctgccagttccgccaccccggcgcgattgctttggcaaagcggaaaacggggttcgaacccgcgacccccaccttggcaaggtggtgctctaccactgagctatttccgcgtgtttaaagatgccggctaaaggacttgaaccctcgaccctctgattacaaatcagatgctctaccaactgagctaagccggcatgtaaaacttaaattatgcgggtgaagggacttgaacccccacgccgtaaggcgctagatcctaaatctagtgcgtctgccaattccgccacacccgcaaaaatatgagccgtacagggctcgaacctgtgaccctctgattaaaagtcagatgctctaccaactgagctaacggctcatatggaggttaacgggatcgaaccgctgaccctctgcttgtaaggcagatgctctcccagctgagctaaacctccatggataacttaagcgtggcgacgtcctactctcacaaggggcaacccctcactacaatcggcgctaagaagcttaacttctgtgttcggcatggttacaggtgtatccttctcgctatcgccaccacactgtggtgttatcttttattgagtaaattttgttcactcaaaactggatttgaagtcacataagtttttttccgagttcttttcttttaacctattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgattagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctgtcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcgacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaactaccatattggagtcctacaaccccaacaagcaagcttgctggtttgggcttttcccgtttcgctcgccgctactcagggaatcgaattttctttctcttcctgcaggtacttagatgtttcagttctctgcgtctacctcgaatgtgctatgtattcacacaatcgtaacatcctattaaagatgttgggttcccccattcggaaatctctggatcatagcttacgtacagctccccaaagcatatcggtgttagtcccgtccttcatcggctcctagtgccaaggcatccaccgtgcgcccttattcacttaaccttatcaaccttgcggttgggttttgatccttcttctagcgatagaagttagatcaagaaaataagcaattgaacttattaaaaaactctatccagctcacaaatcagcctgtgcggcaaaaagatcgatcgtctcataaaatcaaagattttatagccgtccgcctattttgctttaggctaaacaatttgttcagctttcaaattcaacgcggtgttctcggtttgtattacttacatttacttcaaatatccagttttcaatgaacaaatttaacaactaatgttgttaatggagcctagcgggatcgaaccgctgacctcctgcgtgcaaagcaggcgctctcccagctgagctaaggccccgttttaaattgagagtaaacctctcaaaactgaacaaagtaaaaacaaattgtgtagtctccgtaatattccttagaaaggaggtgatccagccgcaccttccgatacggctaccttgttacgacttcaccccaatcatctatcccaccttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgcatcgtggccttggtgagccgttacctcaccaactagctaatgcaccgcgggtccatccatcagcgacacccgaaagcgcctttcaaatcaaaaccatgcggttttgattgttatacggtattagcacctgtttccaagtgttatccccttctgatgggcaggttacccacgtgttactcacccgttcgccactcttctttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaaaaatgtttgttgtcttgaattgaatcaagacgccctacacatttggtttgtcttactttgttcagttttcaaaggtctacttcatcgagagtgtttcccgattcatttttggctgccgtagcaacttttatatcatatcagagagacaagcgattgtcaactcttttttaaaagtttttttcgatttcgtttttcgaaatctttcggcaactcatttatcataacttatcgtttgttatttgtcaagaacttttttgaagtttttttcgatagaatcaagcttcgcaagtggttcttttttaacgactcagttatcttatcatgtcgttagtaacatgtcaataacttttttgttatgtttttgaataaatattttcttctgtcttttggacaagtaataatataccaactaaatttagcttggtcaacgaattttttgtattttttcaagtttttttcaataaacgattattcataacttttctttctttatcgttcgttttcgtcttctttaatgtctagaatagtcggcattagcttttgaactttcgttattatttattcctttctacacagcaaaagctgcctaaggaattccttagacagcttttattcgattatctcattgttgggaatagcaaaacatcccgaattgattgtgcatcagttagcaacattactaatctgtcgatcccgatgcctagaccaccagttggcggcataccgtattctaaggcttccaagaagtcttcgtctacaccgtgagcttcgtcatttcctagttcacgttctttttcttgcgcttcgaatctttctctttgatcaattggatcgttcagttctgtaaaggcattagcaaattcgcgccccactatgaatagttcgaatcgatctgtgaatcgaggatcttctggatttttcttcgctaaaggcgaaacttcgactggatgtccgtatacaaacgtcggttgtgtcaatgtttcttcaacaaatgtttcaaagaattcattgataacatgtccgacacccatagcttcggttacttctacattgtgtttttcggctaaagctaatgcttcttccaatgtcatttcttgccagaagtctacaccagtttgttctttgattgcatctaccatatggatgcgtttaaagtcactttctaagtcgacagcttgtccatcatatgtgatttttgctgttcctagtactttttcagctgcgttacggataataccttctgtcagattcattacatcattgaaatcagtatatgctgtgtatgcttctaacatcgtaaattctggattatgtgtagtatcaattccttcattacggaaaacgcggccgatttcataaactttttccattccgccaacaattagtcgttttaaatgaagttctagcgcaatacgcaaatataaatcaatgtccagtgcattatgatgcgtgataaatgggcgtgcggcagctccacctgcctcattgtgcaatactggtgtttctacttcaatatagccattgccatctaaatagcgacggatttcgctgataatttggcttcgtttcataaatcggtcaaagctttcgcgattactgattaaatccaagtagcgttgtctgtagcgttgttcaatattcgttaagccatggtatttatctggcagtggacgaagtgcttttgacaaaatcgtgatttctgaagctttgatagaaacttcgcctgtgtctgttttcatgatttgtccagttacaccaaagaaatctccaaggtctgcatgtttgaatacttcataggcctcatcacctacttggtcttttcttacataaatttgaatttggccttcacgatcttgtagatgcgcaaatccagctttcccttttcctcggcgagtcatcatacgaccagctacactagcggtcaatcccatttctgctagttcttcttttgttcttggatcaaatagttcatgcaattcttctgagttgtgcgtgcgttcaaatcgttttccaaatggatcgattccatcttcacgcaattgttccattttttgacgacgtacaagcatttgatcatttaaatcttctacttgatgttgttgttcctgtgtcacaaaagttcctccattctcatgttaatctctttcctataatgccaatgaaacacaaaaaaagcaagccgaacttggaatttcggcttgaaaattcacgaaaaacttagaaatcacaacgtttgtttcaatagtactttttccgctttttctacaaattgatccagcaggtcattgatttcttgctgtttttctgtctgattgattgctactttcactttcgctgctcgaggaatcccttttaaataataagccgcatgtgttctgaattctctacaagctactttttctcctttgagatctgctaagcgttgtaaatgaagtttagctgtagcaattttttcggctggtgttggttcaggaatcagttctcctgtttcgagataatgctgtgtgcggtgaatcatccatggattgcccagcgctgcacgaccaatcatcacaccgtctgcaccgacatagtcaagcatccattttgcatcttctggcgttttgacatccccgttccccataaatgggatcgtcaaatgttttttcacttctttcaatacttcccagtccgcttttccttcatacatctgaacccgtgtacgtccatgcatagcgatggcacttgctccagctgattgtgctgctaatgcattttctacagcaaagacgtgctcttcatcccaaccaatacgcatcttgattgttactgggatatttactgctgaagaaacagcttggaccatttcgtatactttctcaggatctaaaagccattttgctcctgcttctgctttgattactttatttactggacagcccatattgatatctattatatcggcagctgtgttttcttcgacaaattgagcagcttcaactagactatctttatttccgccaaatatctgtaaacttaatggatgttctgtttcttcaatgtggagcatctctaaagtttttttgtttctgaaatgaataccttggtcactgatcatttcacatacgactaagcccgcaccaaattctttgacagtgactcgaaatgctgaatttgttattccagccatcggtgcaacaacgacacgattagggatttccacattgccaattttccatgtgtgttccacttaaatccctcctaaggcttctttcttcaatccatctaattcttcttcgctatacttgtatttgttattacagaaagaacaaaccgcttctgcaccgtgatcttcgtctatcattgcttggatttcttctgcacctaacgcgataattgcttctgcaaatttttcttttgaacagtcacatttgaattgaacaggcattttttccaaaatgttcaattcttctgtaccaagcaatcctttcaatatttcttctggtgtctgtccttcatctaagagggtagagattcttggtgtcgtttttaattgttcttcgatcttgctgattgtttcttcatcggcacctggcatgatttggatcatgaatcctcccgccgtcttgatgctgtcgtcagtattgaccaatacactcagtccaacagctgaagggatttgttctgagatagcaagatagtaagtaaaatcttcagcgatttctcccagaaacaatcggcgtttgcccagaaaaaggttcttttaatcctaagtcttttgtgacagtaaacattccttgtgttccaactgctccccgcacatcgattttaccttcactatttagaggaagactgagatgcggatttttgatgtaacctttcacatctccctttccatttgcatctactacaattcctgttgctggaccatcgccttggattcgaacagttagtttgtcttctcctttgagcgtcgcaccaagtagcagactaccgaccaatgtccgtcccaaagcagctgaggaggtgtgccaagtatcatgacgtctttgtgcctccgctacggtatttgttgcttgaacggcgtatgctcggacgaatccgtcgtgagcaagtgccttaaccaaataatctttcatttgttatgtactcctttttccgtttttaaactcatagtgaatcatactagcaactactgcttttttcaactttggaatgcttcttttaaaaataattcagaatcatctagaaaacaggacatcaccctatttacaacttaaataaagaaatctcccgaaaaccggtttttgttccggttttcgggagtcatatcagatcaattgacctatatttttttatttgtattgatcgtctgaatgattatcttctgattgttgagaatctgaatcatgttctgctttattttcctcattcagttcatgttttgcttcttcaaaatcacgtttttcttccgcttgtttttcagcgtctttttcttccaaagcacgttttgcttcttcaaaagttttcgcttctttttcgcttggataatcatttgactcagtaccttcaggcatcacaccgtgttcaaacaatgacttgattgctttggcatccaatgtttcgaattccaaaagtttttcagcaatcagtttatgctgtgcacgatgagcttcgatgatttctcgagctttatcatgagcttccatcaagatttttcgtacttcttgatcaatctcgaaagcgacttgttccgagtaagcttttgtttgaccatagtcgcggccaacaaacacttgatggtttccttcatattgaacaggacctaaacgatcactcattccatattctgttaccatgcttcgtgctagagctgtcgcttgctcaaagtcattggaagcaccagttgattggacattgaagatgatttcttcagctgtacgtccaccaagtaagcctacgatttgttcaaacatatcttctttcgtcatcaagaactgatcttcttttggtaaagcgatcatatatccgccggcgcgtccgcgagggatgatcgttactttgtggacgacccgagcgcgactcaatactaatccgacaatcgtatgaccagcttcgtgataagcaaccatttcgcgttcttttttgctgattacgcgatcttttttagctggacctgcaatcacgcgatcttccgcttcatcgatatcagaagcatcgattttctttttatttcttctagcagctactaacgctgcttcattcaagacattttctaaatctgctccggcaaaacctggtgtctgttgagccacaactttcaagtcaacgtcatctgccatcggtttattccgtgcatggactcgcaagattgcttcacgaccttttacatctggacgtccaactaaaatctggcggtcaaaacggcctggacgtagtaacgctgggtctagtacatcagaacggttggttgcagcaatgacgattactccttcatttccgtcgaagccatccatttctacaagcaattggttcaatgtttgttcgcgttcatcatgtccgccgcccataccggcaccacgttgacgacctaccgcatcaatttcatcaatgaaaatgatagctggtgcgtttttcttcgctgtttcaaacaaatcacgaacacgacttgctccaacaccgacaaacatttctacgaaatcagaacccgagatcgagtaaaacggtactccagcttctccggcaacagcttttgctaataaggttttacctgttcctggaggtccttctaaaagtacacctgccgggatacgggcacctaattcaacaaatcggcgaggatctttcagaaattcaacaacttcaactagttcttgtttttcttcttccgcacccgctacatcagaaaaacgtacgcgattagcttttttgtctgcttctttggcttttgatttaccaaagttcatgacacggccgccaccgccaccgccgccgccttgttgtcccatcatcatgtaaaagaaaaagatgatgattacgattggcaagaagctaagcaatagggaaacccatataccgctgcttgattcttcttttactgttgtagcaactttgttttcttttgccagttctgttacttggctcaatgttgtatcatttggcaaaatgattgttgtgaaatgggtagtagtcgtatctgttgaacctaagatagctaacccaccgctgttagcgacggtctgctgttctttgtattcaccagtgatcttatatacaccatttgcaggctgcacttcaaattctttgatcttgcctgcttgtagttgttctgtgaattttgagtactcgatatctgacgatcgctggccgttattaccaaaaatgaaataaacgaccattaccatcgctaagattacgaggacataatacaaggcatttttcatcatgccgttgttctttttgttcatagttgccctccctaagcgtcaatttaatttaacagttttttatcaatcctgaccattctattgtaccataatttaattgagatacagcattaatttgattgataaacactaggtttcaatacaccgatgtacggaaggttacgatatgcttctgcataatccaagccataaccgaccacaaattcatttggtacgttgaagccaacataatctgcttcgatatttactactcttccttcaggtttgtcaagtagtgtaacaattttgactgattttgctttgcggtatttgaaaagatccactaaataagcaagtgttcttccgctgtcaatgatatcttcaacgatcaacagatcgcgaccttctacattcgtatctaagtctttgacgatttttacttcccctgacgagactgttgcattcccgtagcttgaaacatccatgaaatccaattccaaatacgtatcgatagaacgaacgatatctgccatgaatggtaccgctccttttaagacacctactactaggggattggtgttttggtaaatttctgttaactctttgcctagttctttgcaacgaacttgtatctcttcttgtgagatcaaaattctctcaatatccttttccaacatcaggttctccttccaattgcttctttttgatatttgtaaagaagtatgtagtgtattttatcagtttcttcacgaatactcaaatatgaaaaggcaaaaggtatcaagctatatatatttcttttggcatctgtaatgatccaagcatgctgcctttgtgaattaggtactttctgatcgataaaatatctagatactttttttgtgagattctctgttaatttaatgcggtctcctgcttttcttttttcgacatacagttgcacatcagcaggaatccaaatgtcatgagaaaatagagaccatgaatctgttgctttgatgtcccctgcattttcaggtttgaccagaccaatccattctgtttcattcaaatatattccttgttctggaatcagcaacaagcgctggtcttctgtctggctagttgcttgtttttcttttttagagagtacaacaaaatgatactctcttttcagtatccaattattgccaatactgagttgccattggctttttttctgttgccactggtctaaaatcgactccatttgttgttctttcaaaataattcctgtttttgagaatgctttgtcgaaaaaggagtaaaaaaaatagtatcgttcagcatctgtcatttcttcaatcatttctgcagaaaatcgaaattgttcctcccactgttcgacttccttttcgatcaactgtcccatatatttttgaatgacttggtctgcccattggatctgttgcgaaaattgctggaaatgtctcaacgcctgtgtattttcttgtttcaattgaggaactaccaaatgacgaagccgatttctctggatatctaacaattggtttgtctgatcctcaaagtaaacaagctgcgattccgctgcataagtatataggtcttctttgctaaaactcagcaacggacgaatcagtctgcccgtagcaaatggttgtacttctttgattccagaaaaagtatttaactgtcccccacgaacgattttcattaacaccgtctcgatttgatcatctccgtgatgagcagtcatcaacgtgtcatattgtccttcttccatcacgcgagtgaattcttgataacgaaagttacgagcttctgtttctatggcggatttggctggatcttcccaaatacttacatataaagggagattcttctcttcacaatatgagcgaagataggcagcttcttctgctgattcttctcttaattggtgattgatgtggacgatacctaaagaaaaaccgatttggcgttgcacttgtaaaagtaaatggagcaaaaccatcgaatcaacaccacctgataccgctgctaaaattctcgatccttgttgccagaatccttgttcattcccgtgccgaataaatgactgctgtaatagcggtgcttttttcccgcctttttcaacgttcatcctttccacaccctttcttcctaaaaaaaagagagcgggaaaacgtctaaaacgacaattaacctgccctctgttgatactatgacccaaatagtcgcactatcattatttgcggctttttagctgcgacgtccgccacggccaccgcgctttccttctgtgtttcgcttcaatgaagataagcggtcatcgctatctttcaaaaatgaactcatcaatgaatcgaagtcttctttttgagctgaaggttgactgcgagaaaaagattttttctgtgctggacgatttcggttgtcacggggatctttttgttgatattttttaggacggctttcttctccagattcagcaggttgttcctgcgctttccggatagatagtccgatttttccatcatcatttactgaaataactttaactgttacttcatctcctacacttaaaacatcatggatgtcttttacatagccatttgacacttcgctaatatgaactagacccgtttttccagcacctagatcaataaacgcaccaaaatttgtgattcctgatacttttccttgcagttttgctcctacctcgattgacataaaaaaaatgttcctcctaattatttcccttttttatattcctgcttattttgcagttgtagaactagttgattgatctgtttcatttgtcgagctgtctgtatttgattctaatataggataaactttttcaccgtcttttgagtaaaagaatttgcttctggcaagtttagctacatactcatcatctttcagcaatgaaacatcttggtgcagctgatcaacgtctgcgttgacttctttcatttcagtatttgcttcgactctcaattcgttcaattgatgcatcctttgcatgtcatggaaaatctgcacacctattatcgcgaaaatgaccaaagcaccaacaaaaattgcagccagtctgcgtcttcgaaaaatcagttgacgttgttgttgctgaaattcagcatactttttctttgcatattccgtatctagcgcagcgattttattgctttttttcgtcacttggattcgctccaatctttttgattgtctttttcattataccaatatcgtgaaagcttgtctaatctatttctctagtgtttctgtgcgattttcagaaataatttcgtacattttttgtgcatcttcttttttggttgattcatgtaattccgtaattttcacttccaacgttttgttgccaaactggactttcaaaatatcgcctactttgacatcactggaagatttcgccaatttaccgttgatttgaattcttcctttatcagctacttcttttgctactgatcgtcttttgatgattcgggaaatttttaaaaatttatctaatcgcatatcttattcctcactttttaatttttttatttaatcgcaggattttcttaccaaaaggcaacattagccattctcgtactgtaaacagacgaagacgaatcactgcataaatgaacacagaagccccgatcccaactcctatcacgctgacaaaaaaagcagtggaacgatgagttacaggaccaaatactatattcaatacaccataatacagcagcagtactactgtcatacaaagaaggctgaacatcaacttccgtccaaaatgccgttctttccaaaaagcatttagctcttttgtttcaattcgaacaaaataccaaagcgtcacacctaatcctaaaagggtagacaggcttgcacctgctgttcctaataaaccggtcagaaaagaagtagtcaatccttttaccaatagtccccatcctgcgccttttaaagaagggcgaaacgagttcttgctttgagcaatactttgataagcttggatgactgcagtgaaagcaatggaaaaaacaaataatacaagcgctgcatttcccgcataatctttaaacaacgcataattgatataagggagcagcaaggctaatcccaaagacgcagctaatgctaaagcggtcgtcaatctaagatagattttggctgtctgtaaaaactgacgatagatccggttggtcaaatgacgagtcaacgcaggcaggaatgtcgcacttaatgcagtggcaatcactaaacctaattgtactaaaggctgacctcgatcatagaccccttttgctatcttcgcaccgtattctgacagtccgtaaacttccaaagcattttttacaaagaaagagtcgatcagctggaaaaagataagcaatccactataaatcgaaaccagtccgccttctaccagaaaacgccggatcaagggctttgacggctgtttgaacaatggaaaccgtcggaagcttaacgctcctccatgaatcttttgttcatagtagtgaaggatcccatatgcgcataaaccgccaaaaacagctccactcattgctgccgtccctgtttggtacaccgtccatccaagctttctaaaagcaaacgcactacagacaatcacaaaaacacgaacgaactgctcaactacttgagaaacagcagttggttccatcaagaatcttccttggaaattccctcgataaaaagatagaccaggcatcagcaaaaaggtaaaggaaactacttggatcagcggtttcaattgtatgtctcccatcatccaagcaatccagctgctaaatgcaaagacaaacaaccacaaaaagacacctgtccaaaatactaagggataaagattttgcaaagcttgctttcgctcgaaaggattctttctttctgcaacgtactttgatatgaactgcggaagaccggataaagctaaagtcattgctatcccataaattggataaacttgctgataaacataaaaaccttcgtcgccgactaagttttggaggggaattcggtaaagggcacttaatacttttgctatgaaagaagcaatcgtcaatacaaatgctccttgcatgacgcgccgcatttctttatgatccaaatcattgctccttcctacgctgacagatatttttgctcacgcaacgctttgacaaacttttggatttcctgaagccatactgcttcttccatttggttggggatcgtcaagcgtatcaccatctgttctttttcaacgcctagactggcttttagttttgtcgctgtcagtgcttcgaataactgttccacactatagcgttttgttccaactttacttagagtaaagactatatgcgcctcctgtttccttatcgtttctaggagcgctcgatcgccatccattttgatctgcccaattgtcaagagatgtgctacttcttctggatattctccaaaacggtcgagcagatcatcttctagttcatctagcatttcttgcgaatcaagttcacgaattcgtttatagatctcgattttctgccgttgatctgccacgtatgtttcaggtagatacgcatcgacaccgaggtcgatctcaacagtggtcttctccacttgactattctttccttgtttacgagaaacagcttcgcttagcatttgagaatacatatcgaaaccgactgcatcaataaatccatgctgctgagcacctaagagattacctgcaccgcgaatggaaagatcccgcatcgcaatcttgaatccagatcccagttctgtaaaatctttgattgcctgaagacgtttttcactgacttcgttaaggatcttctgctgctcatacataaagtaagcatatgcgacacggctgcttcttcctacccgccctcgcaattggtataacgtggataatcccatataatcagcgttctcaacgaacaacgtatttgcgttcgggatatctactcctgtttcaatgatggttgtagtgacaagaacatcatattgaccttcaataaattcaaaaagcgtattttctaattgcgcctctgtcatttgcccatgagcataaccgatccgtgcttccggaacgagttcttggatttcttctactttttgttcgatcgtttctacccgattatataaatagaatacttgtccacctcgtcccatttctcgatggattgcttcgcgaatagccccaggatttttttccataacatacgtttggatcggataacgattcgcaggcggtgtttcgattactgaaagatcccgcacgcctaacatcgacatatgcaaagttctcggaatcggtgttgcagtcagagtcaaaacatccacttgtgcacgtaactgtttcaatcgttccttatgttttacaccaaaacgttgttcttcgtcaatgatcagtagacccaaatcgctaaattcaatatcttttgacaaaattcggtgggttcctacaacaatatcaacttgacctgtacgcagttgttcgatggtttctttttgttgctttcttgttctgaaacgacttaatagcccgatatttacggggaaaccttcaaatctttccagcatcgtttcatagtgctgctgtgccaagatcgttgttggaactaaaaaggctacttgtttgctttcctttatcgctttaaaggccgctcgaagcgctacttctgttttcccataaccaacatcacctacgagtagtcgatccattggtttttctttttccatatcccgtttgatctccgctgcacttctcaactggtcatcagtttcagagtaggggaaggcattttcgaattctttttggtaggcgtcatcaggtccaaaagcatatcctttttctgactctcttgcggcatataatttgattagatcgtcagcgatatcctcgatttttgaagagacttttcgcttggttttcgtccattcacttccgcctagcttattgatgcgaggcgctttggcttcagaggcgacatatttttggatcagattcagttgagtaacaggaataaacagtttgtcgtcgttttgatacaaaatagtcatatagtcttggtgaacgccatctacttctagcgtttccatcccaatgtatttcccgataccatgattggcatggacaacgtaatctcctgcttttaactcattatagcttttcaatcgctctgcgtttgttactgtttgacgtctcgtttgttttttcgtcgttttttggaaaatttctttttctgtgatagctactattttttcttgaggaagttcaaaaccagcctgcaaagctccttcaactaattgtacctgtcctctgatcaatgcatttttttctgtttctactactaatatgtcttcatctcgaagcatttgttctgctttgcgtattctgtcctttgtcggaataaagatcacaacagtctgtttttgcttgcgccaacggtccatttctgttttcagcaatggcatttgtccgaagaactgttgcatcgtccgatattgaaaattatggattgcttggaaacgaagatttcccatccctttttggaagagtgagaaaaaggttgtggtgaacttttccttctgcacgattttttgtatatctgctgaaaatgtctgctcagaaaacacccgcaattcgctgattttttgagtctgccattctgccgcttccctttcgatttcccgatttgtttccatgattcgctgataatcatcaacgactagtaaactatttgaagggaaataatccaagatcgtcacagattcttggtaaagaagatctgagtagaattttgcttcttctgtcgggacacctgcttgccagcttgaagtcagctgaccgaagtaatcttgcaaaaactcgcggtctgcttcttctgtggtcgcagcaagccgtttttctagcattttttgcatttgctctattccatgttctagatcctctggtccgtagacttgttcactcgttggggaaacccagatttcttccgttttttcgattgagcgttgtgtttctgcttcaaaataccgcatagaatctatctctacatcaaatagttctacacgaacaggataggttgtcgttaacgggtaaatatcgataatgcttcctcgaatactgaattctcccggttttgcgaccatctcttctcgtacatagcccatcaaagtcaattggcgaggaagattttccacgtctatctcatcaccaatatgccaattcaattgcgcctgtagccaagttttcttattcggcagtcgtttgtgcaaagatgcgactggcaacaaatagatacctgcttttttttcttgaagtgcgttaagcgttgcaactctctcgcctcgcgcttctggagaagaaaaggccatttcagcagaaagcacttcatccactggaaataaatggatctgatcttgcggaatcacatgttgcagatcttctgctaactgattcgcataatacaaatttggcatcagaataatcatgtttttatttgttttcttaaacgctcgagcaaatagaagtgttttcgctgagcccgctaatcctgtgattagttgtctaggcattttttcttctaaattgctgacccattcttttacttgcggatcttttccgactaattgaataatatccattccttttcctccttcctcaattgaatcgattcatcgcatccacgaacgaatgcccttctatgagatattcgactgctttaacagattgacacatgctttcttctatcaaaggctgattttctttgctgaaaggactaagcacatgctggactactgtttttttcccttctggcctgccgattcccaccttgattcgatcaaagacattcgtattcaaatgggaaataatacttttgataccgttatgcccgccggcacttcccttttgacggagccggatttttcccactgccagatccaaatcatcgtagattacgactaattcctctggataaatcccaaaataagtcattagtgggccgactgcacgaccagattcattcatgaatgtttgtggtttgactaaaaggatcttttctccattatgaaaaaattcggcaacttctgcttcgaacggattttttttgaaagtagcttgatgctcgcgtgcaattttatccacgaccataaagccgatattgtgttttgtatattggtatttggtacctgggtttcctaacccgacgatcattttcatttttgttttccacctaattctaaaaagcagcacaaaaggctggactgctaattagcggtccagtccatcgagcttttttcttttttatacttgtcaatgcatagtataacacaaaacaaggcgtttcggctaaaagagaatcgttaataaatgataaataaattaaaaatttcttcaaagtttaatgaaataattgatatataaaaatagtgaaataacgcacatgtaagcttttacatataatacaaccttgttatctgttatattttatagccaaatagcgtgacatggggcttgagaaatgttagcataagcatgggaaaaaacaaatcaatggaaggattgatactaaatgactgcagctgcagaaaaaaaagatcatcaaaaagttattcttgttggagacggcgccgtaggttctagctatgcctttgctctagttactcaaaatatcgctcaagaagtaggtattgtggatatcaatactgctaaaactgaaggagacgcaattgacttgtctcacgctttggcatttacttcacctaaaaaaatctattctgctacttacgcagacgcacatgatgctgacttagttgttattacagctggcgcaccacaaaaaccaggtgaaactcgtttagacttagtaaacaaaaacctaaaaatcaaccgcgatgttgtcacacaaatcgttgaatcaggatttaacggtatctttttagttgccgctaacccagtagatattttgacttactcaacttggaaattctcaggtttccctaaagaacgcgtaatcggttcaggtacctctcttgactcagctcgtttccgtcaagcacttgcggaattagttgacgttgatgcacgtaacgtccatgcttacatcttaggtgaacacggagattcagaattcccagtttggtcacatgcaaatgttgccggcttgcaaatctatgaatgggtaaaaaacaacccagaaatcgatgaagaagctatggttaacctattctttggcgtacgtgacgctgcttacacaattatcgagaaaaaaggcgctactttctatggtatcgcagtagcattagcacgtatcactcgtgccatcttagatgatgaaaatgctgttcttcctttatcagtattcatgaatggcgaatatggattgaacgacatctacattggtgcacctgctgttatcaaccgtcaaggtatccaaaaagtaatcgaaattcctttaagtgacagcgagcaagaccgtatggctgcttctgctaagcaattaaaagaaattctagatgaagcttttgctaaactagacgctgaataatctttgaacatgacggaaaacatctattcggtgttttccgtttttttattttatcacccttatggtttctaaattttttcataaagtagagataaccttcgtcttttcctctaaattatgctatcatgagaccgttccaccctaaacttttacttaaggagttgtcgatatgacaagatcttcgcatcgaaaaaaatcgaaacatgttgctttgctttcagttcttggtgttctcttagtgctgatcagcttttatacctatcgcagtacatactacacaaagcattttttgccgaatacagaaataaatggaataaatgtcagcaatctaacagtcgaaaaagcaaatgaaaaattaaaagaagcttattctgataaaaaactggctattaaagaagatggaaaagtctggcaggaagtaccaaaatccgagctcggctacaaagatgatttcacttcggagctttctccgatcctaaatgaacaaaacggatggacttggggaatgacttatgtctcagcggcagaaaaacaagaaatagatcctgtcagtcaaaaccaccaaaaactagacactaccgttcagacattgacaactaagctgactgatttgaacaaagaccggacacctactactgatgcaacgatcgaaaaagcaggtgactctttcgttatcaagcctgaagtcaatggaaatacgatcgacgtcgatgctgcggtcaaacaattaaaaagtgcggtaaactctggtaaagatacaattgaattgactgaattcaaagaaaaaccaaaagtaacatctgaagacagctcactgaaagaacaactcgcatccatgaatgctatcgcaaatgtaaaagctacttacagtataaacggtgagactttccagatcccatcaagtgatattatgagttggctgacctacaatgatggaaaagtcgatttagatacagaacaagtacgtcaatatgtaacagatttaggcacaaagtataacacaagtacgaatgacacaaaatttaaaagtacaaaaagaggagaagttacggtcccagttggcacttacagttggacgatccaaacagacagtgagacagaagcattgaaaaaagcgattctggcaggccaagattttactcgttcacccattgtgcaaggtggcacaaccgctgatcatccattgatcgaagatacgtatatcgaagttgatctggagaaccagcatatgtggtattacaaagacggaaaagtggcccttgaaacagatatcgtttccggaaagccaactacacctacacctgctggagtcttctatgtttggaataaagaagaagatgcaactttaaaaggaacaaatgacgatggaacaccttacgagagtccggtaaactactggatgccgattgactggacaggtgttggtatccacgattcagactggcaacctgaatacggtggagacttatggaaaacccgcggttcacacggctgcatcaacaccccaccaagtgtaatgaaggaattattcgggatggtcgaaaaaggaacgcctgtattggtcttctaacaaaaataatatataaaaagaaagcacccgtacgattggtacaggtgctttctttttattatctaacaatgtgctacttacatttcagcagcagtaaagacttctgaaacatcatcatcgtcttctagcttatctactagacgttccaattgctctttttgttcctcatttaaatcaatcgtcgtttgtggaatcatcgtcaattctgcttgcgccaaagtgaactctttttccaactcatctcgtacagcagcaaaatcttctggtgcagtataaatctcgaatacttcaggagaagtttgcagatcttctgcccccgcctctaatacatcctcaaacatcgtctcttcatcaacagtcaacccatcgcgttcaatagcgatatatcctttgcggtcaaacaagtaactgactgaacccgtttctcccagtgatccaccgtttcgagtaaaagctactcggacatttgtcgctgtccgattacggttatctgtcaatgcatggactaagattcctactccacccggaccatatccttcatacgtgatttcatcgtaattcgtttcatctacggcactcgtagcctttttaatcgcccgttccacattgtcgttaggcatatttgcagcttttgctttgtccacaacaagccgcaaagctggattcatagatggatcaggaccgcctgctttagctgccatataaatttcacgagaaagtttctgaaagactttccctcgttttgcatcttgggcattttttcttccttggatattatgccatttactatgtcctgacatgatttttcctcccttgttcttttgagaatacacttctattctagtactatttcacaaaaaaacaaagccacagccaatctataaacgcttcttgaatgccgcaaaaagcacacataatatcacagcagtcagagcaccgatcgaatccaacatgacatcttggaacataggtgttcgtccaccggtcatcatctgatggaattcgtccaaacctgcgtaccctgttgctgaaagccaagcaaggatcgctgtcagccaccaaatttttagcttggggaaaacacctaaaaacaagctgcctcccaaaataaaataggtaccgaaatgtgcgcccttccttaaaaagaactctaaaaatttggcgtagcccagatggtcgatactcaccatacttccaccataattaaaacgtatacccgctaatgtgtctttaaatggctgattaggcagccagctttctaatcgcgaaacttgtgattgctgtccgtaagtttgagaagaactgtaaaataagattataacgactatcagtgcgattactaaataaatatttccgtttttcatttgtttttttgaagaattcataagtcacctctgtattttatcttagactttttttgaagaaacaacaatcattttcatagagacttcttccataaaaaagtgctatacttaattttgtattacaatatgaagggagttttttcatgagttattcattaaattggaatctagattctattttttccggaggcagtcattctgatgctttgaaccaacggatgaagcaattggaagaccaaatgaacgagtattatcaccgcgtaacaaaatggtcacctagttctgacaatgcagagcagttaaacgctattcttcaattgcaagaaacgattacgaatggttttacccaatgcagcagctatattactgcattgctttctgccaatgtcaatgattcagatgcaaaggtcttatcaggcaagctttacgcaatgctgcctcgtctgcaatcagccgaaactgtattgtcaaagaaatttgcagaaatatctgacaatgattggaatcagatgctttctcaatcttcgtttgaaacaattgcttttcgtttaaacgagattcgtcgtgatggctcacaattattatcagaagctgaagaaaacattataaatacgctttctttagatggtctaaatgcttggagcagtcattatgatacgattgtagccagcatttcgattcccttcgaacaagatggacaagtagtcgaattatctgctggacaagccttcaataagatgatgggcgatccagatccaaaagtcagagaaacacttttcgcagcatgggaagaagcctggaaagaaaaggcacccctcttcacggatactttgaatcatttagatggttttagactttctgactatgaacttcatggtgtcacagattttctacaaaaaccattagagtacaatcggttgaagaaagaaacattgtctgtcatgtgggatacaatccagaaaaacaaacaaccccttgttaattacttgactagaaaagctaatcttttcggtaaagaaaaaatggaatggcaagatcaagatgcacctattattttaggcgatttgaaagaaaaaacctttagttttgacgaagcagcagcatttattatcgaaaactttaacaaattcagtccaaaaatggctaaatttgcccaatctgcttttgaaaagagctggatcgaagcagaagatcgtcctgggaaacgtcctggtggttattgtactgagttaccagaaacaaaagaatcaaggatctttatgacctacagtaattctgttaatgaggttgcgacacttgctcatgaactaggacatgctttccatagcagcacgatgtgggatttaccttctttaaatcgcgaatatgccatgaatgtcgcagaaacagcaagtacattcgcagaactgatcgtagccgatgctacattaaaagtcgcaaaaacaaaagaagaaaaaatcaatttgctagatacaaaactgcaaaatgctttagctatgttcatgaatatccattcccgattcatttttgaaaatcgattctatgaagcacggcaagaaggattagtctcagaagataagatcacagagatgatggttgaggcgcaaaaagaaggctatcaaggagctttagctacttaccatccatatttctgggctgcaaaattgcatttctttattgatgacgtaccgttttataacttcccatacacatttggctacctctttagtttgggcatctatgcttacgccaaccaaaagggagcaaattttgaagaagaatatatccatttactacgcgatactgcctcaatgacgacggaagatcttgcgaagaaacatttgaatgtcgatcttacccaaccagatttttggcaagcaggtatcgacatggtgactgaagatatccaaacgttcatggaattgacagaagaatttatctgatttctattttatcacaataaaaaaagagttagtccagaatgggctaactctttttgattaatcattcttacatgctgacagcaaagtcaggggcaaaccattgaactgaaccaacttttacgctttcgcctggttgaggagcatggatatattgtcctccgcctaaagcaatcgctacgtggtaagttccgccttgtgacccccagaataacaagtctccagcttttgcttgagaaactgaaatttttgttccagctgattcttgaggaactgtccaaccaccgatgtcacgaccagttacttgcatgtaaacatagcgtgtgaaccctgagcagtcaaagccacttggatctttaccgccccaaacatatggagtaccaatatatttgtaagcttctgctacgattgctgcaccattcacacttccagaaggagctggagcaggtgttacaggttttggttgttcaggtgttggtgttggcgttggagccggagtactacttcctgtgccgtttcctgtatcaacactttgatctgttgatggtgttgtaggcgcaggtgttgttgattcttctgttgttgaagattcaggcactgttgttgattcttctgttgctgaagattcaggcactgttgttgattcttctgttgctgaagattcaggcgctgttgttgattcttctgttgctgaagattcaggcgctgttgattcttctgttgaagattcaggtgttgttgattcttctgttgctgaagattgtgtagctgatgatgattcttcagtcattgaagattgtgtagctgatgattcttctgttgctgagctttgtgcagtagatgaagcttgagtagcttgtgcttcagcctctgcttgttcgcgtgcttctttttcagctttttcttgtgcagcttgttgacgagcttgttctgctagacgttgttgttcacgaatacgagcttgctctgcttcagcttctgctttttgacggttcaagtcagctttcttgtcttcagcagttgcttgttcagcagctaatgaagttttcagtacgttcaaatcagcttgtttagataaaagatcgcctttttgagattccaaagcagcttggttttcagctaattcttttagtttagcatcgttttcagcttttttgtcttctacagcttttttatcttgtttttgttgttccatcaagtcgttgtttgcttttaccatcgttgtcattgcttgaacgcgtccaatagcatctgctaatgaatcagcattcaatacagcatcgatgtagtttgagcttgtgttgcttacttgtgcttcgcgtgcttgtttttggattgtatcttcacgtttttcaatacgttcttgtaaatctgcaatgtcttttactaattgtgcagattcttgacgcaatgtatcttgttttgctaataggtcttgtgcttgtgtgttgatttcagaaacttggctttctaaggcatcgatttgtgattgtgcatctgcttgttgatttttcaagtctgcaatcttttgatcttgctgttgtatctgagaatcaaaatcgtccgccgcggcagcgatcggtgatgctacggcagtcaaggtcattgaacataccattactgctgatattaaactctttttcactcttcattcctccgactggcttaatttaataaatatctaaatatatttaagtctttcttaacgatataaaaattgtaccatagcagtgtgtcaacgatataatagttatgttacaaaaatgtttcaaaacaacttttaaaaatgacaaaactgttcgtttcagaaaatgatcatgaaaaagccgcgttaagtctagcatttcttaagataacaacgattctttttcgctttcgacctaaaaataaaaaaagaaattattcatcactgaataatttcttaaagggaaaaatgaataatacaaatataatcatgttcaacagcagtgtaggtcctaaaaaccttgtaataaaatacgtgttatttactactgctaatttaaaaatcaactggaccaccatcgtaaacaattcataacccgtgacaaagatgatcatactgaaaaattcagtaaagatgttgacatggataacgtctttcattacatacatcaaccatacaattaaagggagagctactgcatagataccgataacgccaatatagtaagcgtcatagatagccccgagaacaatcgtggtaatcagtaaataacgtttttcaaacgccatactgcaacataataatgccaatatcagaaagtgggcatttgacatataggtgcctttcgaccactcccctagcattcttgttaaatgaccatctatcaacatcaaaaagaacaaaacgattggcagatagtacttcattgtttctttcttcaacatggactaatcctccgctagccgttggacaatcgtcacaactgacacgtcatacatttctgcataaggtttcacataaacttcccgatccagcccataactatctggtttcgttttaataaccgtaccgatcggcaagttagctggagaattccctccaagaccggatgtctggacaacatccccttctttgatatccgtatcaccagttaattgggtcaccactaaggcatggagcttttcatcatagtttttaagcaaaccaaacgcttcgccattagccgaagatacccgtactggaaaatgattggagctttcattagaggatgacagtaattcgattttagacgaagccgtattgacctcgatcactcggccaatcaatcctttttgcgacatgactgccatatttgcttcgataccgtctttagaacccttgtctacgatcagcatgtcctgccaactgtcaggcgaacgagtaatgacatttgccgttactttttcgtaactagtcagcgtctgattcaactcaagttcttttttcaacgcttcgatttctctctcgtaattcttgttttgctgtgaaacgtcatcatagctatcgattttttcttttagccgctcattttcggcataagttgaaaaaagattatggacagaagctactccatttcgtacccaccgtactggggcagagattgttttatcaaccattgcaacactgtcattaacgatggattggaagaaattgggctttccttcattcgctcgctgcgcagcggtcacacttagtatcgtcaccacgatgataacaataaccaaggtaataataatatttttattaggattgaacttcttcacaaagacacctcgaattaattagactcttgtgttcaattttatcactaaatgccgtgaaacaaaaggtaagttgctcctcttaagcttttttttagcaaataatagattctgtcatttttagcctgaaagacaaatttttttatttgtttatggatcaatctttgctttgaataactgcaatcataccatctgaaaaagaaaattctgcggtatctgaaagaaattcgttacttgcataagatgtcggatattctacttctttattttccaatacatacttgctgccttttaatgtaagattcgagacgggagtcaagcagcaataagctaaatacttcatatctggtatctgtcttactatatgctctccaggcaaataataagacaaataattttgacaatctctgataataagctgatgggcaaagggtttgaagcgaggttccatacctaaccagagattggctaaaagatgatccaatcttccgcccgtagctccaatcaaagtgacttccgcttgcgggtaacgttcaaatgtttttaagatacctaactgtgtatctgtatcgtctttttctgcaggggaacgggtatactctttggcttttgcaaatacttccttctgctcttcgttcgacaatgaatcaaaatcacccactgccagatctactgggtagcctgcttgaagcaggtacagcgcaccacggtctatcccgacataggcatcgtatttggacagcagagactgcggccagttttgcggattacctccagcagctaataaaattttcatttagtctaatgcctcttttaatcgttcgatttgtccgactggattttcggctccatagatatatgatcctgcaacgaagacatccgcccctgcatctttacagatttttgctgtttctggaacgattccgccatctacttcgattgcataagtccaattgttctctctacgtagatcagcgagttccgtaattttttctactgtttcttcaataaagctttgtccgccgaacccaggattgacagtcatgactagtacttgatcagccaaaggcaaaacatgtttgatcatggagactggtgttcctggattgataactactccagctttaactcctaagctttttgtcatttgaagtgcccgatgaatatgaggagttgcttcgacgtggacagtaatgatatctgctccagcttttgcaaatgctggaatgtagttttctggatcaacgatcatcagatggacgtctaacggtaatttagtaacaggacggattgcctgaacaatatttggccctaatgtgatatttgggacaaattggccatccattacatctacgtggatgtaatctgcgcctcctttttccactaactcaatgtctctttgtaaattggcaaaatctgcactcaaaatggatggtgctatcttcattcttgtttcctcctattttcgtttaccttctttttttgcatacattggttttcttttttcgatttcttgtaagaattgcaaataattgtcgtaacgtgtctgtgcgataccacctgtttctactctatgttttacttcgcagccaggttctttagcatgcatgcactctctaaatttgcaatggacagaagcttctacaaattcaggaaattgtctcggcagttctcctgcttcaattgtcaaaaagtcaatcgagctaaatcctggtgtatctgctactaacccgccatagataggaatcagttccacatgacgtgttgtatgccgtcctcttccaagtgcatcagaaatctctcctgttgctaaattcagttccggtgatatttgattcagtagcgtcgattttcctgctccagactgacccataaagaccgatagccgttctgggaagtaacggatcagttctgtcgtatcacccgtatgattgggtacaatcaccggatagcctattttagtataggtttgcttgatctcttcgattttttctgggtcgtctgacaagtcggtctttgtcaaaaaaataatcggttcgatcgactcgtattccaaggtaactagaaagcggtcaagtagattataagaaaatgcaggctctacgatacttgtgacaatgattccaagatcaacatttgtgactggtgggcgaactaattgattttttctcggcaagatttccagaagatagccgtctgtttgattttcactctcaaagatcacctgatctccgacaagcggcgtgattttccgattccggaaatttcctcttcctcttgtttgataggtctctccgtttgcgtatacatagtaaaaaccgctgattgcttttctgatttgtcctttgataagtgccacctccgtttttgtttattttaccatacgaagaggaaagtaggtgttattccatgcaaacttctcaaagtatatggcttgaaaattgatcaaaagagatagaaacacaaaaaagagaatgcaacaaatcaatgtcgcattcccttctgatatattttattcagcacttattttgaactttctgaggtgctagctgatgaacttgtggagctggaagattcttcttttgaagagttgcttgtgctactggagctacttgagctgctagaactgtctgaagagtctttttcagaactagaagacgctggatctggtcctttagagtaaattacgttcacaaccattcctttggtaattgtcgttcctgcccctggtactgtacgaatcactttatctttatccaccgtgtttgaatattcggaagtctcatgcccgatatattctgcaccgacactagctaaataactttgtgcttcgctttttgtatagccggagatatcattcaatttaggctctgttccttggcttacgacaaaattgatgtaagtttcttctgctacaacttcacccgaggctggatcctgactgatgatcgaacctgatggtacagtgtcgctatagtcataagtagcactaatattattgatattgaatccttgtgtaacaagccaattacgaacagtttcgtagttttctcctacatgactactcaaagtcactgtttctggtcctttgctgactgtgaaagtaatcgtgtctgttttaggatcgacttctgtatcttctgatggagattgcgaaatgatcattccgctttctacctctgaactgaattcctcttctttttgaatcaagtcagcagaaaaccctaattctttcaaacttgcttcggcatcttcataacttttaccactgtaatcatctaatttgatttttttcgtgccgctactaatatacagagtgacttcgcgtttttgcttgactgtcgttcccgctgccgggtctgtcttcactacattaccttcttcgattttgtcatctgcaatttcttctgtttttgttgctacttctaatttcgcttttgcgagtgtttctctagcagaagcttcagaaagatcagaaacatcaggaacaacaacttctcctcgcccgccagaagcaaagaatacagctgttccgattcctaaaacagcaagaatagctaataggatcagccaccattttttctgtcctttctttttaggatcaggcagaacttcttcctcctctggtaaggtttcgttttctggcttgtcttttggcagaggcatagatttgaatgaatcaggcattggtgcatcttccgtaaggggtgtgataacttttgtttcattatccatcacatgaggctgccatttttcttcgtttgcacgagctggtgataatactgtagaaagatcatcagacatttcctcggctgacttataacggtctgcaggttctttagccgttgcccgtaaaatcacgttttccagtgcttgtggcacatttggatcaagtgcttttatagatggaagatcatcttgaaaatgttttaaagcaattgttacagcagattcaccatcaaacggtacgctacccgtcaacatctcataaaggatgatccctaaagcataaatatctgactgcttcgttgccatacttcctctggcctgctcaggggacagataatgaacagatcctagcatcgtattcgtctgcgtgatcgatgtttcagataaagcgatagcaatcccgaaatccgtgatttttacaacaccttcattatcgatcagtacgttttggggtttcaaatctcggtggatgatttgatggttatgagctaaagaaatagcagaaaggatctgctgcataatatttactgctgtttcataaggaacaggataatgtgtttggatatatcgtttcaagtccattcctttgacgtattccatcaccagatactgcatgttgtcttcttcaccaacatcgtaaacactaacaatgtttggatgaacgagttctgttgctgctaaagcttctctctgaaatcgtcgaatcgcagtctggtcattttgaaagtcaaatcgtaagactttaactgctacatcacgatccaagattaaatcgtgcgccaaaaatacatttgccataccaccgctaccgatatttccagtgatttgataacggccatttaattttttgcccaactcgatcatacactgtcctccttatattcgataagaagaacggtgatattatccgctccgcctgcttcattggcacgatcaatcagctcagttactttatgagacaatgggccttcttgattgatgatcgttcctatttcttcttcagacagcatgttcgtcaagccatctgaacataacagcagtcgatcttttagttgccaaagatgagtagaaacatctacttcgactgttccaggcatgccgacagaacgtgttaaaatatttttccttggatggttcactgccatttcttcgctgatttctcctgatttgactagttcattgactaaagaatgatcctccgtcaattgcatgattttatcttcacgaatcaaataagctctgctatccccaacattggcaatcgtgaaccagtcatctgacagagcggccgctacgattgttgttcccataccgttatattccggctgttcttgtccacgctgataaatcagcatattttcttcttgaatcgattgaatgaaccattgggcgattttttcatcgtcaacagcttcttgtttttcccaagcttcgcctagattcgttaccgccatctgactggcaatgtctccggcacgatgaccacccatcccgtctgctaatacagcaagcttgagacctgaacggctggtaaatacactggcatagtcttgatttgtgttacgtcgtcttcctacatctgattgatattcaatctgcattttttcacctcattactttttgcgcaaacaacaaatgaaaaatccatctgtgtaaaactgatgcggatacaaagtcaacattttctcttcgattgatgattgtagcataggattggtcaaaacatcaatcctctcaaaatcagggtgtctttccaagaaagcagaaacaacgtcttggttttcttcttttaagatcgtacaagtgctataagtcagaataccggaagactttaaagttggtgcgcagctttctaaaatttccaattggatttttggtaaattcgctaattcatccggctgttttttataacgaatatctggttttcgccgaagcagcccaagacctgaacaaggcgcgtctactaaaatccgatcaaactgctctgcttcgaactgtttactgacttctctagcatccatcttttgagcgtagacagcagaagagacacctagacgtgctgcattatcttcaatgagtttgactttgtgttcgtgtacatctaaagcgaccacttctccaccgcatgacggatctaaaaaagaagcaatatgcgtcgtcttacctccgggtgctgcacaggcatctaagacatgatgttcaggctcgatttgcatagacggcgctacaagcatcgaactttcatcttggatcgtcatgacgccatcgtggaacaatgagctagaagctaaatgcccttttttcgctactataccgtatggactgacttggcttttttcagctgtgatctcttcttcttgcaaaacagtgatggcctgatctctggaaagtcggcgtgtatctactcgggcactagcatggctaggctgatatagcgataaaccgagcttttcagtttcttcgtatccgatttgatccaccagtcgtttagtcatccatagaggcaggctgattttgacagaaagtctttcgataggatcagcaatgccttgcagatctggtgctccttgacgctgataattcctcaagacaccatttacaaatttccctgtcccaggatttccttttacttttgcgatttcgaccgcctcgtttaaaatagcatgtgcagggactttatctaaaaattctaattggtatacagaaagataaagaagcgtcttgacccagtcatccactttttttgctttagcgatcaatggtgcaacgtaaaattccaatagtcgctgatggctaatcgtaccatagatcaattctgtaaataaacccacatctttttgatttagctcgctttgtttgatcatctcattcaacaaaagattcgagtaggcgccacccttgttcactcgctctaatgtcagtaatgccatatatcgtactgattttttcatttttttagggatttttttcattatttcacctgctgaccaatctgaacttgctgaccgcttccgttaaggaaatcatgtacggcctgttttcctttaccagctggctgtaattcattgatggctaagacggtctgtttaccgcaagcaatccatagattttttttgtctttccggatgatcgtaccaggtgctttgtctgtagtttctgccaatacttcaaccgataataatttccagcgtatgccctcataggtcgtgaatgcaattggccaaggacgcattccgcgtacttggttgtcaatttcttctgcagttttatgccaatcgattgcttcttgttcccgtgtgatgtttggcgaaaaagttgcttctgactcgtcttgaggtactggtttttgtccatccaaaatattgggcaatgtttctagcaatagctttcttcctaaaaggctaagcttttcaaacatcgtccctacatcatcttgtttagtgattggtatgctttcttgcgcatagattccgcctgcatccatttttttgatcatttccatgatcgttacaccagtttctttctccccattcatgatggcataatgaacaggcgcacctccccgatatttaggaagtaaagaagcatggacattgattgcccctaattttggtacttgcaataacttttcaggcaagaattggccaaatgccgcagtgacgatcacatcaggcaccaattcaatgatttcttccatttctggcgaaccggagattttctctggctgcagcacacggataccgtgcttcagagccgcttcttttaccggtgtcggcgtaattactcgtttccgcccaactggacggtcgggctgtgttaccactgcctggatctcgtaacctgattctatcagcccttcaagaatcggcacagaaaaagcaggtgtgcccataaatactagcttagtcatcaagatgttcctccatatattcttcaagttcttcttccgggatctgctgtatcattttctcaatgaacaagataccgtctaagtgatcgatttcatgctggaaggcacgggctaaatagccaaaagccgtcacttctatctcttctccgtctcgatcataataacgcacggtcacttcatctgctcgcttgaccgttccatagacatgcggaatactgagacaaccttctacgtcaaggctttcaccttttgcttcgatgatttctgggttaatcagttcaaatttctcgccttcatctacttcgatcacagcaattctcttgttttgtcctacttgaggagcagcgatccctattccgtcattcgcaatcattgtctcatataaattgtctaataaagcgattgtctcgtccgtgattacatcgattggctgagcagttctttttaatttatcattagggtggatcaatataggatagcgcataatttggccctttcttaaataaagtttaatggttcgttgtcaattgccacaaaaagaccttgtcgctgttctttctggcttccattcaaaatttcatccaaaacatgaggaagattcggttcatgtttatatttgatgattagttgataataatatcggtttttcactctcaaaatcatgctgggcgttggccctaatagcaagctttgagggcttaacacttcttttagctgattggcaatctgaaagattttctttgccgctacttgttcttcaggatggctggcggttattttcacagtaaagtaataaggaggatagcctccacgatgccgtacatgcatttcctgctgataaaactgctcataattttgttttttagccaattctatggcgtaatgttgaggattgaatgtttggatcacgacttcgcctgctttttccgctcgccctgctcgtcctgaaacttgggtaagcaattggaatgtatgctcactagaacgaaaatccggtaaattcagggaggtatcagcattcaacaccccaactaatgtcacttctggaaagtccaaacctttagcaatcatttgtgtccctaataatatatctgcttcttttgcaccgaatttttgtaaaatctgttcgtgtgccccttttcttcgagtggtatctacatccatacgcaaaatcctagcttgcggataaagttctcggagttcctcttctactttttgagtacctgttccatagtagcggattttattgccgccacaattaggacagcgattgggaataggttcttcatgtccgcaataatggcagcgcattgaacgtgtatccatatgcagtgtaagagagatatcgcaattaggacatggaagaacaaatccacagtccctacacatcacaaaagacgaatatcctcgacgattgagcagtaggacagtttgttcttttttgtctaatcgattttgtattttttcctgcaaattagcagaaaaagtagaggtccgatgattctgaaactcttcacgcatatctacgatctcaatagctggaagctgtgcagctgctttggctcggtggtttaactgcaataactgataaacgcctttttgagctcgtgctcttgattctaaagagggcgtcgcgcttcctagaactattgggcaatgatgatatttactgcgccaaattgctagatctctcgcatgataacgcggtgtctcatcttgtttgtaacttgattcatgttcttcatcgataatgatcagcccgatatttttcagcggggcaaaaatagcagatcgtgcgcctactactacttgcgcttcttcccgctcaatcttgcgccattcatcatatttttcaccttgggaaagtccgctatgtaagaccgcaactgattctccgaagcgtcctttgaatcgctcgaccatttgcggagtcaatgcgatttcaggcactaacataatagccgttttattttctgacaaaacatcagcgattgcctgaagatatacttctgttttcccgctgccagtgattccctccagcaaaaagacctgatctttttgctgctgacctgctgtgatgatttgttcgacagcatttttttgttctgcattcagttccaatgccgtcgtttggtcaaatactcggtctttataagggtcgcgataacgttctgattctataaactccagccagcccttttcttttccttgattcaagacagcagtactgattcctttatttttgaaataagcaattggttcttcttggctcagttcagataaacacaaaagaagttctttttgtttcttggcattttgccgtaattttgcccattcttcttcgatttgcttttcagttaacaaagaacggaccaaacgaatcgtttttactttatttcgtgtatggacttcatatttgatatctactaattgctcttggcgccagcgaatcaattgagaaaggctgccttcttcttctgcttccttccaggaaatcacttctcgctgatcaaacaatacctgaacttctggtgtgtctgccaaaggatagatcaatttatcatattctgctttcatcacactcggaagcatcgtttgtagacaagtgattttgaatgcgtaagtaatttttttcatataatcagctaatgaaagtaattcttcattgaccaccggagcaaggtctagcaaacgaataactgccttcaaagatggattagctgattcttctgatttttggatagccataacaaatccttggacatgacgattgccattaccaaaagggacttctactcgcatcccgacttgcaaagctgtttccatttcagagggaaccaaataagtgaatggctgatcggtctgcatagtaggtacgtccacaatgacttcagctgttaatgtcatggttcgtttcctcctttttttgtcttttcttatcaagcgacaaaaagttccttgcctattttactagagatcgatggatttgtcttatcttctgccaaatcctaacaaaaaattaacagcagataagaaaaaaaagaactgtgtcaaaaagttcagacacagccttttctaccagacaataagtggcgaatgtttgaaaaggaaacagctgggtttgcttttctttttagatgttcgctctatttttctttattacattttttgctcttcacggatacgtgattccaattcgtgttgttcacgctctttttgtgcttgacgttcctcttcttccatcttcaaacgttcacgttttaattcaggatgtggatcattgactacatttcctgcatcgatttcttctaaagcttgaccgacgctttttactgaatcaaaagaatctagagtaggctgtgcacttgcatccaattcatgcgcgcgtttacttgctaaaatcactagagaatattttgaatttacacgatctaatagtgagtcaattgaaggttttaacatcataagactacatctcctttaacattttaatatatttaccgattacgcgatctactcgaaaatgttcactggcaataatgtttttgattcgttcaactgctagcggcacttcatcatttacaacagcatagtcgtaaagagccatcatttcgatttcttcttttgcaactttcattcgttcttcgattacttcatctgcatctgttcctcggcctacgatccgtgattttaattccgctaaatctggcggagtcaaaaagatgaatacaccatcgggcactttttctttgacttgttttgctccttggacttcaatctccaagaaaacatcttttccttcatccaatgtcttgttgacatatgacaaaggagttccataataattcccgacatattctgcgtattccagcatctctccagcttcgatcattgattcaaactcttctttgcttcggaagaaataatcaacgccttcgacctccccttcacgcattttacgggtagtcattgagatcgaatactgaaaatcattatcctcactctcaaaaattgcttttcgtactgtgccttttcctacaccggatggaccagacaacacgattaataatccacgctctgacatgacgacgtcctttcaactagtctttttgtacttatcgtttattttgcactttttttctgcaactttcaaggttatctttaattatagctagaaattggtaaaaaagctaccctgtaccaagaggtcgtaaaaaagctgtcctgcatcaagtaataagaacagccaaacataaacagcttctcatgtttttcgtttggttggggttattatcgcagatgcaagcttttgaacgccgtgtataagaggtcgtgaagaagccgattagtttcgagtatgaagaaaaattttgtgaaaatagtttctcacatttttgcataaatttggcttaataccgagaaaatggtttttgaacatcacttattcaaaataaaaaaagattgtgacacgaattttgtcacaacctttaaatgtattcctagagcaaagaagctaagcgaagaaatccaattctgattatttattgtatttctttgttcagcatccttgctaaaagcccatattggacaaagtattcactacacccatgatctcatcttttcgagaacgtgctttttctgtcggatcttctacctcttctgtgtcaattcgaacaataaatttccgattcatcgtcacgtaagcaccgtcgttgatcaaaataaacagttcgttctcattatagtctgcacaggcatctttccatacgtcaaagccgtttttttcagaagggatatcccgtttaaccacagtttttccacttaattcgtggaacgttacgtcataatatttcattatctctacctctttcgtcattcaatattttgtacttgttctctgattttttctaagatcgtcttagactggacgacttgatttttaatttcgattgcatttgatttggaaccgatcgtgttgatttcccgattcatttcttggatcaggaaatctaattcccgacctacaggacattgtgcttcgataagttcatctagtttttgtacatggatcgccagacgatccagttcctcgtgaatatctccgcgttccaacaagatggctagctccgtcaacaaccgttgctcatcgactttcgctccaagaaattcctccagctttttttgataccttatttgaaattccttttcatagatttctacaaaactatcgagtttttttagtacttctttgaattcttcagtattctttttcaacactaaagctaaagcttgaccttctttttctcgactcgcctcaatagaatcaagtgcgcttttcaatgtatctagagctaactgtgccaattcttccatgctctcttccggtttttcttctaccgttacgaagttttcgtccagcgcgaagcgttccgccatccgactaattgacacttgattttgactaccgtatcgttgttgaattccgtctgtcaattgagtgataagtgaatcaatcaattcccagttgatgacgatctgtttttcgtttttgccaatataagctagattcacaaatacttcgattcgaccgcggcttaactgctgtttaataagctgacgaaaatcgttttcaacaaagttcaggattttaggacttcgtatttgaacatctagaaaacgctggttgacactttttatttcaatatctaactgatacgcttttgtttcgcggatggctttgccaaaaccagtcatacttttcattcgacagggtccttcctcattacatattttctattgctttttgcagttgttcaaactcttcgttcgtcaatgtcaggcctttccccattttttcatggtctggcgcccaatctcgaagatcgaattttggcgggcgaccattccagctgactaggttcagttctttacgccaccccttgttgttttctgacaatatagcgatttcttctacgatttcatatgaaaattcttgtgccatggttgttcctccttgagataatataaatataggatcagtaatgtgtcaactggttgcttaagcaattcatgctgcaaacgatccttgcgttttccttgtagcagataatcaaaataaacagttttcgtgcgctcattttgtattttttgctggtattttcgataccttcgccattcttcagtacttaattgaccaatttgtgccaataaatcatccggcatactttttatatcttgttggcagatcatttgaatcatcatgtctacttgatagatttcattgggcagtaaaaaatgtttttttgctaaaagttctagcatcgccaatccgcatgtctctggtacgaccctgttcttatataaattacgcagtttttgccaaaattttatgcttttgaaaaaagataattctaactgaatttcttttgttaagtaagacaaaaatcctcgccagtatgttcttgcaggtttaacagaatgaaatgtataccagttcccatagtaatagcctaatcgttttttcatttccagatagcctaattgtaaatttaattggttcctttggctatcaaaaagcagaaagctgcctagtgtccacaatgtttgacatttccaatggataaaaatgtctggcatacgaatttttttcgctgggcctggcccttgcacatctacgacaaatgcctctgttgctcctttgttaatcgcaatatcaataggtattttgttgcgatacccaccgtctgcatatttattttttccgatctttcgataagccatagcgggataaaatgaagcagaggcgagtatccaatctggtatttcttctgtttttgtctgttggatatcagtcactacttccgctagttctggcagtttagtagacaccgtatataaacgtattttgggattatgtttgagtaaggacaaatccaaattgtctttgaccatcttttccaatggagcagaagaaaccccgccttcaattagtgctgttttcgtcatttggcgtctttctcgatagaagcgttcacgaaggtcttcaactgcagccatttctggtaacgcaagcacttgtcttgtcgacagctttttccataaattcacagcttttttcatatctccttgtaaaatcaatgcgccgttcaacgcacctaccgaggtacctgtgataatctcaaagttgatatcatgttccttcagcgcctgccacacaccaatctgataagcaccgtgtgctcctcctccacctaaaacaagtgctgtatgatagaccagctttttatttaattgtgtggttccttgatagccgtttttatgaaaaatacgcaaccattcttctgatagaggagattgaaataaaaaacaacagttttctttaataaaaaaacgagcgcaagcttccatataccgaaaaaattttttccattcaaaagtttcaccttcaatcaacagattattaaaaataacatctcctctacttttagcaatagtaaaatagacggtatattttttcgatactgctttaaaagcacattgcttttttgcagaacgccaaaaagcgtctctactttcttgatgactttgaaaaaatggaaggggttgttttgcttgctggataggcgaatacagcgacattttctgtgaaaagtaaactttttttatctccatcgcgctctcctttttcttcaagtataccagtacgtcataaaaaggtcatgagtctcgtattcgactttgtagattccataagaaaacaattcataaaacatcctttaaataaaaaatacaaaaatcacaaaaattaattgaaaatgagagtgttttcaatgaaaacgtgattttgtaatggaattttaaaataaaagaaacaagcttttttaatgcaaatgttgtaaaataaaagagattaagaggaaataagaggaggaacatgatgactgagtcagtttatgtacatattgataccacaagtaatgctgttttaacaaaagggctgactgctactgactttgcaaacagtatcgtgcattttcctcaaaacttgctcttgcttgatccatctgcttctgctggagaatatgaatcccatacagggctgaaagtaatccgtggtacagaaaatattcagcgtttcttttcctcttctcgtaacaggcgtggattcgatgaattgaagtggatcgactttactgatttaacgatgctgaaagaattgacacctttagaaatttcagaattattatattttggtcatatgaaaacacatcttcattcgccgtttttttataaactacagaataattttgtatacttcgatcttaatgatcagctgaatcggatttattatcgctatttagatgaattttataggatttttgctagtaaattaagttcgatcttgtcagataagatcaatgtaaaaaaatcttttttcaaaaaagaaacacctgttgaaaaaatcagtgtggaattattgaaagaaatgcgtaatttgatgcaggaagggatcattttttcttttgatcaagttggtttgatcgatggtaaatatcgtatcccaatctatgtgattgaagattatatttggaaattaaaaggcacccggtatcgagaagaggaaatcatcgctactttaatctactctgtcaccgatcgacactggcaattggtagaagatgccgatctttcttatctgccattgaagtagatctatttcttatcaaaaaataaaaaggaaacaagaaactaggacatgattctgtctcaagtttcttgcttcttttttatttacagctcctgtcgtttatctggcacaaaaatcgaaggagtcgtttgttggatccctaataaaacgatgatcgttacaatagctgtactcaacccgctggcaccattcattacgaaagaaaagagccaagaattcatcccccatagtgcatacgctccccagaaaaccactcctgcaataaaatgccaaaaatatctggaaagtgcgccaatcaatgcaccaaacacgatgctttttctaatttgtttcgtattatcgtctacatagcctttttggacatttgaagccatgagccctgctgcgcctgcaaaagtataggcaatcgggtactcaatcaacacttgaacgacacttaaataataaacttgtcccaacggaaaatgtaggatgccccaaatgaaacctgccagcatccctgcctttgtccctcttcttaacgcaaaaagagtcaatggaatctgccctaatgaaatagaaaaactgctgccgatctggatcggaatcaacgacaacaccatcgctaacgctgcaacaatcgttccttctacccaaactctattttttcccataaaaaaacttcctcctttgaataaaaaagtcacaaaggaggaagcagctttcgaaaatagtcaaacagctgtttattcacaattcctacgctcgcataaccgatacaggtacgaagggtttagaaatagattcaatctcagcccaattggactcccctttgtgagtttatttattatttattttttgtttcaaacaatggactaactggtttgttttcatggatacgtttgattgcatctcccattagtccgccaacacttacttcatcgattttgtcgattttacgatcttctggaagatagatcgagtctgtaacaactagacgctcgatagctgaatcttctattctttgtaaagcagggccggataatactggatgtgtacatgaagcatacacactagttgcaccagcttctttcaaagcattggcagccaatgtgatcgtacctgctgtatcgatcatatcatcgatcagtacacaagttttgcctttgacttgtccaatgatattcattacttctgcaacatttgcttttggacggcgtttgtctatgatcgcaatcggagatttcaaaaattccgctaatttacgtgcccgtgtgacaccaccatggtctggtgaaacaacgacaacatcatcgcctttgattcctttttctaagaaataattggcaataagtggcgcacccatcaaatgatcgactggaatatcaaagaaaccttggatttggactgcatgaaggtccaaagtcagcattcttgttgcaccagctttttgaatcatgtttgctactaatttcgctgtgattggttcccgtgcacgtgctttacggtcttgacgcgcatagccataataaggcatgactacgttgattgtttttgcacttgctcgtttcagtgcgtcaatcatgatcagcaactccatcaagttatcattgactgggctgctcgttgattgaataacatagacatgcgatccacgaatactttcttcaatgtttacttgaatttctccatcactaaattgagtaacagatgattttcctaactcgacgccgactgctgctgcaattttctctgctaatgggcgattggaatttaacgcaaaaatttttaatcttgggtcaaagtaatgttttgacatggggacctccactttctttttcacaactctagaattctacctaataaatagtagtcatattttttaaataaatcaagtgattttgcaaaagtcttagtttagataagggagtttttttgcatatccttctttattgacttgtcttgctctcgcaattgccagcgcatattctggaatattgtctgtaattgttgacccggcagcaatcgaactgtttttagctacctcgacaggtccgatgatattcgtgctagaaccaataaagctgtggtcgccgacagtcgtatgatgtttgttctttccatcatagttgacgaagacaacaccacatccgacattgatttcttctcccagcgtagcatcaccaacataagtcaagtgaccgactttagttcctttgccgatttgagcatttttcacttccacaaagtttccgatatggacgttttcgccaatttcagcttttggtcgtaaatgtgcataaggtcccacatctgcatgtttcttgacatggctgctttcaatgactgagttttcaatgacgacgtgatcctcaatcctactgtctacgatttttgaatgtgacccgatgacacaatcagaaccaatgactgtatttccttggatttgtacacctgcttcgatcaatgtgtctggaccgatttctacgcctgcatcgatgtatgtcgttgctgaatcgacaaagcttacgccattgaccatatgcatctggttaattcgctttctcatgatctcatttgctttagctaacgcgatccgatcattgactcccattgattcttcaaaatcatccgtttgataagcagcaactgtatggccttcttcttttaagatttcgatgatatctgttagatagtattcaccttgagcattgtttgttccaactttgcttaacgcatcgaacaaagcttcgttgtcaaaacagtaagttcctgtattgatttcttgtacaagagcttcttctggtgttgcatctttttgttccacgattttttctacgatcccaatatggtcacggatgattcgtccatatcctgttgggttttctgcttgtgccgtcaagatcgttgcacttgcattttttccttggtgatattcaaaaagattgttcagcgtttcagtagtcaataatggtgtatcgccactgataactaacgttgttcctttttttccttccaagaaagaagcagcttgcaaaacagcatgtcctgttcccaattgttctgcttgtaacgcatatttactgcgttctcctagttgtgctttaacttgttctgctccgtgtccaacgatcgtaatcacttcatctggtttcgtttcactgacccgattaatgatatgttctaccataggtttaccagaaacgggatgtaaaactttatataattttgacttcatgcgggtacctttccctgccgccaaaataattgcataacgtgcgtccaactgcgtcactcctaaatatagtttgctgatttcagtttatcccagtatacccattttttcaacaaaacaagtgattttcttttatcccagcgttttctggataaaaaaatagatagaccataacgggcctatctatttggtaaccggtgctctcctgccaactcctcggtcacaagtcacactactcataaaacatgaaaagctgttttttgaaatcgtttcttgtgacttagagttaaacggtaggcttacaacctcttcattaaacgtttttcaatcagctgaccttcggtattagctcaataaacggcaaaatatgaggagcaatttttccgtttattgagctaatactcaggacaggacgctgatttcacaacctctagataaacggtgttcaaaagccagtttctcggtattaagccaaatttatgaaaaaatgtggaaagccattttcacaaaatttttcttactactcgaaactaagcggctttttcacaacctcttattctgaaaaataatttcctggcacaaccgtaatatttttcgtttgagtatctacatctttgacataaagcagtgacgtataatcatcgatggcgcgatgaccgttgaattttgattcggcaaatacagtgatgccaacaagttctgattcgaattcttcaatcaagctcttcattccgttgactgttccgccgcctttcatgaaatcatccactacaaggacacgtgaaccacgtttcaaacttctcttagacagttccatcttttcaattctttcagaagatccagacacatagttgacacttactgttgatccttctgttatttttgagtcccggcgtacaataacgaatggcgcattcagataataggacacagcttgggcaataggtacgccttttgtggctacagtcattacagcatcgattttttcaccaaggtatttagaagcaatgattcttccaacttgacgcagcagttcaggttctcctaacaaatcagagagataaacatatcctcctggaagcagacggtcttgttctgatagacgttctgctagagattcaatatattttttcgcctcttcatatgaaatttcagggatgaacaatacaccacctgcagcacccgggattgtttccaaggttccataccctcgttctttaaatgttttcttgatgattcccaaatcttcactgatagaagatttagcagattcataacgttcggcaaagcttgttaaggaaatcaattcatgcgggtgattcaataaatactgtgtcatgtcaactagacgttcactgcgacgtactttcacctattccaactccttttaagaaattttatcgttttacattatataagtttttcttcaaaaattcgagcattttatgaaaaaataagaaaatagttcggtatttattaaaataaaaagaagcctataaaaaatttttcgtttttataaggcttcttttctttataatttagttattttttcttctgaaggcaaccaatattcgtttgatgatatttacaatcaggaacaaagcaataaagactaatgtgattgttgctcctggaggtgtatctagataaaacgagctagttagtcctgacagcatccctagaaatcctacacaaacactgatagcaatcacgacattgaagcttttgcctaatcgcataccgattgctgcgggaagaaccatgattgcggatatcaaaagtgcaccggcaatcgggatcatcacagcaatagccacaccagtaatcacattgaacatcatcgacatcaaatgaacgggtagcccatccacgtgggcggtatcttcatcaaaagtcagaacatacatcggccgtttgaataaaaagaacaatataccgatggcaacgaataagattcctaaaaagatgacttgctcccatgtaatggtcacgatcgaaccaaacagataggattggatacttgttgctgaattccctccgctcaaattcatcaatactaacgctagcgccaaaccaccagccattaaaatggcaatggagatttctgaataggttcggtagatcgttcgcagatactccaatatcacagctgctaatacaacgactagcatggtcgtaagtgtaggattaaggttcaaaaagaatcctaacgctacccctgctaaagagacatgagaaagcgtatcagccatcagcgattgtcttctgatcactaaaaacacacctagcatcggggcgattccggcaatgaagatagcggcaagaaacgctcttctcatgaattcatatgaaagcaacgccattgagaatcctcctttctcaccagtcggatctgtctgtccgcatactgtttgatatcttcatgatcatgggtgatcattagaactgatttcccatggacatgcgcactatgtcggagaagacgataaaattcatttctggattcttcatccatacctgttgttggttcatcaagaacaaataagtcagggtcagtagcaaaaatacgcgctaaactgattcgctgcttttgtccgccagacaattcacctattcgccgatttcgcatatcccacatccctacagcttctaaagcacgctgtacatgttgatgatctttttcagagagacgcttgaaccagcggcctcttggatatcttcctgaacggactaattcgatcaccgtactaggaaaacctgcattgaaagatgcaacttgttgaggaatataaccgatacttaatttttttccttcttgatttttctcagcaatctttatcattccttttgaaggtttcagtaatcctaacgatgctttcaccaaggttgacttggctgctccattttctccagttaaaatgacaaattcacccgcatctacatgataagagacatcttctagtacaggttcatcatcatagtaaaaggtcaaatcagatatttcgatataacgcaccttacaacctccattctaaaacttaattgatactttcttttaaagctttcagatttttttccatgacagaaatataattttcgcctgctttgatttgttcattagtcaagctttctaaaggattcaacacttctagcttcactcctgtttcattcgacaatgtctcagctaccttcgaagaggcattttcttcaaaataaatcactttgatgttgtttttcttcacaaattcttttagctcagctaagcgacttggtgtgggttcctgatctggtgaaacgcccgaaatcgctacttgttttaagtcgtattgattcgctaaataagcaaaagcagcatgctgagtgacaaatgtgcggtttgttgcatcttttagctcatcggagtatttttgatccagtgcttcaagctttttgatataagcatcggcattcttcgtaaaagtttcctttttatctggatatttttcgcctaattcttcagcaatcgttctgacttcttttatagctaataccggatcgagccaaacatgtggatcgtattcatgtgaatgaccatgcccttcttctgattcttcatgttcgtctgcttcttgcgattctaaacggtcgattcctttagctgcttcgatcatcaaggtctgtttgctatccactgaatcctttaacgaatccacaaaaaattccatgtctgaactattatacacgaaaacatctgcatcggaaatttctgctctttcttttgcacttggttcgaaatcatgcggctccgttccagcagggatcaaaagtttcacgtttccttcatcccctacgatctcttttgtaaaatcatacatcggataaaaagtcgtaacgatcgtcaaatcctcttttttgtctgcttccttgttcgtatttccacatgctgcaaacagtaaagcacctatcattacggtagctgtcaaaagatattttttcatttatatgctcctttcaatgaacaaatcggaattttacgatttattaacgtgaactaatgtatcaaaataaaaaaacacagtcaatagaaatccatcaatttctgatttaagcatgtatattcttgattaaatcgtaaaatggatgagttgctgctcatatctagccatttcactacaataaaaaactgaagaataccattttaggattcctcagtttttcatcacctattttacttcttatattttattgcagggttcgtactaaataaacttcctcacaaaaaccttttaacccattatatactctctgcgctcttgaataatgttgacacaaggcaaaaacggttggtccgcttccactcatcaatgcagcatctgctccgtacttgatcatacgctctttgatttgatggatgactggatgccgctttcccgttatatcttctaaactgtttcccatttttttgatcatctgctgataatcttgctctcggatggcttcagcaagtccgtggatgtcttgatgttggatggcttgcgtatctacttctctaaacactgtacgtgtagagacactcattcttggtttgaccaacacaacccagcactgtggcatagaaggtaatacttggatttcttcccctttgccaccgacaaatgccgtacttccgtagacacagtaaggaacatctgtaccgacttccaaaccgatttctgccagttcttctaacgaacagcccagattccataattggttgatccctcttagagcagctgcacagtctgtacttcctccgcctaatccagctgctactggaatattcttcttaacaaagatcttgacaccggttttgatattgtatttattttttagcaataaagcagcttgataaacattgttccgttcatctaccggtaaaaatgctttatttgtttctacaatgattttgtcttctgttatttcttcaaaaaatagatgatctgccaagtttacgctcgacatcaccatttccaactcatgatacccatcttgccgtctatataatacatccagtcctaaatttatcttggctggcgctttttcaatcaattccatcctctcacccattcgaaaagtctaagtcgcaagtattctatcatagggaaaaataaaagtatagcttatgtctgcctagtggttgattttgtcatcgtttcaacagctttcacagaattttctcttcataatccaaacaagttctagtgattcttataattctgtgagcacttcttctgccaaactcggaacatttcctttttcttttcctatcagactgagtagctgcatggtagcaaatccgaaattacttcctttcctataagcaaaataacgtccttcccaatgatcgacatattttaatttcttttcataagcagactggaaggaatagaaaaaattaccataattatatacgatatgcatgactttttcttgaaagaaagaaaaatctgtttctccaacattagctaatggagctaagcctagattggcttccgagtagcccattttctcgtatacaataaacagattggctaacagatagtcagctaattcctcagattctttaggtaagacccgcaacaaatcatatcccgcctgcttcttcgtcatcggctgagcggtgatgaagccaacgactttttgatctttacggacaataccgacaccgctagataatacatatgatttatcaaatcgtcccacagagaagtatttttctcgtgcaccttgaagccatttttgtgaaacttcatttacagcttgatgtaattcttccggcagttgatcgtaccaagtaaaatggtatccttctttcatcaaacgttgatattcaagttgctgactcagccgagacaagtcttctgttgctagatcaacaatccctgcttcacctactttcgtgaagtgaaaacccaattcatgaagcatcactacgtagctttctgatatcttataaaacgcaagctgatagcctaaacaatctgcttgtttcataaactgattcgttgctgcccgcatcattttaggattgccaactggatctcctaaaacaaagcatttgtttcctttgatctgataaccaaaaacgacttgatcttggtcgtcttcttggtaataaaaataactgtaacctgacaagcgaagctgatggcttgtagctgtgcctccgtatgtttccaataaacggtcaaaacggtctttttcgtactcactgccaagcttcgtagtatcttcagctaaatattgataaagcgccactaaagctagcaatgagatgcccaaaccaataagccctgagaaccacacatcatctgaaggaaacaaaataaaatgatttcctgttattcgaccgactaaaaagcgtccgctgtgatagcctgcaattgcgtaaacgataaacaaaaagccgaacaagctagcatcaaagattatagctccccaagaataaacgaattttgttcgataaaattcttttctggataaccacacagctaacagaatcaagacatataccaatatcaactgccaagataacgtacgtgtgattgtatttaaaataccaaaagatagtaaagcaatcgtaggcagaaatgcctttttgacttttactgaaagtgctctagcaaggccgagtaataaaaagccaaccaatagattcactgtctgatctaaaaaattgaatgagaacggcaataatacttgaaatagccgactgattgcagacagattagtgattgttgatagaagtaccatcatgatccccgcaaaatagacagcacttacgagcacgatatgcgcaaccttttggaaaaacagtcgcggaatgttatctaaaaatcgattgattttgactcctgtatgtgtgatgaacaatagaagtcccgtcataaaaggtagaacataataaaacaaccgataatataatagccaaactactgctacatcttgccgaacagacaattgactcattcctaagatcatcaaaacgtcaaaagtccccattccacctgggaccatcgtcagcattcctatcaatgtagcaatcatgaacataggatagatcgaaagcatcgaaatatctattctcatcaacttgccgatgatcaaaaataccgcaagggctcccgtccattgtccaaaggatgccagtagcagaccaagcaagccttttggataaaactcgaagaacaatgtctttctctttagataagcaaaaaagaaaatgactggtgctaaaaaactaccgccgaaaagccagatccaatagcttcgaaaaatactttctgactgaataaaaaagacatcaataaatgtaagaaacgaccatacagacaaaccagtcagcataaatagtgcgacttttgatacagtggctaaaaccatttttctatttgtctgctttccataaaaactagcccgcagacttgctcctaccacaccaccaaaaccggcgagattgttgatcgtgtttgttacccacgcagcaagaagaaactcttttctttccatttttggttttccttgtttttctaagactctgatcgtcacccaatcatacaacaacatcggagtgacacccagcagtccagccagaatcatgagcaggatcgtcatgcggctttgttgtcccatcctttgccaaatatcttgccaactcatgccattagcaatatttgcgacttgatttgccacaaagactaacacggagccgaaaaaaatcagttttaaaatcagactatgttcctttatccattgcagcatcaagtatcgtttatttttcacattttcccattcctaacttgtatacttttgtgtcataccccaatgttatcttatttattttaatttttccactttagacctgttctttgcttgcgatgatagaaaaagaaagatatcctaatgctaaaggagaggataacatgaaagtaggatttatcggcacagggaatatggcacaagctattattgatggtttattaaaaaaaggaacagtctcgaaagaagaggtgttcgtttccagtggacattttgaaaatgcacaaaaatttgctgctgaaactggcgtccatgcatgcaaaagtaatcaggaagttgcatcacaatcagatatcgttcttttagccgtgaaaccaaaaatcattgaaaaagtattggaagaactaagagaatatagccagaaagtcttattcatttctattgcttcaggaaaatcattaacagatttagaaacagcgcttgaagatcctcaggcctccatcgtacgtgtgatgccgaatgtcaatgtcagcgtaggagcaggcgtttctgcgatttgcaaaaatgaagctgccacggaggaacagcttcagcaagctacgatgatttttgaagcaatcggcagcgtctatcctttagcagaatcagatttcagtacattcattggccttgctggcagctcacccgcattcgtttacatgctgatcgatgcgatgggacggactggtgtactgaatggtttgtccaaacagacagccactgagattgctgcaaaagcaattatgggttcttgtcaaaaattcctttcaagtgataaaaatccatgggaacttgtagaccaagtttcttctcctggcggtacaactgttgcaggtgtagttgccttagaagaagcaggattcatcccagcaatcatcaaaggaatcaatacgacgatcgagaaagatcttgagatgttgaataaaaaataatgatagcaatgttttttcgtgccttacaaaaaaagaagagctgtggcttttgccgcggctcttcttttgtattttttattatttagcataatcagttgcacgagtttcccgaataacgattactttgatgtgtccaggataatccagttcttcttcgattcgtttacgaatatcacgtactaaacgaacagcgtctaaatccgagatttcttctggcttgaccattacccgaacttcgcgtccagcttgaactgcgtaacttgattctacaccggcgaagctgttcgaaatattttccagacttcttaaacgacggatgtagttttctaatgattcacttcgcgcaccaggtcttgctgctgagagcgcatctgctgcagctacaaggacagagataacagaagtagcttccacatctccatgatgagaagcgatcgcgttgattactactgggttttctttgtacttggcagctaattccgcaccgatctcaacgtgagatccttcaatctcatggtcaagtgctttcccaatatcatggagcaacccggcacgttttgctaattggatatcttcgccaagctctgctgctaagataccagctaattttgcaacctcgaccgaatgcttcaagacgttttgtccataactagttctgaatcgcagacgtccgatgatcttgattagatctggatgaagtgtatgagcaccgacttcaaacgctgcctcttccccgtattcgcgaatacgttcatccatttctttacgagatttctcgaccatttcttcgatacgcgctggatggattcgtccatcttgtatcagtttttccaaggtcatccgtgcgatttctcttcggattggatcgaatccggaaagaacaactgcttccggtgtatcatcgatgattaaatcgataccagtcagcgtctcaagcgttcgaatattacgaccttctcgtccaatgatacgacctttcatttcatcattcggaagggtaacgactgaaacagtcgtttctgaaacttgatctgctgcgcagcgttgaatcgctaatgataataagtttttcgctttgcgatctgcttcttctttggcacgctgttcagattcttttaccattagagttaactcatgattcagctcttcttcagtcgatttcatgatgacatctcgtgcgtcctcttttgataaaccagcaattttttctagttctttttgttgatcttcaatcattttttcaacgtctttttctcgctcttcaattaattgctgttttgaactaagtgcttcttctttactttcaagtgagttctcgcgtttttctaacgagtcatctttacgattcagcgtttgttcgcgttgaatcaaacgattctcttgagattttaattctaacttactttctctcagctcactttcaacttcagaacggtatttctgattttcttccttagcttctaacaatgcttctttttttagagtttctgcttctttttttgcactatcgatgattccagcagctgatgattgtgcaccagctatttctttctcgtgacgtgactttgcgaccataaaccctaaaccaagaccgacaattaaaccgatgatagcgaggagaatgttgaataccataaaatccacctccatactatctttttcatttttatcatctatacagcttctatgataaattattctaaactcgtcaatatgcatcttcgcatatatgtgtacaaaaaacatgcacaactttattctaatgtttgtaccccgtagtgtcaactttaaataaacaaagaaacggctttctacttattcattaaacgatggtttttaaaataaatgacactagtttcatataggtaaacctttaaattgagaaacttttctattaaattattctttgtagatgaacagatatttttattttatgtacccactcgtataattaaataactcacgatttctttattcaataaaaaaacggcaggtcaaggagagtacctactcttcagaccagccgtttttgtttatcataatttttattcttctactaaaggcaattcttcttgtcctttttcatcttctgggacagcgacttcttcaccaataccataagctgctctaactagagcagaaacttctgccatcatttcaggatgattagccatatagattttagcgttttcccgtccttgaccaatccgatcttctttataagaataccaagcaccgcttttatcaacaatgtctttttctactgccatgtctagaagttctccttcttgtgagatccctaaaccatacatgacatctacttcagcgattttgaaaggaggtgctactttgttttttacgactttgatctttgtacggttaccaacaatatctgtaccttgtttcaattgttctgcacgacgtacttccaaacggatcgttgcgtagaatttcaatgcgcgtcctccaggagtgatttctggattcccaaacatcacgcctactttttcacggatttggttgatgaaaatagcgattgtttttgttttgttgatcgaaccagagagtttacgcaatgcttgagacatcaaacgtgcttgtaacccgacatgtgagtcacccatttcgccgtcgatttctgctcgtggaactaaagcagcaactgaatcgactactacgatatctacagccccacttgatactaaagcatcagcgatctctagaccttgttctcctgtgtcaggctgtgaaagaagtagttcatcgatattcacacctaatttttgtgcatattgcggatctaacgcatgctcagcatcaatgaaagcggccgttccgccatttttttgtacttctgcaatagcgtgtagtgcaactgttgttttacctgaactttcaggtccatatacttcgatgatacgtccacgggggtaaccgccgacacctaaagcgacatctaacgcaagagagccacttggaattgtagagatttgttggtcgattttttcgcccaatttcataatagagcctttaccatagctcttttcaatttttttcagtgcagcatctaaggctgctttacgatcatctgccaatacgataatcctccttatatttacaaatcagagcaacatttcattatccttatcatatcttttttagtgaaaaaaagcaagaaaaaaccgaacaaatattcgcatttatcattttcttaaaagctgttttctcaaaagatcaaatccttgcataaccgcattatatctgatagcagcacgatctctggcaaagtgatatttttccgaaaccacgccgtctttagatgaaatagcgatccatactgttcctgcagattgaccttctaacgtgtccggtccagccactccggtgaaagctacactgtaatctgttcttgctatctcacgtgcttgaatggccatctgctccacacattctttgctgactgttccatattctgctaatagctccggatcaatctccagaaaaccagcttttgtttggagcgagtaggtaacgaatccgcctggaaatacttcagatacaccagcaatgtcgcctaatgcggcttggaaggcgccggctgtcaaactttccgctgctgttacagtctgcttgttttctttcagtagttccactacgacttttgctagcgaattatcatcgccgtatccataaaaatattcccctactcgttcttggattttttcttctaatgctaaaagagcttgattccctgcctgaacatcatttgttttcactgtcagtcgtaatgtcacttcatttggtttggcatatggtgcgatcgttggattgatctgtgtctcaatcagatcttttagctcagtgaccagtcgcgattcaccaatcccataaaagcgcaaaactttagaaattagtttttcttcagaaggaaaacgttcctctagtaaaggacgtacttgttccacaaacattggtttcaactcattaggcggaccgggaagaaggatatacgcatgtgtatctgtttgataaaaagtccctaaagcaagccctgtacgatttggtagaggaaccccgccttcgataatctgggactgttgcagattgtttttggtcatttttcgatgggttgtttcaaaatatgccaataattttttgtatccttccgtattttgtatgagagacttaccgaggtgagccgcagttgcttcttttgtcaggtcatcttctgtcggtcctaatccgccacataagagtatgagttcacttcttgtttcagctagagcaatcaactcttctaaacgctgctgattatctcctacaactgtttgataataaacttcgatacctagatcagctagctgttctgacaagaaagtggcattcgtattcacgacttgtcctagtaaaagttctgttccgacagctattatttctgctttcattacttcccgctcccttatatagtatacgctgtatttttatatttttttatttaaaaagagggcaaggagctgtgacaaaaatcttgtcacagctccttgttccaaataaacagtgttctcctgccaaaacctcggtcataagtcacaatatacataaaacatgaaaagctgttttttgaaattatcccttgtgactcagagttagacggcaggctcacaacctctccactaaacgatacttacattgatcctttgaacacaccgctgtttttgatgaagtaatccacacctgaatagatagtaaagatcagacaagcataaagcatgatttgatctactggaataccgatcaggctgaatgggatattattgataaacagcaagataatagcaaccatttgtgtagccgtcttgacttttcccggccaagctgcagccatgacttctccatgttcgacaagtagtaaacgcaagcctgtgacggctaattcacgacagacaatgatcgctactacccaaccaggggcctttccttggtcaaccaacatgataaaagcagtcataactagcattttatctgccaacgggtccgcaaacttgccaaaattagtgacaaggcctcgcgcacgggcaatttttccatctaaccagtctgtgatactagctaaagcaaaaataactgcacctactagctgtgtgacagccagtgtggtgtctcctacgttaaattgtccccaatctaaaggtaaacctacaaccaaaatgaaaatcgggatcatacaaattctaagtacagttaatttatttggtaaattcacactatcgactcctttcttccctattctacgtgactatcagcgaagtttccaccgatattatttacttttccaaatgaatttattcaaaggagtatttttattgaaattgatctttttgaattaacgaagaaggaccgcgacacagatttgtcacgatccttcttttttatacctacaagtaaacagatgcgtaaactaatttatacgatcattctgcgtattgaagagtaaggttcacattttttggactctgattgttttcccctggattaactggtacggattctccattcgctttgatcgttgcattgcttgctgcaccaatcgtgatggtcgcatttgttgctgtttccggtaacacggtactctgtgtttcatttgctgccagtgtcccttgataaacataggcattgtctactagcacacctaaccatacacgattgacagcagtaaattcaagggttacaggcttggtagcgtctgtgatatttactgcgatggcactgccagaatcttctcctgtagctattgccattttcttttcttcacttgattttgttgttgattctactgtagaagactctttggtctgcgtgctttgctctgaggaagaggactcctcgactgatccttctactttaagcgaagaagctgtgtctccgattattggatcagcttgacgatcttgccaagtcatatagcccacgacaacgacaatcgccaaagcaaccaatcctaataaaatgacaggaagacttgtccaaaagcgacttggatgcgattcttcctgatgcattgcttttctagaagtacttactgtttcaggctgcggacgttcagggaccgatcctgtcaatttgcttttcccatcaaaaacatcgactaaatggtctccatcttctcctacagcttcagcgtattgccgaataaatgcccgcacgtaaaatttaccaggcaattggtcaaaatcatcattgtcgattgcttccaaataacgtttttgaatttttgtaatctgctgtaattcatctaaagatatttttttattcaggcgtgcttgccgtaatttttctccgatggtttcaaaagccactcgttcatcttctccagtctgtttgattctccgaagcatctgctgttgcaacgaaagacgttatgtttgggtgctgtgacaaaagtcatgtcacagctccttttttccgaataaacattgttctcctgccaactcctcggtcacaagtcacaatatccaataaatataagaagctgttttttgaacttgttccttgtgactcggagttaaacggcaggctcacgacctctttcttaaacggtgttcaatcagctgttcctcggtattagctcaaaaaaccggcaaaatataaggagatatttttccgtatgtttctctaatactcaggtcaaaacgctgatttcacaacctcttccttaaacggtgttcaaaagcttgcatctgcggtaataagtccaaccaagttaaaaacattaagaagctgtttttacttggctgttcttattacttgatgcagggcagctttttcacaacctcttggtacacggtgttccagaagtagcttcttcggcaataagccgaaatatcacaaaaatttgagaagcaattttcgtaaattccttcttatttcttgaagctgaccacttctgtcacaacctctttgattacttcgtttgattttattttaatataagttgattaaaagagagcatgatttgttttattttctcactaatttttccaacacaactaagaataccataaaagctgattttggaggaggttcctactacaagtctaaaacgaaatttaagacttttcctcataaaatactggtttattttggtctcatgtaaaactcgctgaaggcctcttcacttataaatgcttccccagctgccagtacgtctttcatttggatcgaatcgatgatttcaggaagatcaaataaagttcgatcgccaaataaactttgcgtaaattgattggcaatatattcgatcgaatttaatgattggaaatattgtccaagcattttcttcttcagcaaatcgagatttgtttctgacacttccggatcatcagcgaatccaagaatgatttctttgactttttctgctgctttctctggttcgtccgtatctccgctgaagtccgcaaagtgaaattcacgatccaagctgaattcaaaaccaaagctgtcatcgataattccttgattgtacatcgctagatagtttcgagaagtattgcctaaaatcatttggaacaacagattgattgctgttttatagcgtaacagttctgttccttcttgcggcaatgtgtctaatcctttaataccaagtacaaatttatctcgtgtaatggctgcttccaatgcactttgtttgatgatttcttttgtgttttcagggaaataacgtacaatttcttgctttggagggaaattttttgcttcttggttttcccgaataagtttcatcaatttctcaggctccatcttaccaactacaaataaaaccatattgcttggctgataaaacgtccgatagcacgtatacaagtcttgagctgtgattttgtcgatactttcaaccgtgcccgcaatatcgatatgcaatgggtgtgtaggatacaagttatttagtatgccaaaaaacatccgccagttagggtcgtcttcatacatttggatttcctgaccgatgattcctttttccttgtttacagtttcttctgtgaagtaaggtgcttgtacaaaatcgatcagagtcgtcagattcttttctacctgatccgtcgtagaaaacagatagctggttttcgtaaaacttgtgaaagcattggcggaagctccttgtttcccaaataattgaaagacatcaccatcttctttttcaaacaacttatgttctaaaaaatgggcaattccatctggaactttcaccttttctttttcaccatagggaataaattcgttatcgatcgaaccataattcgtactgaacaaaccatatgtcttgtgatagtcatttttaggcaacaaatacacggtcaaaccgtttggcagtacttcatgataaagtgtttcattgatttgctcatattctgttttattcatttgcatttcctcctgctaaaaagaagattgcctgcaattcgatttgctcagctacttgttgtatctctttgatcgttacgctctccatacgtttcaaccattcttcatcagataattttgtttccggcagccagctgtccaaaaaagaagcttcgattgccgcttgcggagagtctagagaaagcagatattggtttctcagcattgcttttgtctgagacagttccaactctgttatttcaccatttcgcaaactttctaattgctcgtgaatcagatgaagtacttgatttcggttcttttcatcgataccggtttggacactcatgaatcctcggaacgtatccacgctactagaggcataataagctagactttctttctctctgacattcatgaaaagtttagagtgaggaaaaccgccaaataaaccgttaaagaccattagcgcaaaacgttctggttcatcgtaatacacatttgtctgataagctaggttcagctttgcttgaacgattggctcacgtacttgtcgttccttcacgatattcacttgaggttgggtataaaacagatctggataaactgtttcccgcgactcaaatggtaattgcccaactgcttcagctgctttgtccggatcaacatcgccgacaacaaaaatgtcgatttgatcatttgccatcatttcttgatagtaggacgctagcgaactagcagtgatcttgtccaaatcttcgactacgcccaaccctgggatcttttgttccgggctgttttcaaaataaagttcttgcaaggcataggaagcaaaagtttgtttatcttccttcaaactttccaaatatagacgcagattgttcttttccaagtcaaacgtcaactgatcaaactgatgatttttaatatttggataaaataaaacctcttttaaaaaatctaccgcttgagaaaaaaggtttggatcattgacatattcaccattcacaaaactgatccctgcgtttagccaatgtaaatttcctttttttctaactgataatccaaagcttgcgccataaagctctgcaagttgcgcacttaactttgtctgatccggataattcaaactatttgtttccaacatgctgctgagaagtgaacgtttcgtgatgacttcttgttgcagacgcgcagtaaaacggataaaaatccggatcgttttgtattgttttgttggtaagacatgaagattcacgccttctgccaattgatacaccatatttatatgctccttttcacagttgattgcccgcttactcttttaatgggtcaacctgccttttttacttattcctctgcttgaaatttataagttcaggcaattcgccgttttttctaaatgatgttacactttatagtatagcatagatgttttttatcaaaagaaacagacggctaaaagcgtatattgttttttattttttatttttcgatatactaaagacaaataaaagaagggagggtcattcatgatcaaagaattcaaagagttcatcatgcgtggagatgtcttggatcttgctgtcggcgttgttattggtagtgcgtttacaagcatcgtaaaccaagtggtgcaaggcttgatcacaccactaataggttggtttgtcgcaatgatcacaggtacttctgatttagaaggagcactttcaattcttgactggtcgccgacaaaaggcgtcacatttgcgtttggtaacgttattagtgctatcattacatttctgatcactggttttgtcttattcttagttgtcaaagcggcaaaccgtgcgaagaatttacgctccaaagaagagcaagtggaagtggaagaaactcctactgcagaagattatcttagtgacatacgcgatcttcttgccaaacaagtggcagaagacaatacacatccagtagagcaaacaaatctttccgatacttctaaataataaagaatctaaaaaaaagaaagccgattttcagtgtcggctttctttttttagattcttaacttgctacttgttcctttttcatgtcgatatgtggaatatcatcttccaaatacacatctgagattgccttgaatccaaacgactcataaaaagcttgtaggtattcttgtgcgccgatcacgattggtttttctggaaaatttttctggatcatgttaatcgtttcttgaacaatctttcttcctaaaccatctttacggttgtcctgatgaacaaggacacgtccaaaatggatactctccgcttcttcatatactcgcgtgtaggcaaggatcttcccatcagtatcttgaaaaaacgtatgccaagcttgtccatcaatgtcatcaacttcttgataaggacactgttgttccacaacaaaaactgcgattcgttctttgacgatcgcgtaaaactctgctgttgacaattcttcaaatttctttacctgatattccactaagcaaacgccccctgcttttttattcttagcataccgattcgcacacaaaaaagcaaacgaaccttacgaatctcaggctcgtttgctttttaaactgcttcagttaaaaattcgatctcaactgtccgagtaagtacatctgaatagctgtaagatactcgttcaaaagaattttcttcaggatccaaatcaacaacgaatactgaaggataggtttctgttaaaacgccgcggcgttctgtttgacgctttcttcctgtctgagcaaccaacatgattgggctgccgatacgaccttctaaatctttcttgattgaagctaaagttgttggcatacagttcacctctactatcaactataccacatatttttaaaattttcaagtttaccataaaaaaaaagaaatgcaataaaaataaataagaagctcattaagatttttctaaattattcctcattataaaatttcaagtgtttttttattttgagttttactctcccgtaagcgctcattacttgcttgtgatccattgctaaacattcagccatgtctacaaaatcaacgccttgcatataataatgaaaaattttagcttctatttttgaaaactggatttcgcaattttcgattgcttcttttaataaaagatgctgaatcgctaaaggttcttgcaatgtgatctctgctaaaaagtctggtccttctgtctctattttttggtcgattgagacttcatctttttgatcacgacgcttcagcgcgttctgcttcctcaacagagaatagatttgattgcttataatgcttttataataacttccaaagctaacacctttgcttttttcgtaagttctcaatgcctgatataaagcgatccttgcttcttgttcccaatcctcagaaacataatttcttaaataataggtgtttttcaaacgtagtaaaagtggaaaatatttttgatacagggcagcaaatgcttcttcgtcaccattacgtgcagcgcgcaataactcctcagacataaaataattcctccataaattcgtttatggaggaatcttatcatcaatgattcatcgaactgattagaacgatatgttatttattttttctcattaaatcgtccaatttttgggacaatttttttaactgctcttcattccatggagaattacgtcggaaatcaataaaatgcatatctttattttcttgggctattgttttttccgttttttttatcgtcttatataattcataagcagaagttcgtaatgctccttgggaaaagatcatccactgttctgctaaatcgcttgtcgccactgtcacttgtgtcaaacggtcattcagctgaccagcgattctctcgatataactgtcagccgtttcgtcttctttcgtaaaaacaacatccaactggtatttcttataattttgttggatgcccggaactagttgggcatcgaagacaacgatgacttccattccttcatatttcgcataatttgataaacgatgtaaaagagcttctcttgcatccgccattttgtcctgctttttaagctggacaagttccggccacgaaccaatcatgttgtagccgtctacaatcaacagctgttttttcatggtctactccccctgacgttgggaaaaagcctgatacataagcaaaccagcagcaacactggcatttaagctctggacgtgcccggtcatcgggatcgtcagcaattcatccatttcttttttcaatcctggactcattcctttgccttcattaccaatgactaaagcaattgatcctttggcattccatttttggaagtttgtgccggtcatatctgtgccaaatacccaaaatcctgtttctttgagctgttgcacagcttgtaccaaattcgtcacgcgtgcaacagggacatgttcgactgccccagtggaagtctttgttacgataggtgtgattccaactgctcggtgttttggtatgatcacaccatcgacgccacttgcgtctgctgtccgtaaaatcgacccaaaattgtgtggatcttcgatgctatccaaaatcaaaaagaaggggtcttcttttttctcttttgttcgttcaatcagttggtcaagggataaatattcataaggtgtaatcgcaagaacgactccttgatgcacgccgtgatcgctcaaagtttctaatttttgtttaggaacccatttgactggcacagcttgttcacgtgcgatttctttcagttcttctactttttctcctcgtgaatcttcttgaagaaagagtttattccctcgcccttgttgtagcgcttctactgcggcatggtgcccaaagacgaaattatcttctaatgcttcttcattttgatcagaaactgactgatttcgtccagtttgctttttatttgaatatctattttgttttttgtcttcaaatccacgtttcgattgatgtttgtttgttctttctttacccatttttttcaccaactttctgaatacaccagcggatcaattcttccatccgctcggtttgttttgtcaaatgcagatagcccatgagcgcttcgaaccctgttgcgacccgatacgtcgtaacatcagcattttttgcgctcgtatggcttttagcatttcttcctctgcgataataaagttcttcttcttctgtcaaaagatgttcttccagcatttgctgaatcaaaaaggcttgtgcattcgcagaaacataattcgttgccgcacgatgcagcttattgggttttgtttctccttgatcaatcaggtggtcacgaacatagatttcgtaaatcgcatctccaacataagccaaggctaaaccgttcaattgtgtgtaatctctcatgcttctcttctccatcgggttccttgcggtgtatcttctaataagatccctttttctttcaacaaatcacgaatttcgtcgcttcggacaaaatcacgattgcttcttgcttgatttcgttcttcgatcaattgttcaatctcttcatctaataactcttctgctgtaaataaaataccgaagatcgaaagccattgcgagaataaagcttctccttgtgccaagacagcggcagaaactttcggctggtctagataagtgttcagccacttagcaagctcatagaccactgtgatcccatttgctgcattaaaatcatcgtccatttcttcgatgaatcgctgttctaaattttctaacaaagcgattttatccgcatcatctgccaaattctctgaggcagtttcttggcggaatttcaaattgtcaaacgtattcttcagtcgttgtaaattggtggctgcttctttcatcgtcgtttcactgtagcggatcggacgacggtattgtgtggtcgccatgaagaaacgcaagacttgtggatcaacgtttttgatcatttcatgtacagtgatgaaattccctagagatttactcattttttcatcgtcttcgccaatcgttacatagccattgtgcatccagtaattagcgaattttttccctgttttcgcttcactttgtgcgatttcattttcatgatgaggaaattctaaatcttgcccgccaccatggatatcgatcgtttctcctaaatgttttgttgccataacggaacattcaatatgccaaccgggacgtcctttgccccatggtgaatcccaagaaatctcgccaggttttgcttgtttccataaagcgaaatctaatgggtcttctttttgctgctgttcttcccctgtacgctgacttgctccgacttccagttcatcgatggattggtcacttaatttcccataattttcaaatttacgggtacggtaatacacatcacctgaagattcataagcatagcctttttcaaccaacacttgaataaatgctaaaatatctggcatatgatccatgactcttggatgcagtgtagcaggctcgacattcaacgctttcgtatcttcttcaaatgctcggatgaaacgatcagcaacttctggtgctgtaatacctaattcgtttgctgtacggatgattttatcgtctacatccgtgaaattcgatacgaaatcgactttatagcctcgatattcaaaatagcgtcgaattgtatcgaaagcaatggtgctacgagcatttccgatatggatataattatacacagtcggtccgcagacatacataccgacatgtcccttttgtatagggatgaattcttctttttttctggtcaatgtattgtagatttttatcattctgatctcctcactttttctcctttgattcgaacgacttttgctggtactcctaccgctgtagcgtcgtctggaacatctttcaacacaacggcacctgcaccgattttggcgttttttccgatcgttaccggtcctaatatctgcgcattcgcagagagcatggctccttgtttaacagttgggtgtcttttacccgtttcttttcctgtgccgcctaatgttacgccatggaataaaatcacatcgtcctcgatttctgcggtttcgccaatgacgattcccattccatggtcgatgaacacgccagttccaatcgttgctcctggatggatctcaacaccagttaggaaacgccagaattgagcattgatcttcgccaataaaaagagccggtgctgatataaaaaatgagagaaacgatgccaaaacaaggcatgaaaaccagggtatgtcaaaacgatctcagctgtcgaacgtgcagccggatcgtttctctttgctgcatcaatcgctcgggtaaaccaactcatgactttccactcctttcgtaagaattttatgtaggaaatcatcttcttataaagaaaagaagcgccttttaaataagtttccttatcaaaagacgctttccgcgtggttccacttttcttcataatcaatgattatctctgacagctaacgcctgttatacgttcttggctactttgtttcctataaaacagtttttcctgttttctgtgtttcgccaagaccactcccagaggcatttcggcaaccattcattgataccttgcaccacccggtatctctcttgtaatgatcagctgcttacttttttctgttcatcgtgtttagttcagtacttgatttaaatgtgctaatgatttttcacgaccaagcaattcgatcgtttcaggcaattctggaccatgcatttgtcctgatacagctacacggattggcatgaaaagattttttccttttacgccagtttctttttgaacagctttgatggcagctttgacagttggagcatctactacttccatttgttctagctgtgctttgaatgcgtggagaacagtaggaactgtttcaccagcaagtacttcttttgctgcttcattcaatacaggatgttcattgaaaaatagcgtagacagatcaacgatttctgcagcatagctcatttgaggttgatacaggctaacgatcttcttcacccattcgattgtcttttcatctgggttttctgctacacgtccatcagcgattagataaggcagacacatgtcagtaaatgcatctagatccattgctttgatgtaatggttgtttacccattgcagttttttcgcatcgaaagctgcgggtgatttacttaggcgttttggatcgaacattttgatcaattcttggtgttcgaagatttcgtcttcgcccacaggtgaccagcccaataatgcaataaagttgaacattgcatctggtagatagcctaattcgcgatattgttcgataaattgcaagattgattcgtcacgtttgcttagttttttacctgtttcactgttgatgatcaatgtcatatgtccgaaggttggtggtgtccagccaaatgcttcatagatcatcagttgttttggtgtattggcaatatggtcatctccacgtaaaacgtgagtgattttcatcaaatgatcatcgaccgcaacagcaaaattataagttggcataccatcgcgtttttgtatgacaaagtcgccaccgatattatcggattcgaacgaaatagcgcctttcaccatatctgtaaatgcgtattctgtattgcgaggcacacggaaacgtacaacagattctagaccttgtgcttctttttctgcttgttcttcaggtgtcaagttcgcacatgttcctgcgtaatgaggcatttctcctcttgcgcgttgtgcttcccgttctgcttctaattcttcttctgtgcaatagcatttgtatgctcgattgctagcaagcagctgatcaatcagcggttgatagatttctttacgttcagattgacggtaagggccgtattctccaggattttcaggagattcatcccaattcattcccaaccaagcaaggttttccaactggcttttttcgccatcttcgatattacgtttttggtcagtatcctcaatacgaataataaagtctccatcattgtggcgggcaaacaaataattgaataatgcagttcttgcatttccaatatgcaggtgcccagttggacttggtgcatagcgtacgcgtactttcgtcattttcttcctcttctttcaaactagactttgactaacagcaaaaattccgtcagttacggcttctcaaatatcatttatttaaagccactcagcacaaattttaccttttctaaggtaaatagtaaagccaactggttgaatttccttaccagttggctgaatttcttttttattttgattgtttagtctttttctctgtctcttttttattgtcgattcctcgtcctgcatgtgcaggtttagcaaagatcatgcgtccagcagctgtttgaagggcacttgttacaacgacttcgatacgttcattcatgtaatgctgtccatcttctacgacaaccatcgtgccgtcatcaaggtaggctactccttgttggcgttctgtcccggcttttactactagaacattcatcgtttcaccagggatgacgactggttttacggcatttgccaacgcattgatattaagaacaggtacattttggaattcagagactttattcaagttatagtcattggttacaatgacaccatctaaaagcttagccaatttgatcaatttgctgtctacttcactgatatcttcaaagtctccatcgtacatttcgacagatataccctcttctttttgcaaggcatttaggatatctaatccgcgacgaccacgcacacgtttcaaactatcccctgagtccgcgatgtattgtagttcgtaaagaacaaaattagggatcatcaaggttccttctaagaatccagtctttgtaatatcataaatccgaccgtcaatgatcacgcttgtatccaagattttatatttatggaaattttctcctgattttcgttctaacagttgactctcaacttgactagctgtttcttgctcgatttttttgcttcgtgaaccaaaaactttcttccattcttcgattcgtgtcgttcccattctcaatcccagatagcctaagatgatcatcagtaaaatcggcaatacactattgacgaatggaatttccatattgtaaagaggggtcgagatcacaacacctaaagtcaatccgatgatcgcaccgatcgcaccgaagagaagataagtcaagctgacctcacttagtttttgttctacttgtttgataatagctgagatatgtttggccaacagcaaagataataaaaagaaaataagtgcgcctaacaggctgttggtaaatgtattattcagccatccgtttgactgttgaccgattgcctgccaagctgagggtaaaaatgaaatacccaagcttgcgccgacaatgatcatcagcaaagtaatgacacgtttttgcatcgtttttcctccgtttcgacaatcatttattagttagcggaacacacgcttcaacgtttcagccaaagttgctactccaactatctcgattccttttggcgcttcccagttacctaagttgtttttaggtaggtatacttttgtgaagccgagtttttggacttctttgactcgttgttcaatatgactgacacgtctgatttctccagtcagtccaatttcaccgatgaaacattccgttggctgtgttcctttttctttatagcttgaagcaatactgacagcgatagctaaatcaatcgctggttcatttaattttaccccacctgcagcttttaagtaagcatcttgattctgaagaagcaacccagctcttttttccagcactgccatgatcagagatacccgattgaaatcaagacctgttgttgttcgtttggcatttccgaacatagtaggtgtgactaatgcttggatctctaccaaaattggacgtgtcccttccattgccacaacgatagcagagccagttgcaccgtctaggcgttcttctaagaaaatctgtgaaggattagcgacttcttccaatccatgctcatgcatttcaaaaatcccaatctcattcgttgagccaaatcggttttttactgctcgcaaaatccgaaaactatgatgttgttcaccttcaaaatataacaccgtatccaccatatgttctaacattcttgggccggcgatcgagccttctttggtaacatgaccgacgataaaaatggctatcccatttgttttagcgattttgagtagttctgcagtggtttctcttacttggctgacacttcctgccacacttgtgatgtctggctgcgtcatcgtttggatggaatcaatgataacataatcaggggagatatgttcgatggcacgactgatttcgttcatatctgtttcagcgtatagataaaattctgtgttgatacttccgaggcgttccgcgcgtaattttatctgctctgcgctttcttcgccggatacatataagacttttccgcctatggctgctaattgctgagaaacttgtaacagcaaagtggatttcccgatacctggatcgccaccaatcaagaccatagaccctggcaccacacctccgcctaacacacggttcagttcttctaattttgttttgatccgaggttcttttttagggacgacgtctgcgatttttgttggttttgctttttctcctgtcaaacttgtccgagttctgcggtccgttgtatcttgttcgatttcttcgaccatcgtattccattttccgcaatttgggcagcgtcccaagaacttaggcgacacatacccgcaattttggcaaacaaattgtacttttgatttttttgccattgtaccgcctccttttatcctaatcatgagacattaaatcaagcttaagtatctttaacgttttatttactggaagaaccaaatccgccttgacgttgagcagtcgtttgatcttgatctgcttttaaaaacggcaaaaagatcccttggccgatacgctcgccttttttgatcactacatccttgaaaccaaagttggtgaattggaacatgatatggccttcatttgcctcattattgtaataatcactgtcaatcacacctactccgtttgtcaacactaaaaaccgcttcaacggattgcttgaacggttagcaagctgcaaaaattcatcttctcccatgtaagctttgattccagtaggcacgagggttggtttcaattgtttttcattttctgatacatcttttttcaatccatctgcgactgtttccaacccctttttccagcctgctttccagatacttggaatcacgacctcttctgctgcttcaaaatcatagccagcagcatgatgtgtagcgcgctgcggtagattgatattttgatctttatatttagaaataacttcaaatcctctttttctcaccggttttcctccctaaataaactactcctattctaacatatccgaggctgtaaaagactttctttacaaattcttcaagaaattctgctatcttaaagtaaaccattaattcgttctttttccaaacgactgcaagttgtacaaaaaaactattttttacatgactttactcgtcaaaacaagtagaatagaacgaaattaatgagtggatatttgattgaggtgtcacatgcgtaaagaaattaaaaatgcaaaacgaattattgtcaaagtaggaacaagtacattgatttatcccaatggaaatatcaatcttgcggcaatcgatcagttagcttttgtcctttctgatcttagaaatcggggaaaggaagtgatcttagtctcatcaggagctgtaggcgttggtatgcataaattacatttgtcagaacgtccgactttgattcctgaacagcaagctgcggcggctgttggtcaagccgaactgatgaatatctataatcaaagattcagtgtatataatcaacagacggcacagatcctcgtgacaagagacgtggtagattatcctgaaagtcgtaaaaatgtgaggaatacattggaacagcttttgattatggacacgatccctatcgtgaacgaaaacgatactgtagcagtggatgaattagatcatctgacaaaatttggcgataatgatcagctgtcagccatcatggcaaaacttgtcgcggcagaccttttgatcgtcctttctgatatcgacgggttttattcagataatccgactacaaatcccgaggctcagatgtatcgctatatcgataaaatcgatgaaaagattctggcacaagcaggtggtgctggtagcacatttggaacaggcggtatgcagagtaaattaaaagccgcttctaggatatttgaagcaaacagcgcaatgattttagcaaatggaaaaaatccggcaattatttttgatattcttgcaggaaaagaagtaggtactttatttaaggaggacttgaaatgactgacttgatgcaattaggacaacaggcaaaagatagcgcgcaacaactagcacttatgcctacaaaccgcaaaaatgagctacttgttcaaatggcacaaaccatcaaaaagaatcaacaagcgatcattgaagcaaatcataaagacttagaaaaagcagtcgaaaacaatatcagtgaaacgatgcaagaccgcttgcagctgacacctgagcgaatcaatgccatggctacagagatcgaaaaaattgcttcgttagacgatcctattggaaaagtagatgagatgtggacgaacaccgacggattgagaatcggcaaaaagcgcgtgccactaggcgtgaccggcatcatttacgaatctcgtccaaatgtcacgacagatgcagctagtctagcattcaaatcagggaatgccgttatccttcgcggtggcaaagaagcattcttctcgaatcaattattagtccaattattgcagcaagtactggtcagtgctggcgaatctccttatgccatccagtttgtcgatgatacttctcatgaaactgcaggacagttgatgcgattgacagaatacttagatgtgctgattcctcgaggcggagcaaaattaatccaacgagtcaaagaacaggcaacggtacctatcattgaaacaggtacaggaaataatcacgtatatatcgataaagaagcacagttatctatggcagtgaacatcatcgtcaatgcaaaagcttcccgtccatctgtctgtaacgcggcagaaacattgctgatccattctgagatcgcaccttttttcttgccagctattgaaaaagaactggtagaacacggggtctctttacgtgcggatgctcgtgcgttagaatatctagagacggctgctttagcagaagacacagattgggatactgaatatctagattatatccttgctgtcaaagtggtcgattctttggatgaagcaattgcacatatcaatcggcataatactaaacattcagaaacgatcgtgacagatagttatgcggctagtcaacgtttcttaaatgaagtggacgcggcggctgtctatgtcaatgcctccactcgttttacagacggatcggtatttggttttggtgcagagattggtatctctactcaaaagttgcatgcccgtggtccaatggggttaaatgaattaacttccacaaaatatatcatttatggcgatggacaaatccgcgaataatgtttcgtgtgaaacattattcccgccttttgccttttttctgtaaaggttctatccaactagaaaggtgtcaatatgtttgaaattttaatgattttttttatttaccttatttctctgaatatcgctgcttttctgggagtcggtattttatcccttttctttcaattcaaaaaacgaagcatagggagtcaacgggaaaaatggtcgcagtattttgacaaaatcgggcaaaaagggctggttacacgcttgcacattagttacatggttgcattatgcttattagcgacaatcaattactattcttttttcgatcattcaatcgcttatacgattacgctactgattgctgggatttttcacttatcttataaatatcagctgaataaaaaccacttgaatcggactttccgctaaaaaatatccgtacgataagtagagtgccttgaagatcggcaaaaaactgccggactttttagaggctgtgacaaagattttgtcacagcctctttttccatataaacggcgttcgcctaccagctgcctggtaaatctgtttcctcttcgttaagaagcgaaaatccgtcaaatgtttcgccatcataataacgaagcagctcatccatggacaagttcatcgttttttctttttcttcttccgctgattcagccagtagctgttcccgatacacctgatacataccagctattttttgctgcatcgcttttctagtttcaccttccgcattgattattggcaattctttgatatagccacgataaatcaaccgatcatctgaaaattcaatgggtaattcaacgagtgtcaacccgacttcctgaaaatattcttccagcatctattatccccccattctttttcttaaatgaattttagcttacctactgaaaattttccagtttcattattttgagaaaaaaagggaatgtgacaaaaatcgtgtcacatcccctttttccgaataaatggtgttcttctgccaactcctcaatcataagtcacaatattcaacaaacatgagaaactgttttttgaaattgttccttgtgattcagagttaaacgacagtctcacaacctcttggtaaacggcgttcaaaagcttgcatctgcggtaataagcccaaccaaacgaaaaatatgagaagctatttttgtttggctgttcttatgacttgatgcaggacagctttttcacaacctctgatttcttattcttcttcatttgtagcaaaataattacggtgataaatgatacaacatacactgataagaacaatggcacctgcaaaataaaacgcatagctttcaccaatatgttcaccaatcacacctgcaataaatggtgctaaagctccaccgaaaaagcggacaaaactatagctggacgaagcaacgtttcgttgcagacctggtatttccatagcaatcgtcgtcaacagtgtattgataattccttggaaaaatcctgctaacacaatgctgatcggtacaaggactggcatagaagttccagctcctaataacagcaaacaaataatgaataagacaaatgctgctaaaattgtccgataagtcgtaaacttccgctcaagagccggtgcaacgaaaatcgaagcaatagccagaagcacaccccagccaaaaaatacaaaaccgacttctaattcagaatagccaatcaataaaaatggcgcatacgcaagtaaagtaaagaatccgaaattatataacaatgcgattagtccaactgaacgaagtttatgattgcttaacgctttgacaccttcccaaaggcctacttttctctttggtttctcagtttcaggtaaaagtaccgctagggctataaaaccgcaaaacatcaaaaatgctaccccaaaaaatggataacgccatgaaccactgcccaagaccccaccgactagagggccaacagccattccgcagccaagtgctgcttcatacatcatgattgctttttctgtgttaccaactaaaatactgacgatcgttgctaaagcagtagagacaaataaagcattcccgacaccccagccggcacgtaacccaatcagcattccgatattcccagataatccgccaagaccagcgaatacaacgatgataaacaatcctgtcatcaatgttttttcaaaccgatccgactagataagaaacctgtaaatagcatcaccacaccagtgactaacatgtaactagtaaataacagggtcgtttcagctggcgtagcgtttaactgtgcagcaatcgtttttaagattgggtctactagacccactcccataaaagcgatcatacaggtagctgctacaactagcgctgaacttttcccctttgtttcttcatttgtttgttcttgtatatctatttgattctccaatatttccatccctttctctctattagcatcatacatgatttattttacatgtaaatatgcacatgtaaaacgtggaaactttactgtgatataataaagaaaataagacgagaggtaggatttttatgaatactttagcctatatattattatgcgtgcttttatccaaaccacgttctgggtatgaattgaagcagctgatcacaattttttgggaagcccatcacagtcagatctatacaacgcttgccaagttagaccagcagggttatgtgaccgttttggacaaagacgagcactctcaaaaaaagatctaccacttgactgatgaaggacgtgctcttgtagaggaatggatcaaagaggaaactcccgctcctacgcaaaaagatgaatttctagcaaaaatctatgctttttcgacgctcgataaaacaacagctactggactgctattcactagagaacaacagctgaacaaaatcatgcaaaaaaatcaaaaaaaattgaatgacctctcgctagacaagaaacaagaatttggacgttatgttgtgatccagcgcagaattatgctttgtcagcaggaactccaatggtgtcagcaagtaagagaacaaatgcagcagttttttgagtaagggataaacagaacctttctagaaatatctattgaagagcaaattatcttcaataaaagagcaatacagttggaaaagaaaaagcgatccgaacgacaggccaaaacctatcgttcggatcactatttttctagaactgcattcaagagactatgacaaaaagcatgccaaggccttttttcaaataacagtgttccatcattcattactttgaattgcttttagcacacttcttgaaagcgggccaacgatgatcaactgcaacggtaaagcggcaatcacattcattttccaagcattcatataagcagagaataattgatcaggtattccttgttccatgatcacaccgaataaagacatacatgtcaccattcctaaaaccatcaagcatgaaatagttaagatcatttggaccttgctttctggatttactggtagtttaaaggcaatttttttcgccagcacaccgatgatgaagacatccaaaatgaaagccaccacgaatccaggcactagaccaatcaacaaacttgataaatgaagatcttgatgcagccataaattatacgcgctcatccccaagaccatcaaaaaacacatcattgttgtaaaaattattccttcttttttatttgtaggcaatctgtaccactcctttaaatttgtcacgaaaatcatcgtagcacatttaaaaatttctcgtaagtactttttttattttctgcccttttatttcataaacttcatcagccgtacgctcgacaaagtaagaatcatgagaagtaaacaaaatcgttcccggatatatttgcattagcttctctaaagcttcgatcgttgccatatcaataaaattagtcggttcatctaacagcaacacattacttggcttagtaaaaagcaaagcaatcgtcagacgggtcgcttctcccccacttaatgtacataacggtttcgtcaaagtttcctgagcaaaccctaagtgattcagcaaactacggacaagcgattctgaaaactctgtttgtctcatgacaaaacgaatgatggattcttcagatgtcatttgataacccttttgctgatatacttgaaagcttactttcggagagagaaggattccttctccttgtttgcggatatgttctaataaggttgtcttacctgaaccattttcaccgacaatcgcgatttttttacctaaagaaaactgaaaatcaccatttaccagtaatgttctcccacttctttccaattggacattttgtcccatgatgggatagcggctgtggagttcaagagattttggtactggaaaacggatttgtttcatctgctgcggcttggttgtttctcctattttttggagtcttctctctaatgttttcgcattcttttggatggctttttgtacactgtctttttgtttagaggaagacaaccgatccggtctgatttgttgctttttctttttactggacactttttccaacttttccgcttgttttttcttttcttggatcgatttttccaatcgttttttctctttcatgatcgactctgcttctcgtagctgagtctttttctccaattccttttgagtgagataggcactataattccccgaaaactctcggatttctccgtcttttacttcccagattttcgatgctagctcatctagaaaatagcgatcatgactaacaaaaaccagcgtaccataataataacgaagctcttcaatcagtcgatcaatactttttctatctagatgggttgttggctcgtctagaagcatcccttgttcataagaagaaagaagacgtatcaactcgatctttcgttcttcccctccgctccatttccgctctgaagtttcttccagtcttaactggaaatgactggctaattccaaatttaggtcctttgcttcagcgagataggttaattgaggcaggtagttgaaggtgatctctgtttggattttcccatgatcgggaaaaagttcaccggctattagtttgagcaaagtcgatttaccgacaccattttctcctatgatccctatacgatcttgctgatagacacgaagagaatcaatagatagttctagctggttgccaaagctgacttgtagatttgttatatttactgctaaattttccatatgttttacactcctatttcatgtaaaacaacaattatcgatactaaaaaagagcagaaaaatctgtttgcaaaaaaactgcatcacatcttttcctactctgaacgaaataactatgactaaatcaccaaatctgtcatagctttcacctattctactgtcgttcgaaaaaatggacatactccatccatgaaattgttgtttatacatgtcttttgaatttatttagttgttattcaaaagttcgaaacgtaatttcatcgatgcagtcatttttccgacctccttttttattaggttaccacacacgattcaaaaaaagcaatagctactgaatagtaactgaaaaccttttattcgaacgtagtgatcttttctggtgctaaacgaacagactcgtaaccttcttctaccgcttttcctattgataaaataataactggaacataacggtctttatccaaaccaaatgcctctgccaactgatctgcttcgaatccaccaattggatttgtttcatagccatgatcacgcgcaactaacatgaattgcatagccgctaagctagaatcgactttgactacatcgttcatttcttctcttgaaaaactcttgtaataaggaatgatcgcagctaattgttgatctctgacttcttttggcatcttccctgattcgtaagcttggttatagatttcttcgccatattcgtaacattgcatatcgccaaaaatcatgaccattgcagaagaagtatcattttgtctcgtattgaaacggatcaaaggacgcaagatttcttttgcttcctcgctttcagcgaccacaaagcgccatggttgcatattgacagaagaaggtgcagtcgtcgcttctttgatcatttccagcatttcttcgtgtgggattttgtatgtttcatcatatacgcgaacggatcttctaccagtcataattgttgaaaaatcatttttttgttccattattattaacctctttcgtttctgttgttatattgcaaagttgggtattcaatttatctaaaagtgttagaaattgtttcatttctacatcgctgaaagccggggatagcacggaacctgtatctttatggtccatttcacaatgctcgattttcttctgggctttttctgttagcgctacatacacttcccggttgttctgaggatttctctgacgcgaaacatagccatttgcttccaataccttcagatgacgagtaactgctccttgatcaatctgcaacttttcttgcaaactgctttgtagcaatggattttcttctttcagtctcatcatgatctcgtatctagtaagacttataccgatattttcttcaaagatctggacgattttttgatcggctaatttgatttgatataaaaggtgactaatctcttctaaagacataatttcctcctttctaataattgactcgtcaacgattgacttgtcaataatagaataaaaaaagaaaaaagtcaaagaatcagctgtgtaataaaaaaaacgctctcaatagaaaagtatagagaaaagaaattttttgtagaatgaacggaaaaaatgataaagaaagcacaacgctaaaaccaagattattgattcttatcaaactatagaagatagctcttctgcagtagaaaattttacaccgccaaaaatttccgaaatcgccttttgcaagaatcccgtcgaatattagaaattggatcagtatgcttaaacagtaataaaaaagttatgacaagatgttgtcacaaccttttttgagtaaacggtgttcaaaaacttgcatctgcggtaataagttcaaccaaacaaaaaacatgaaaatctgtttttgtttggctgttcttactacttgatgcagggcagctttttcactacctctttttaataaccataaaatcctattccttcatatctccagcccatcggtgttagccaatctctttccttagcactcaaggtatagtgatgggtaccagttttttcatttggattaaatagtcgataaattggcttggaaccaccagaataaaaacttagaccttcataacgccaaccgatttttgttaaagagttgatctcagattgtgccattgtgtaatgatggtctccactgtaaggattgtataaacggtagacaggttgtccgctgtttggtgcttgccaagcaatcccttcatattcccagcctacagttggcagataatttttttctccggcattcaatgtatataaatgttctcctgtatgacggttatacagacgatacatcggagaagttgaagttggtgctgtatcatactgtgtcagattataggtttcgattacattgttcaatgtagaaccataattaggcgcagtggcataacgacctgttagccaagccgtagcatctttgtaagagttcgtattgcttttccatgcaccggaatagtagtaaacgcctggctgaaaagaagtcgtcttcaataccgttacgttatcttgcaatgattctttgtacgaaggatattttctaaaagcggcattcaccgtaatccattgcccattcacatattccgaagtaggcatcgtaacagattggccattatagcttcctttaatcccaaatagattgtaattaggggcagaagccaaagtactgttcccccagccactttcaacgatggcttgagcaatcatgactgatgcatataagtcattggcacttgccaaactttgtgcagttgaggcaatactatcaatgaacgcttgttgagaattagcagatgagcgagcataaaaagcatagccagtatagttttcgaattcagacaaatctgcttgatgggtatgtgtcaatgtttgcccatctgtcaattggttcgtgatttcttctgcattctctggattgttctgagcttctgctgatgtactgtcttcggtttgtgtttgttctgttgtttcagttgttggttcttcggttgaaattgtattttctgagacagtagctgactgcaaagtactctctgtatcgttttcaattcctgtttctgaagaactcgatgtctgagttgcgacagtttctgtcgattcttcagctagcactgttgtgttggcaactgctagatttcctaaaagaataacgctaaataataaattctttgctttcatcttttttctcctttgaattatgaaacttttcctaaataacagtgtaactaaaaaagtaaaagcaagtcaatgtccatatttaaataacatttgtttctttttgataaatttgctttttctacataaaaagacgtaaatgaagaatattcttctccattcacgccttaaattgatggtcgtttgaataactatttaacaagtaattctctttggatattatccgttatggattatacttcctgtgtcgtcggacggataatcatgttactgacagacatccggtctggcgtttctatcgcaaatgctacagcagaagctatatcttcggaggtcaatccccattctttttgcgcttcatgaagttcaagagcagcctttttgtcgctgatggtttgatataattcagtttgaacagctcctggagagatgatcgtagatttgatgttattttgccgttgctcttgacgtaatccttccatgattgcacggacagcaaattttgttccgcaataaacggcggaatcaggataaacaacatgtcccgccacagaatcagttgaaatgatatgcccagatttttgtttttccatgattggaagtacggcggaaattccatttaacacacccatgatgttgatatcaagcatattttgccattcatcacggtgaccttcaactaatggagcggttggcatgattcctgcattattgtacaatacatcgattcgaccgaacttttccatcgctaaatcgataactgcttggacttgtgcaaaatctcttacatctgctgtttgaatatatagctcagcttctggtaaagattcttttattgcttttaggcgatcttctcggcgtgcagctataactagtttagcccctttttctgctaatagcttcgttgttgcttcaccgattccgcttgaagcgcccatgatgacaatcactttttctgataaatcattcattctattctcctcctgttttgaaaaatctcttgcttatactcactatctcttatttcatcttactgttcaaataatccgttcgacaggtttgacgattttggcagggattcctgcaacgatggtattgtctgggacatctttcgtaacagttgcattcgctgcaacaatggcattctcgccaatcgttacgcctggcagaatagttgctcctgctccgatccaagcatttttcttgatgtggattggctttactgacaagcctcttcgttcttttggatcggttagatggttcaccgtgatgaggttgacacgaggaccaatcaatactgaatcttctaaacagatgccacctaagtcaacgaacatcacttgacgattgataaagacatttttccctatactaatatgtttgccgaaatctgtataaaaaggcagcagaacagtcaccgtatcatctactttgtcactaatgatattttctagccgtttgcggatatctgctggttcatggtacccagtattcagcgctgctaaaggctcttcgttttcagcttggatctgatggatcacttcaaagagcggatccgttactcgaatctctttattgacgatttgtttttcgatgaggcttgtcattttgctccctccttttatccttactttataacggacggcttatcatgtctaatacttataaaacatacttaactattccttttaactatacttagtggtatgcttttttaaaaacaggagggaaaaaatggatattcgtatactgacgtattttttagcagtagctagagaaaaaaatatcagccgagcagcaaaatctctgcatatcacgcaacctactctctcaaaacaactgaaagatttagaagaagaacttggtgtgacacttttcactcggggctcccgagagatacagttgacggattctggtcgatatctttattcaaaaggaaaagaaatcttgtcgttggtagaaaaaacggcgaacaatttaacaaatgacgcaatcatctctggagaaatctacattggcggaggcgaaactaaagcaatctctttcatttctgatagccttcattcgttgatcaaggcgcatcctgatatccagtttcatttatatagcgggaatgcagatgatatcatagacaaactggatagcggattacttgattttggactcgtaatcgaaccgacaaacaaacaaaaataccagtcatttcgactgccagcccaagatcgttggggacttttgatacatcgaaatcatcctttagcaaagcaaaccgtcatccatccgcaggaactgaaaactgttcctttgatcatttcccggcaaacgtcagtggacagtcaactagctgaatggctaggtttcagcatagatcagttatcgatcgtcggaacatataacttattgtacaatgcttctttgatggtcgataacgggacttttggtgcattagctctagatgggatcatcaatacttatgggacggaaaaaatattcatcccactcgatccgccattacaagcttcactgaatctcatttggaaaaaagaccagcctctttctcctgctgctcgtaaatttttagatgtcctaacggagaaatacagttaagtagagtttttttccttcgctttcagctttttaacaacgaataagataagcaaaagatccaacgattaaataacataagtttcttaatttatttcttccttttatttctgataattccagtaaattactataattataaaaaaagaattgacaaaacataactgtctatataaaattgattacgttaacaataattcgtttcatgtgactagatcatactaggcatgaaaaatctctgaggaacatggtttccctaggaggtttttcgtgtctatttttgtttggccgcaatcaactggtctagcaaacgtgaaaaccaaatcttcaaaaagggtgcgcgcatgaaaatcaaaaagatctttaatcaaaatgcagtattggtagatgacggtggacaggaaaaagtagctattggaaaagggattggatttgacagaaaaagaaatgatttgatttttgatcgtgatgtcgaacggatatttgtcatggaaccagaaggtcaaatcaagttgcaaaatttacttaatcagattgatgaacgctttttatttgcagcagaaacgatcattgatcatgcggaaactgttttgatggaaaagttgaatgaacatgtattgatcgctttgaccgaccacattgctttttctgcggagaacattaataacggtatcgtcatccgcaacaaacttttaagagaaatcgaagtgctttacagtgatgaattcagtattgctcaatgggcagtagagtatctgacaaaagagcttgggattccatatacttatgacgaagcaggatatatcgcaatccatattcacagcggacgaagcggtcggaacaataaccatcgcagtatccgtgaagtgacgattgtatctgacatcatccatttagtggaatcagaattggaaacagatatccattcagaaccattttcactgaattattcaagactggtgaatcatttacgactgcttctacaacgaacccatgcgcaacaatatgctgttttagacacggaaatcgtagaaatggtcaaacgaaaatacccagaaagctataagatttctaaaaaaatccgtgtgttgctgaccaaagaataccagctcgcgatcacgaaagaagaactgggttacttggccatccatatcgagcgtttaagaagcgcaatcgtacaaacaaatgttaacaatcatgaggaggaaaaaaattgaaagcatatctacaacgaatgggacgttcccttcaacttccagttgcggtcttacctgctgctgctttactagtagggatcggaaactggtgggcatcttatagtaacgacattgtcgctcattttttacaagctggcggtaacgcagttttaggtcaattacctttgctgtttgccgttgggttagcactagggatgtcagtggacaaatcaggtgctgctgccttggcaggtttggtcgcatttgaagttccagtaaatgttttaaaaactgattcagtagctactttattgaatatcaaaccagaatcagttgatccatcttttgctcagatcagtaacgtatttattggtattattgccggattgattgcggcagctctttataatcgtttccacgaagcaaaattaccgatggctttatctttctttagcggcaagcgtctagtgccaatcttggctgcctttgtcatgttgctgatcagtgcagtgctactgctcgtatggcctccggtttactctgctttagtttcttttgctaaattcattttgagtttaggctggggtggtgcaggtctttatggcttcttcaaccgtttactgatccctacaggattgcatcaagcaatgaactccgtgttctggtttgacgtagcaggaatcaatgatattggtaaatttttggcttctgaaggaacaaaaggcgtaacaggaatgtatcaagctggatttttcccaatcatgatgttcgggcttccagcaggagcatatgctatttacagaaatgcacgtccagaaaacaaagcaaaaacagcttccttgatgctagcagcagcttttgcttcattctttactggtgtgacagaaccacttgaattttcatttatgttcgttgcttggccattatatgtcttgcatgcaattttcactgggatttctttagcagtgagtgcattcttccattggacagcaggatttgcctttagtgccggatttgtcgattacttcctatctttgaaaaatccgattgcgaatcagccattgatgttgatcgtccaaggattagtaacagcagtgatttactactttggctttaactttgctatcaaaaaattccatctgatgactcctggccgcgaggaagcagatctttcagatgacgatactgcaacgactaattcagacaataaatatgcggcacaagcaagcaaaatctacgctgcattaggcggagccgacaatgtaacttcgatcgataactgtactacacgccttcgtttgcaagtcaaagatacaggcctgatcgatcaaaataaaatcaaagccactggcgtacctggtatgaagatcatcgacggaaaaaatgcgcaagtcatcgtaggtacagaagtacaattcgttgcagatgagatggcaaaactacatggtggtgctgcagcacgacctgcacaaacaaacaccgtggttaaaacagaaacatttgccggtgaaacgatcgaacaagatatttacgctatcgcaaatgggaaactgattccaatcactgaagtttcagatgatgtattcgcggaaaaaatgatgggtgacggctatgctgtattaccagaaaatggagaaatcttctctccaatcgctggtacgatcacaaacattttcccaacgaaacatgctgtcggaatccaaacagatgctggtatcgaagtcttgcttcatatgggcatcaacactgttgacttaaaaggcgaaccattcactttatatgtagaagaaggtcaaaaagtcgcaagaggtcaattgattgctttagttgatcttgccgctattcaatctgcaggcaaaaacacggatatggtcgttgtattcacaaatggcgacaaagtccaaagcttagaaatcgaacccgcacgtgatgtaaaagcaaatgataaaatcggctctgtttccaacaaagcctgagccatcgtcttccccagacttttttatcgataaacaaacaggagctgagacaaaaatcttgtctcagctcctttttccgaataaaaacggcgttctcctgccaactccgcggtaataagtccagctaaacgaaacatatgaagagctattttttatttgactcttcttattacttgatgcagaacagctttttcacaaaatttttcttcatactcaaaactaatcggctttttcacaacctctttatacattattcctgatccaatatttcttttaatgctgcttcaagagaagttaatggttttcccaatactttttctaaatcatcagaggaaatagctaactgatcctttttaatatcatgttggatcgctaaaaacatgtcagctgcttcttgagggaatccggcttcttttagattttcgacaaacgctgcatcacttgcttcaataatttctaactctttacctgtcgcacgctctaatgccttggctaattcttcatagtcagttagattgccggataattctaagatttctggagagtcactttctactagtacttttgctgcagcttctgcatattcacgtttcaatgcccaacctgtttttccatttcctgcagcataaacgaattgaccagtttttaaagcctgcccaatgataggtaattcattctctacataccaattattccgtaaaaatgtatgggaaatacctgaatccttaatcattttttcagtgaattggtgatctggcgctaatacactgatcgagtgatcggcatctgcaaaacttgtataagcgatataagataccccagctgcttgtgctgccttcactacattcttatgttcggcttgacgatttcctggaacgccagagacaaaaagcaatcgatctattcctttcaacgcttctttcattgagtctaaatcatcataatcaccaatacgtatattaaatccagcttctttcagtgcttctcctttttcttcactacgtactagtacatagatttcattttgtggaaccatcttttttaagaattccagcgcataaccaccaaaacctccagttgctcctgttactaaataatgcatatttgccactccctattctttttatttgttaagatttacagctgtacatttataaattacacctttatcataaagagtgtggtaagataagtcaagcaaaaaaaatgaaaggatgacaactgatgaagtattctctgcaatttagtgatgcaatccatgtacttgcctatattgaaatgtttcaagatacccgatcactttctagtgagatgattgccagtagtatcgaaacaaatgcagcaaatgtacgtaaaatcatgagtcagctcaaaaaatccggtttgatctttacaaaaaccggaaaaccgcagccttcccttgccaaaagtccagatcagatttctttactagatgtctatcgcagcatcgaaggtaatacacagcttatccaagtcgatccaaaaacaaatccaaattgcgtcgttggtgcgaatatccaagaagctttagaagaaagctacgctcggctgcagaaaaaggcagaagaagaaatggctaagatcacacttgatagtctgatacataaaatagccgttttggaaaaagaaaaaagaccagaaaacacaggcctcgtagagagatttttataattctctctactgtgcctgcatttttctgatcggaatcgtctacataaattcttttattctccgggggacaaaagccttgtcatgcccctttttcctctctaatgctcaggtcaaagcgctgaagtcatgacgtcttgataaacggtgttcaagtagctgaccctcggcattagttctgaaaaatgcaaaatatggaaagctatttcccatttttcctctctaatgctcaggtcaaagcgctactttcacgacctctatattatcatggtttattgactaccggtatccagatttctcccatatatttcccgttggtaactcccatttcgactacagcatttggacccccaacataggcgtaatcttctacttctcttaaaacatgcccaaaggccgtattcgtcaaatcatttcttaattcttcaggcgattctgctaaagcgcttacaacaagatacgttccttttgggaatgggatgattcgcgtagtgtttggaacatcctgactcgtttgaacaccgacatagtacatcattttcccgttatagggttcgttgactgtaaagaaataatgattttcagcagcttgtttcaatgcatctattgttccattaccgataactttttgctcaaatgcttgtttctctgcagccaaaccgacaaaatccgtattgctactcttcaattccacaccaatacccgtcaccgtaaaatctggtttttcttcgatcctatactttgccatttctcccaccctttctattatattaagttcatcttacataaaattaaagggaaatgacacgattacgctcttttttctagggatatttttattttttaactatttttttgctttcactgcaatccaaatctcactgtaaacattactgaaatcctctccccattttgtaaaagagatctcgggagcttcgactaacccataatctgaagaaggaagccattctgcatagattttcccccaagtatcttgtaaagtttggggaaatggccctttattaggaaaaatggcccaagtgtgttcttctatagcaagcatttctaaatcagcgtacggattttcttttgtcgtagcaaagccaatcatgtgcatcaaactgcccttttcttccaagcggtctccatcaaatccataagaaacgttgattacttgatttggatataaatctcctaacttatgcatctcttccctttgagtctccgtgatcgtctgcgctaacttttgtatttcttgattgactccttcaaatttgacaggaacttttttcgccacacctgccacataaaactgttctttcttttcgatacgaaattccatcgattttcctcctctgacatcaataaaaaatgtcaagcgtggaaaagatttttgtatgccgtatctactgatttctgaaggcagatatcctgaccaatcacgaaaagctcttgaaaaaccttcgactgtttcatatccatatctaaacgccgtttctgtcactcttgatccatctagaagatcgcgattagccaaagccaatctacggtttttgatatagtccattagcgacatccctgcaataaacgtaaagatgcgttttaattgatattcagagattcctgtattttcggctattattttataggaaagtccttctgtcaaatgttcttcgatgtaatcgatcaattggttcagatctttaagcatatttatcttcctccttgattgcctttttatcatattatcaaagaaagtcaattacttgatgaatcaggaaccaatttagtcagatgtagaaaatgttgtatggatctaaagaaaattctcaagcagcgtttcgtaacggataattggtattatctgcctatctatgttttacctttagaaaaataaattttggggaagacagattctaagtaaacaaagcggtaaaaatatcttttattcccttagttaatccgcttactacctactgtacaaagcaaattgttgttcaaactgctgatcagaacgctgcttggatttttctttgcgatacatcatacctcttttatcaattggaacaattatttatttctaacaaaatcacttcatttttgtcagataaataaaaaacaaaaaaagttccatctttaaaacacgctattcttttactttttctcacattctctaagaaaagaaaaggagaatgaatttttgacaattcgagcaaaagtgattatcaaatatgtaaaatcagctacttttttcttaaacgtttctttatactaaatataaataagtgtttcatgaaaggagaactagatgaataattggcttgagtattttcctgaaaacgttttggaacgcggttacagctatcatctgcacggttttgtccgtcatttgaactatacaagcaagtacttgtccgcaacagtttctggcacggaagattataaggtagtgatcacttgggatgaaaagaccaacatgacttgtgattgtctatatgccatagaaggaaaaaaatgcaaacacatggctgctgtcttattcgcttacgaagaacgtccaataaaaaaatccaactactcactttccgaactctcgtcccttgtttcctccgctagttcctctcttgtacgggagcttttaacagagattcttatagaacatccgcactttatcgaacgcttcaaagttaagatgccatttcatgcaataaattattcagataaattaacaactatcatccataaatacgatcatattatcaagaaaaacaaaaacaggaaaacagcgaagttcatcatggagatgcgaaagttcatccaagaagcagttgaatcgcttattcagcaaaatgcctatcttcccgcattcgaattgatcaatgaagtgattgctactctcgaaacattctattgggagcctgaggatgaacgaacccttcttctgatagaggactgttattatttatggaaagaattattagcagaagcacctcatgcagaaaaaaggcaaatgttctcttggttcgtctgccaagtcgatcatactgacgcctcttattcaaaacgctactctataaaaatcctgaaagaagactttcgggaaaaagaattttctaaccaaaagaaaaaaatagataaaaaactaaagaaacggtaaagaaagacgatttcaatgaaaaatagcaagtaaacgataacaaccatcctaaatccacaagaaatacagcagaccttgctttaaaaacacgaatcatgcaaaggatgaagtaaagaagacttaacgcgtacccaatattagtcatttgactattaggtacgcgttttgttttataagtcatgacaaatttccttcgttgctggatagattttccggcattgttgatagattttatgatacttttctacattttgtaagagaggttccgctgcatctgtatattggataaaattctgacaacaactttcaggtgtgtcgaaccaccctaaccctagtgcagcaatcattgttgcgcctaatgcaggtccttcctccacacttaaacaatagaccgttgcatcgaaaatatcagcttggatttgtagccatgcaagatttttcgcgcctcctcccaccgaaacaatacgtgtaaatctgcgacccgctagttctttacgtttcaatcccaccattgacaaatgctcattaaaaatttagaatattcacaagtttaacgacaattatgaaaatttatgtcgtgctaaaggagttttgttattggatgaaaagttagatataaaaactgcgatcaaagacacgttacctaccgttttcggttatatcggtattggacttgcatttggtatcgttgggaaagctgccggatttcatccactagtcgtcacgttgatgtccctgctggtctatgctggttctgcccaatttatcacagtcagcatgcttgctagtcacagcccattgctttccatcgttttctcgacctttctagtcaattcccgaatgattctgatgagtatgacgattgctccttatttcaagaaaaatcggctgcttcaaaatctgctgattggcacattgctgacagatgaaagtttcgcactgggaatgaataaattgaactatactggacaaaagttaaactttcgttggatgaatacagctaattggatttcttatttgacgtgggtgggttcttctcttgttggcgcacttttagggaattttattactgatccgaaaaagtttggtttggatttcgccatcgtcgctatgtttatcgggttactttatcttcaagtcatttctgatagaaacacctctaaacgattacagttgatcctgattggtctcactttgattctggtatatgtcggactgatttttatcccaagcaacttagtgattgtagttgtaacactgattgggtgcggattgggggtgtggatcaaacatgccttcttttgagtttacattgctgactattttaggttgtactttagcaacttggctttctagggtcctaccatttgtcttactgaaaaaattcgatttaccgcaaccgttgcttgagtatttaagttttgtcccgatcgtcattatgtctgctttatggttcagcagtctatttacccaaaatatcggacatctgccgcagatcaatctcgaaaatgctttggcttcagttcctacacttttagctgctattctttcaaaaagcttattggtgatcgtcttggcaggaattctttccctttcgttgattcgcttattataaataaaaaaacaagagcttatggcaaattactgtcatgcgctcttgtttttatcaaagtcaaataagaaaaaaatcggcgtattcttgcttatccgttgaacggaccactaacaacgacttttcctaacatatgtcctgtttctacgtctttggttgcttgtttcaagttcttcgcattcatcccatctgaatagaccttgctcaatgtactgcggataatcccttcatttgctaaagcagcaatgtgcgctaaagcttctccttgcgtttcgatttcatagttatagtctgttttagcgaacatatactcccagtcgaagctgatagattggtttttccaaacacctatatctaacggctctttgatccctacgatcgttcccacatgtccaaatggtcggacaaggtgcttgatttgatcaaagtagcgggtaatatcgaataatacagcgacatactctacttgatcgattcctaattcacgaaaacttttacttaagtcgtgatgataatcgattggatagtctacacctgtttttttcagccattcaaaattcttcggacttgcagtcgcgtagacttctaggccagcccaatgcgctagttgattcaaaatcgaaccgacgcccccggatccgttgatcactaagatttttttcccgcgattggcattttcttctggagttagaccaaatttttcaaataacaattcataagcggtcaatgaggtcaacggcaaggctgcagcttcttcatctgaaagattttttggtgcaagagcgacaatacgttcgtcaactagttggtattcttgattgcttcctgctcttgttgttgtacctgcgtaaaaaacgcgatcgccgacagaaaatttttgcacttcgtcacctacagcaacaactttcccgactccatcaaaacctaagatacgtaaagcatttcttatcccgttatcttggcgaagtttcgtatcgacaggattaacagatactgcgttgacttttaccagaagatcccgtgaactgggtacaggtatctgttctttttcatcaataaagctttttggatcatcgatcggcaacccttcataaaaaccgactaccttcattaattccttttctgacatacgaattcctccttagcttcatcaagttggagcatccatacagtgttcatttcaatatatatagtatgctatttgttccaccttttttattcatcataattattctcttacttaaagtaaactatttgcacttttttggttaaaaaagaggttgcgacaagacttttgtcacaacctcttataaacggtgttctcctaccaactcttcggtcacaagtcaaaatattcatcaaacatgagaagctgttttttgaaattgctccttgtgactcagagttaaacggcaggctcacaacctctgatataaacggtgttcaatcaactgaccctcggtattagctcaaaaaacgacaaaatatgaagagctatttttgtttggctgttcttattacttgatacaggacagctttttcacgacctctaattcacggtgttcaagcaagaaatcattgttcactgaaaagcgttggatgttctttttcaaaggtctctaagatctctcgtacttcatcagtagatttcgtattcatcaactgaactcgcaagtcatttgctcctggaaatcctttgatatagattttaaagaaacgatgtagtcctgtgatggaacgcgggatgatttctgaataatgatcttgcagatctagttgcagacgaagtagtccgatcagttctttttctgtatgttccctcgggtctttttcaaatgcataaggattcttgaaaatccctcggccaatcatgatgccatcaacgccatatttctcggccaattcttctcctgtctggcgatcggggatatctccattgatcgtgattagtgtttgtggagcgatttggtcacgtaaagcaatgattttaggaatgacttcccaatgtgcatctactttactcatctctttacgcgtacgcaaatggacagaaagattggctatatcttgatgaagtaggtgactgatccattcttccatctcagacatttccgtatagccgatacgcgtcttgacgctgacaggcaaaccgccagctttagctgcttcaatcaattgtgccgctacttctggacgaaggatcaagccactgccttttccacgttctgctacattagggactgggcagcccatgttgatatcgattccttggaagcccatttctgccatagcaatgctcatttctctaaaaaattctggcttgtctccccaaatatgggcaaccatcggctgttcatcttctgtaaatgttaatcttcctcgtacactgtcttttccatctggatgacagaaactgtctgagtttgtaaactcagtaaagaagacatccggtgctgctgcatgctttacgacatggcgaaatacaacatctgttacatcttccattggtgctaaaacaaaaaaaggctttggcagctctttccaaaaattagtagtcatttatttgttactctccattctatcaagcagtgaagtcgcaatctttctcaaaaacattgtcattatactaggaaacaaaaaaagaagcaaagtgaacagcttaaaagatgtttctgattgagcaaaaaaaagactgtgacaaaaatcttatcacagtccattttccggaataaatggtgttcaaaagcttgcatttgcggtaataagtccaaccaaacgaaaaataggaggagctatttttgtttggctgttcttattacttgatgcagaacagctttttcacaacctctccactaaacggtgttcaatcagctgaccctcggtattcgctcaaaaaacaacaaaatatgaggaactattttcccgtttgtttctctaatactcaggtcaaaacgctgatttcacaacctcttttctaacttctcaatcctcttcctttattgatcaaataccaagtaacggcgtacaaaacaacgatgaataacacaagtacgatcatcgatgttgctactggcacatcgatcgttccaaggaatccgtaacggaaaccggagatcatataaacgatcggattgacttttgaaacagcttgccaaaagggcggtaacatagagatggcatagaaaacgccacctagataagttaacggctgcaagacaaatgtaggcacgatcgatacatcatcataagactgagcaaaaatcccgttgagcagtcctgctaatgaaaacaagattgccgtcatcaataatgtaatgatgaccatgaaccatgaatacacatgaagtggtacaaagaacaaggaaatgatcgttacgagagagccgacgagaatactgcgacccacaccaccaatcacaaagccccaaataatcacatgcgtaggaacaggtgctaccaagatttcttcgatatttttctgaaatttttgagagaagaaggacgaagaaacattggcatacgaactagtgatagcagacatcataatcaaaccaggaacgatgaattccatatatgaaaaaccacccatgtcaccgatccgcccaccgatcatttttccgaaaataacaaaatacaaggatgtcgtgatcactggcggaaccagtgtttggacccatatacgcaaatagcggttcgtttccttgatagctaaactttttaatgcagtaaaataaagattaaacatttttctcctccgtatgattattttcttctgtgattttcaagaacagttcttctaaacgattcgacttattcctcatagaaagaactttgattccttgtcttgtaagctgatcgaagattccgttcaccccttgatttcgttcaacttcgacagcgattgtctgctcatcttcaaatgtacaagcatatccttcaatcacaggtttggtatcatatggcgctaaatcaaagataaatgtttcaaattgcagttttgacagaagctctttcatacttgtattctcgatcagttcacccgattggatgattccgatgttgcgacaaagcatttcagcttcttctagataatgcgtcgtcaaaatgatcgttgtaccattttcgttcaattctcgtagaaactcccacatctcgcgtctcaactcgatgtcaactcctgctgttggttcatccaagatcagcaaacgtggttcatgcatcaatgccctagcaatcatcagtcttcgcttcattcccccggaaagcatacgtgcacggacatttctcttttcccaaagattggactgcttcaaatatttttcgctgcgtttcatcgcttctttgcgagagacaccgtagtagcctgcttgattcacgacgatttgctggaccgtttcaaaagggttaaaattgaactcttgtggaaccaatccaatctgttgctttgctcgaactagatccttgtccagatcataaccgaagacattcacttttccagatgttttattgactaaagaagtaataatcccgatcgttgtagacttcccagctccatttggccctaatagcgcatagaaatctccttctttcaccgaaagatcgattccccgcaatgcttcgaccccacttccatagatctttttcaaattatttatttcaagcgcatttgccatttatttcctatctccttatagacatgattcttaattgtatcatggaatacagcagatgaaaaaacaacttggcttccacacaaaaacacacctgctaacaaagaggagatgtgttttctagttcatgatcatcttcgatagaataactatctaaacaactctggaacttttaaaatcataaaagtaccgacagcaactactacgatgacatatagaagatccttataactgaggttcttgtcttttttattcatgttaagctttcctccgtccttttatcgaaagcttttttcttttattttaaccgaaataaataaaatggaaatagttattttcaatttctgttttcgctgtttgttttacggagaactttgccatggaacgtgcgtctcgtcgctgatgctaagttttttcgataaaagctgctagaaggaagacagcgtggtttattttgtatcgtcttttgctaaatcttccaagatcatctggacagcagactcgttcccattgaattctgccacttttttggcatcaatgtacttcttttgataatcgtctttttggacccacgcatcatgcttcgtttgataaagttaatcaaacggataccactgacgctgttcatcgaacaacaaactttctttttgggcctgttcaactatggatttaggataattcaaaactttcagcaaggcaatcgcatttcgggtccttgaaggtccttcttttaatttgaaatcaaaactgattccttttccttctgttacttgttcttcaaagtggacattctcacaataattctttaaaatctctgtcaattcgatatcatgtgtggcgacaaatgctaaagatggatactccgcaagccaccgaacgactgaagcggaagaagcaatccgttcgatcgtatttgttccttttaaaatctcatctacgaagcagtagcagcgttctttggaagccacttggtccagcaaacgtttgatcgatttgatttctgaaacaaaataactgtcgccttcaaataaatcatcttcgattgccatggaagtcaacacatgtccaggttgcagggtaaactgttctgcaatcgctgtttggatcgtctgtgctagaatacagctgatggctatacttttgacatacgtagattttcctgatgcattggaacccgtgactaatgtattcttctgccagttgactggattaactaccgcttcttttaacaatggatgatagatatctttcgctgtcacaccgccctcagtaaactctggtcggcaagtgatcggcatataggtgcgataattcaaaacggctgctgcaacttccaattctcccagcaattcccacagcttgatggcttcagttgaatgcttttctaatttagtgagaacgaaatgataggagataaatggcagcatgaacatgatgttgacatattcaaaaatcaattctgcttcactcccgctcttcattcgaaatgaaaaacctaatttagggatgtctcttaatggtttagtttgctgtttcagctctttttgaagtggtgtcgtcatttttgctaactgattggcggctgaaatcgttgaaaccaaataactcatgctattcagctctgtttctagtgtttgtttcttcactagataatagaccgtattgaatactaagccaccgattgctagatagattcctagtacttgccctaaaagaagcaaacctacacccaccagcggaagcaagccaagaaaaataaataaacctacgcgtccaatctttttactttttccatccgctagatattgttttgcaaaattatgatctttttttcctaaacgagcgaattgatattggattctttctctcagttgaggattttcctgataaaaagcaattagtttttctaactgataatcttctccaaaatcaaagctacgtaaacgctgatacaacgcttctgaacctacactagaataggtactgttgatcccttcaaatacttcgaacatatccaagtcataccaagtaagatcgtcgatttcactatcccatgaacggaattttttctccgtgagccacgcatccttcaaactttcttctttatcaaatctcggttgataaggaatttttccccaattactacgaactgtttcctttactttcaaacgtgaaaaaatgtctaaaacaactaataaaataacaactgcaataataattaaaacgataaattctctttggcccatatccctctccgttccttgatttgttagttttagtatagcactgttgcgctatttgaaaagggggtacaaaaataactgtcttcgttacctaattcgtatcaatcacaccaaaataaaaacaccttccaaaaaagaagatgtctttaaaacgagatacaattttttgtcattcacttcaggtaaattagagccaattaaaccctccgcaacttgacggagatggagaagatgcccccgtctaatctagcggtcatctctcctcccattccttccaccaatttttttgacaggtaaagcccgattccgctagattccgtatttgtgcggctggtattttcggtataaaaacgctggaagactttttcaacagaggtttgcgctcctggtttgataggattggccactgttaatcgaatgaatgaatcctcttttgaaaatgtcacctttgcttgtccatctgcataacgcaataaattctgtatgatattttgcagcactcgcagcaacatgagcggatctgctaatacagttgtatttatcgagtgttcagcgaacgctacctcgatatttttctcagaaaattgttcataaaaagagaaaaatacttcttccacctctttagaaaaagaaagcgtatggagatccatttctttttgcttcgtctctattcgagcaagatcataaaactgatccgtcatactgagtaatcttgcaacagattgtttgatgatcgttaaatacttctcccgtttctccgtatcctctacctgttccagtaattgtacataaccgttaatagcagtcaaaggagttctgagatcatgagaaaggccgacgatcgatagtctgatgttttcttccatttcttgaaatgcttgtcctttttgttcattttcatccacccatgtattcagtgcatctactaggtccattagattcttttctcgaaattcgactgaaagacgaccaccatattcttgtcgttcagaaagagtggcgattttcttagttaatctcttgatttccctttgcaggaagaaaataaaacttcccataaagataacaacgagaagcaacagccacttaatcaaatctaaaccccactccccacaccgtatgaatatacacagcatgtgcctttgctagtttccctcgaagattggaaatatgcatattcactgttttctcactatcaaaatatggttcttgccaaactgtttcataaagatttgctcgcgaaaatacttttttcggatgttctaaaaaaagcttcagcagatcgaattctcttcctgtcaaatggacagccacaccattcacatttacatccctcgactctttgtccagtaagatttccttgtaatagatgcgttgcgacagatcttttacttggacagaagtctgatgacgaagttggatgccgattcgtaacaacagttcttcgatatcaaatggtttcgtcacatagtcatccgctcctgctgccaacaaggaaactttatctctttgatcgctttttgctgaaagaacgatgatcggaacattcgatgtctgtcggatttctgctaacaatgcttcacctgaaagccctggaagcatgagatctagaaggatcaaatcgacaggatatgtgcttaacaataattttccttccgtacctgaataagcatcaagaagtttgtatctctgttcaagaacctcctccagtaaagaatgaacagcttcatcgtcttcgataatcaaaatagtttccagcaggaacacctacttaatgtcagatttttggaaaataaacattcctagagctgatgataccacgattgttactagactgaccagaatcattttcggtgcttgcgaataagttgcttgttgcgcaaagtccgtatacatgagccacgtttccgtaaaccactccgttagaaattccaagcctttgatttttgcgaaaacaccgggaacgaaggccgttcccatgatataaagaaaagaaagaagcaaactgacactggtacttctagtgatgaatgtcaaagccactggaacagataatgtcgctaatatcagcagaagcaatacaggaaatacttttagaacataatttccatagtttttgattccctcaacttcaccaaatccgaaagcaagtgtgtaagcaatcatggctagccccgtaatcaaaaccacgccaagtgttgtgatcaaaagcgtaacgagaagtttcgacacataataagtcattcgattccgtcctaaagataacgtattgcgaatcgtaccgttttgaaattcttccccaatataaaagcacgcaaatgctgcgaaagccagaagaatccatgcagccattttttccaccattaaaatccctgttgcaccgttgatgactgtatccgttgcttggtttaattcattgccgtattttgtatgcatataccattcgttccaagaataaaaaagcggaagtacgaccatcagtcctagtgagacccacattttacggctcttccatacttttattttttcagcagttaatagattaaacatgtggattgcctccagttaattgtaagaaataatcttccagtttttgcccaactaggtggataccatccacaggaacttttgcctctaccaatgcttgattgatggctgctacttggtcaattccttcaaaaagctggataacacggctagattggacaaaataatccctataaccaagagagtcgagaaccgttactgcttgttccgtcgccgaagtgtcaatttttataaattgacgagattcttgtgccaattcttctttcgataattctttgatcaagtgtccttcatgcaaaataccgtagtgagtggcgatctgtgacaattcatctagcaagtggctagaaagcaagacggtgatgccccgttcttttaccaaacgttggatgatttctcgcatttctgccatccctgctggatccatcccattcgtcggttcatccaaaatcaaaaattctggattcgtgatcagtgcatttgcaatagctaaacgctggcgcatacctaaagagaaattctttgctttctttttccctgtattttccaatcgcatcattttcagcaggtcttcgatttctctatccgacacaccgccgttcgctgcttggatacgtaggttatctcttgcagttaattctggataaagagcaggggtttcaatcgattgacccatacgtcgtcttgctgcctgcaaatccgtcgttccaaataattcgatcgaaccttcatcaatcgagatcaaacccataatagttctcataaaggtagacttacccgctccattctccccaatcaaaccatagatcattccacgtttgatttcgatcgatactttatctaatgctttggcagcaccgtattttttggttataccagttgctttcaagaccgtttcatttccaaaatccatacttatccttctttcttattgataagtgaagtatagttgacgggtataaagaaagcagccagaaatgtataaagaaagtgtaaattttccaattgaatttcaagaaaaatcagactgtctcgcagacgtggttgagttgtctgccaatcaaagagcgcaccaaacagtgctaatccaagtggactggccaccatggtaatcgttgttatcgttgacatcagacgtccttgtatatgcgttggaacttctcgctgaagccagaccatataaaaagcaaaagaaaacattaatccttaaaaacggacttatgaaaaataatacatgccgtttgggatttacaattagctaccaaataagaggttatgacaaaagacttttcacaatcccttcttccgaataaacggtgttctcctgccaactcctcggtcacaagtcacaatatttatcaaacatgagaagcaatttttgtaaattccttcttatttcttgaagctgaccacttctgtcacaacctcagaagcggataaataatattgtttgatgatactttatctttttcccgtttgtttatagatcgaatgatattatagaccaagaatcctacctattaacatagctaaaaacacaaaaaaggcactttccaaattgtggaaagtgccagaaaagttaggattaaggtaactgcgctcagcattgcttcgcccagtacgattctcgtaactcgtgaactcgaacgataatcgcaattaacgttttgagaactgtgaagctttacgggctttcttaagacctggttttttacgttcgaccatacgtgcgtcacgagtaagtaagccagcacgtttaagagctaaacggaagtcaggatcaacttctagcaatgcacgagcgataccatgacggatagctcctgattgtccagcgtatcctccgccgtttacgttaacaaatacgtcatatgcgccttttgtttcagtaacagcgaaaggttgattgattacttcacgcaagtcagcatgtggaatgtattcttcaacatcttttttatttacagtaattttgccagttcctggtactagacgtacgcgagcaactgcgtttttacgacggcctgtgccgatatattgaacttgtgccaatgaaattccctcctattagattaagtttgtgatgtctaaaacttctggttgttgtgctgcatgtggatgttctgctccaccgtatacgttcaattttgtaaattgtttgcggcctaaagtgtttttaggaagcataccttttacagaagtttcgatcaaacgacgagaatttttagcacgcaattcgccagcagtgattgatttcaatcctcctgggtagttgctgtgacggtaataaattttgtcagtcgcttttttacctgttaatttcactttgtctgcattgatgacgatgacgaaatcgccagtatccaaatgaggtgtgaaagttggtttatttttaccacgtagtacagatgcaacaactgttgaaagacgtcccaatggaacatcagttgcgtctactacataccatttacgttctacttcgcctggtttggccatatatgttgtacgcacgttattttcctccaatttaagttctgatgtttgacatacacttcgagtttccggggctctttgtggggcaaacataccatttaacatattacccgctaatctagtcaatgtcaacgtttttctgcttgattgaaaaatttatatgaaactttacttcttttctttcttttatataaaagggtcgtttcctgtcaaaatgaaaaacaaaaagaggctgtgacaaaagtcttgtcacaaccccttattttgaataaacggtgttctcctgccaactcctcggtcacaagtcacaatatccataaaacataagaagctgttttttaaaattgtttcttgtgactcggagctgaacggcaggcttacaacctcttggtaaacggtgttcaatcagctgaccctcggtattagctcaaaaaacggcaaaatatgaggaactattttgacgtttgtttctctaatactcaggtcaaaacgctgatttcacaacctctttttcggtcaagttcaacaacagtttttacgcgtcgatctctggcgctttgcccaaatgagcttggatcatccagatacgtttttctgtggctgttttgaattcgataaagatatcttgtgttggatcgtcgccttcttctccagaaacttcgattcctttttggtaaagatctgctagataacgatagcctgcaacaagtgtttccaaacgttctggaatagtacgatcccagcggccaatttcatcagggatttttgtgttatctgcaaattcacgcaatgtagaataaggtgaaccgtctaatgtgatcaagcgttcggatacttcatctaactgagcgttcaaatcatccatgaactcatccatcattgggtgcaatgtaaggaaacctggtcctctcatgtaccaatgtgtttggtgaacaacaacagacatttggcttagatctgcaactaattgatttaatacttctttggtttgttggaatttcatctttcttgcctcctaacattttcttacacttaaaataatagtagactttcaatgaaaagtacaacaaaatcatttacctgagaacgattttcagttcgcttttttatccgtaaagccaatcatttttcagaatcagctaattcttctcgcagttgagcaaattgctgataagtctgtgctaaatgcttttgtgtcgaaacaaataatggatagattttctgatattttttatgatcagtttcttgtactccaacttgctctttcaattctatcaattcctgtgcttcactgatactttggatctttccgatgcttctccagcctaaaatcacagctcctaatgcggatgcttctgtgacagtagggaaaacaagcgggtaacccagtacatcagccatcatctgacgaaaaatcggagattgagcaaacccgcctgtagcacggatctctgtgagctgattttcctggcaaactccttttaaaatccgataaaggttgagacagatcccttctagaatcgccttcatcatttctttttctgtatgttgccgctgtaaaccgataaaactgccaaacgcatctgcgtcccaaagcggtgctcgctcaccaagtaaatagggatgaaaaatcagaccattggcacccgctggcacaaaagcgatagccgaaagcagtgcatcatatggattttctcctttttctttagcagattgaacgacttcctgtaaaaatgtatgccctgcccaatcaaagatgccagcaccattgctagtcgctcctcccactacccaatgtttctgatccagaacataacaaaacgtctccatttctggatggaactgaggctgagtagtaataaaacgaagtgctccgctcgttcctacggtcaaagcggcgatcgtatcaccaaaagcacctaaccctagattagaaagcggcccgtctgcccctcccaaaacaaatgatatatcatttggcaaacctagttctgctgctgtttttgatggtagacctgttacttgataggtggaaggaaagacttgcggcaattgctctattcgaatgttcaagtagtcaagcacttcttctgcccattggaattcatggatatcaaaatatccagttcctgaagctgttccgtagtcgctgatcagttcgccaaacaatctataaaagatatagtctttgataccgacaaaataagcagtttttttgaataattcaggttggctgttttgcagccacttgattttgttcaatggtgtcattggatgaatcggcgtcccagtctgccgataaaattctttgccaagcacggtatatttcagtttttctgcttcgtccgctgctcggttatctgcccaagtgatcattcgagataacggtgttttctcttcatccaacaatatcaggccatgcatcgcagaggagaaggagacaaattgaatgattgtgtctgaaggcaactgtttaattacttcttttataacggtgcagacaccttgaaagatcaattcctgatcttgttctgccatcccttgtgtttcttggatcaaagggtagcgaaaataagcggatgctgcttcttgggcttcatctgtgaaagcaactgctttggtttgtgtggttccgatatctaatccgattgaaacgttcattttttcacctcaaattttatgtatgtacaaaaatttagtttaagcttgcgtatcttggttttgaaaagggggagatggcgtgttactttattttatcattggttgctgtatcggatcatttttatgtttaaccgcccagcggattccgttaggtcactctattatttatcctagatctcattgtgtcaaatgctgtcgttcgctttcttggtatgaattgattccgattctctcgatcatcgtccaacgatttcgctgccgctattgcaggtgtcggttgcccttctactatttgttggcagaagccttatgtggtggtctttttgcctggttctttactttttcttccgcaagaaatttttcgacgttcatatggatgctttcggctttgctattttcgttgatggatttattttacttcatggtccattctcacacgctattctgttcttgggcaattttatggattttttggttgcaggccggcgtcttccaatggcaaagtgtgctgttaacgtttatcgtaggcggtgtgtgccttcgctatggtcaatcctatctcggagctggcgatactctgttgatgctttcttggagtggtggcttgtctctagaagagttgcttcagatcttgtttcttgctagtctgtttggaatatccgttttttctgtttactttatctgtcataaaaaaaagttggaaaagctgcctttcattccttttttgagcagtgcgttgctgattgtccttcatcttaggtattgaaaaaaggttgtgacaaacgacttgtcacaacctctgatatatagtgttctcttaccaaatccttgtgacttggagctaggcgacaggttcacaacctctccactaaatggtgttcaatcagctgaccctcagtattagctcaaaatgctggttttacaacctctgatatacggtgttccataagtagctttttcggcttcttatttcttgacgccccaatgtcgacgaaggaaacctgcacgtccagaaccttctcgataaagattgtaatggagcttgtttttcttgtaataatcctgatggtaatcttctgcaggataaaattcgcttcttggttcgatttttgtcacgattggcttatcgaatcgcccgctgtcttgcaatgcttgttttgaacgctctgcaatatttcgttcttcttcatcattatagtagatcactggacgataagaatcaccgcgatcagcgaactgtcctaatgcgtcagtcggatcggtttgctgccaatagatttccaccaactgatcataagaaataacttctggatcatattcgatctctactgcttctgtatgccctgttgtgcctgttgttacttgttcataagttggatttggtacatgcccgccagtataaccggatgtcacagaaatgatccctggctgctcttcaaatggtttgaccatacaccaaaagcatccgcctgcgaaaactgctttttttgtcatataaaatcccccttttttctcatcataccttgatttccaaaaggaggataacgttttgcttgtgacagaaaaaacggaaactattatatacgtgatacggcttctgataaatgccaaaacgaacgtacttgatcaaaaacggttaaatcaggaatcacatattcagcagaaggaagatttatgttttcacctattcccaatacatgcatgttaccagccaaagctgcttgacaaccagcttctgaatcttcaatgaccaagcatgcatttggcggtacattcaattgctgtgctcctttgagaaaaacttctggatcaggttttgcttttgatacttgcgtgccgtcaataaggacatcaaaataacttgtcaaattcgttttttctaaaatgaggcgtgcatttttgcttgctgatcccaatccgatcttgatgtttgtttttttcaagtactcaagaacagctattgcaccaggcaaaacggatgtttcatccattttttgaatcgcttgaagatatagattgtttttttgctcagcaaaggctgatttctctttttctgagaatttctgttccatttttccaaatgacagcaatcgctctagtgactcggttctggatattcctttcagttgctcgttttctttctcagtgaatggaatggacagctggttagctaaaaccagccacgcttcgtaatgataacgagctgtgtctacaagaacgccatctaaatcgaatagtgctgctttgattttcatcgattacctccttgaaaatgaacgacttgaagtaaagatgcgatgtttttagctgtgcgatgaagattatcagtggcttgctgtaaagcttcttgtaaaggcacagctgcaggaaggatcggaaaaacggccgaaatgccaacatctgctgctttttcgcttcctttaccaacacttccgcaaatagctatcacaggaacgccctctggtactcttctagcaatcccaactggcgcttttccttttagactttgtccatctagacgtccttcgcctacgattacgaggtctgcttgctgtacccgtttatcgaactccagtaaatccaatacgtagtcgatgccagagactattttccctgaagcaaatgctaacagtcctgcacccattccaccaccagcactactgcccgatgcctcgattacttgaggggcaaatctcatataaaaatcatgcatggcttggtcagccactgctaattcattttctttcaagcctttttgtggtccgaaaacaaaagaagcgccttcttttccgcataaaagattagtaacatcagtaatgacagtgattttggctttaatcagctcaataggcacgttcgttttatcaactgtagcaattttacctagattttctcccagtgcttctactttttgattatcttgatcgtaaaaagcataacctagaccttctgccatgccgatgccgccatcgttggtactacttccgccaacgccgatgatgatgtgtcgaacaccttgttgcaacaattgtcgtatcagttctcctactcctcgcgtggataacctaagtggctgttgttggtttagtgggacatctttcaatccgacgatttctgccatttcaaaaatcgcagtttgaccgtctgaagcgtactggatttctttgtttttgccaaatgcattagtaacgactgctgtttgccgcttcaaccttaaactgtctgctaatgatgaaaccgttccttctcctccatcgcctataggtagcagatcatattcagcctgaacaaaaacttcttgaaaacctgattgaatggcttgtgctgcctctaaggctgtcagactttctttgaaagaatctggcgcaatcagaatacgcattattttcccctccgttccaagatcagttctttttccagctggtattggtctccattgacaaaaataggtaatgtttctttcgtctctttttttattactatttgtttttttgtcaaaacaaatagcaacctgtgatttttccaaataaaaggaaaagaaattttttcccatgctgaaggaagtcttggagaaatagaaagagttccattcgttactgtaatacctgaaaaaccaaatataactgctagccatagtgctcctaatgaagcagcatgaattccgtcatctgatgaatgcggatctggtcctaaatcaatcaggcacgcttcttggaataaatgatacgcccattccatttcttggatacggcaagcctctatggcgtgaatcgctttactcaacgatgagtcgtggattgttttgttttcatagtaatgcaaattcttagaaacgattggttgagaaaaatactcaggtaataagtataacagcatgacaagatctgcttgcttgctgacttggagttcatttacttcgctacgggcataatcaagtaaaatagactggctgccaggacgttctttgtaagtggtcaaatcaataactggcttactgagatacgtgtcatcttgcggaatcagctgttctttgttaggcactggcaaatataacttatctaaaaaattttgacattctttcaaaaaaagcggatcgccagcttgatatttaacagctaaggccacattataatgcgccagatagttcgtatatgcattattgtcgatatattctgtgtattcatctggaccaatgactctgtgtatctctaaatgatcatcgacttttacagctctgctcagccaaaaagctgctgtttcatgaatgagcgtttttccctttgtttctaaaaacgattgatcctctgttgcttggacatactcttgaacggcataagcaaggtctgcactgatatgatgttctgcggcagctgaagcaacttcttgtcttgttccggttttgatattcaatgcagcaaatttgggtgtctcttcctgaccagtgtgtgcgctttcccatgggaaaagtgcaccttgatagtgataatctcttgctttttgccgtgcgccttctaatcgatcataacggtacagcagcaaattctttgctacttcaggaaactgatataaaaagaaaggcaggataaaaatttccgtatcccagaaaacatgccctttataaccttcgccagttagtcccttcgcccctacactaacacttggatcattgcggggagtcataatctgtaaatggtaagcagcgaagtccatcgctaactgatcgaaagaagaatcgccttggatcgttatccgatgctgatgccaaaaatctgtccaataagacatcgactgctctaaaatttctgtataactaacgcttttctgggcttgggcaatacttttcttaaacgggtctgtttgctgaagagaggtagagagcacgatgatcttctccagcgtaaaggacgtattttttctgatcttttctgaaaaggaagcggtgatccggcgattttttgcttggaatacacctgctttattgaatttagctgcaatcccaatatcaattttactttctgttgtctggtaggatgcactgatcaaatcgtcaccaaatactcgcagttctttttcaaccaactgctgtgtaccaaaattggtttgctgtccatcgatacccgttttcacatctacttggcagtcttcggtcaacggcttgatgaccactttcagggctgcctgatggagattattttgatcagcaacacgacaagtaatgacttccactttttttccttgagcagtttcaatgagcgcatagcgtttaagctctcccatttctaaatctagtgcccgctcgtatgcaagaactttcatcgtctcaagagaaaaatgttcaccgtcgatttttatttcccatctgatgacatctgggagattcactaactcggctgattctgctcctaaaggtcggttatatacaccagctgcaaacattccccttacttgattccgatagtcttcctcctggcttcctctgataccaaaaaatccatttccaatggtcatctgactcgcatacttattgatatactctaaatcaaactgtttttcttctactttcataaggtaataacttctcctgtttctgccgaacgatataaattttccaccagattctggatgacatatccttgccagccatctgcaatcatctgagtctggtcaccgagcgcccgattcacaaaatgagccatacttagttcatgtgggtcattaactggcgtggtcttttgtaaggaaaccagctttccatctacatcttcgaatagttcgcctggatacagattagcacctgcctgatcgccacaaaaagccacattcagtttgtcttctctgatattcaaagcaaacgaagtattcagttggatgatcttgccgttttctaattccagtgtgccaaaaattgcatcttctactgtgaatttgcttggatcccatttcccgaatttccctgaattttttttcgtaccaattttttggaagctgtacgcccgaacgctttttactttaggaaatccagtaatatacatcgctgtatcaagcatgtgaatgccataatcgatcaaaggcccgcctccttgaagttctttgtcgataaacgttccccagcctggaacaccagaccgacgaagcgcattcgcttctacgtaataaatatccccgagaacatcaagatgattcttgatcattgttgcttcgtcagaaaaacgatgctggaatccataagccaaaatctgcccgtttttatcggctgtctctgccatctttcttgcttgatcagctgtcatagctggtggtttctcgcacatcactgaagcattagcttcgagggcagccaatacatgttcgaagtgaaagcgattgggtgtacagacactcacgatatcgggagaaatctcattcagcatttgtgtaactgatgtatacgcatgagaaaatcctgtacgtcggcaaaagtcttctgctcgctggctgactggatcaaccacagcggccaattctaagacatctgatcttttttgataataagcagcatgtactttttctgctacttgtccagcgcctatgattgctactttcttcatttatttctccctcctttgcttatttacttattgttattctttctctattctttctctaaatcatttaaatgacgcgctgtttccagacagtttttcaagtattgcaatgattcctgataaattttcacttcattttctcctcgcaaacgacattcatataccatataaccttcatactcattttgaagtagcgtttgaaaatggcgagtaaaatcaattgcgccagatcctggttggtagcgatgattatctgctaaatggatatgacccacatactctttttgcgtagtcaatgcttttgaaatatcatcttcttcaatattcatatgataaaaatcagcgatgatctgcacatgtttcaattgattagagtcaatgtaatgacgcgcatccgctaacaaattgatcatatggtcttggtatcggttcaaaggctccaaataaataaccgtacctgtttcttcggctactttatctaaataacgaagtgattcgctgactgctttatagtctccttctttgcttcggggtgaaaccatcggcggtaatcgataagtgaacattccccaagctgctgggataacgattcctttgcctccaacctcgcttagtgcacgcaaaatctcagcaatttgacgtacaccattaagacgccgttcttcgataaagtcaccgatccacccatcgtagccgttacaagctgtcactactgggatccctgtttctttgattgcctgtttgactgtgtcgatattttctattaacaacttaccgtcgatttcgtattcttcaaatccacagtctttgataaatctaaatttttctaaaatgtctcttgggaaaaatgcttgatcttgcgtaccgaatttcattgttctcctcctcggacttgaacgcccattttgatactttcttctgggtgctggtctacataacgcatgtaagcttctgcgctttctgcaaatggcacaactggatcaatgatttcttcacaatccaagtaaccgttcatcaataattcccaacatgtgtcctcgattcgtttacggttccatcttgggtaatctgggtttggttcactagatgctcgagcaaagacgatttttgcattattgaaatgtgcttcgcgaccaagattaaacccagctggaaaaggtttagcaaaggcaacataagaaatgatcccgccatagccgatccctcttaaagaagcttgtaatgcggcagcactgccactcgtttcaataactgaatctactccacgtttatctgtcaattcctttagacgaaaaccgacatctgctttcataggatctagcgtgtaatcggcaccgtatttttctgctaattctctacgctgcgctatgggatcgatcccaacgatggtagtagcacctgcttttttagctaattgaatcgcaatttgcccgatagcgcctaaaccgaagattgctacagcatcacctgctcgaacatgtgcttcccggataccacctaaagcgaattgagcaggatcgtaacatactgcatttttccattgatccaaccgatcaagtttacgtagtttataattatcaacaccgtttgtaatcagcgtttcacgaatgggtccataagtgcagactaactctcctttttgatactctgtcaccaaactgcccgtttcttcgatcgtaccgacaatcatatttcctaattgaaattcgccaaataccacaccgcgttggcttccttcttctcttggcaagaataggcgccattcttctgaaaattcttcatcgataaatggacttaatcctctaaagtcgacaatttctgttcctggttttggagtagcgaaaattactcggatacgtacttcgttcttttcgatctcacggtcttcgtaatctttgaatccggctattcttggttctaatgcaactaattttttcatcttttctttcctctttcttttctttttatccttttacgccgccttcgactaaatcacctttaataaatcgttcagataacgcatacataatgatgactggtaaagcggtcaccaatgaagcggccatcattcgtccccaaatgtagtctggtgtactgaataatgtgttcaaaccgattggtaaagtaaatttttcggaggtcgacaggaaaatcgaagcaaataaataatcattccacgaaaccataaagcaataaacgaagacagaaatgattccagaaatagccaatggtataatgatccgaataatgatctggatccggctaagaccatcgatcattgctgcttcttcaatatcagtcggaatcgtgtcaaaataactttttagcatgaatatcgcagtaggaagtgtttgaacgaccatcgtgataatcagtgctgtattggtatcatacaaacctagaccggaaatgattttaaataatggaacaacgatcaaaataccggaaaacatataaacggtgtaaaagctagcattgattttcgagcgagctttgaagcgtagttttgacaaagcgtatgccccgctgatcccaatcactactgcagttacggaggctatcaaggagatcactaaactatttttgaaatacatgatgaatggaaaaatctcagcattgaaaatatcctgataatgttcaaaagtccattctttcggaaaaatagtttgtgtcgttgcaattgcttcttgtgaatccttgaatgatgtcatcagcatgatcaaaaatggaaacaaattgacagctaatagcaacaaaatcgtcgcgtaaaataagattttcctgctctttttatttttcatttcaagtccaccttctttcgtgagagcaagacgaccgctgcaataatgatgaacaatagaatcgatatagctgctgcttttccaagatcattgaacgcaaaggctgtctgatacaaataaacgcctaagatattgactttattcgtcagtagatagacatctgtaaacatatagaacatccagatagatcgtaaaacaatcacagttgctagtactggtttgattgccggcagtgtcacgatcttgaacttctgccaagcatttgcaccgtccatttcagctgcttcataaagcgttttgtcgactgtttgcaaaatagccaaaaatgaaataaacgcatacggatagtatctccagatagcaaacaaaacgaccataaagaagctagcaactggctggtcgaaccacagcggtgcttcgttgaaaagctgcaacctatctactaacagatcattgacgattccataactattattgaacatatatttccaagcaaaaatcaaagaaatagatggcgtaacataacttaataaaatcagtgaacgcaccgttttcctaaatctgaacttgcggttaagcaaaatagctacggctaatcctaaagctgtactgcctgctacaactaagaatgtgtaagcaactgttaaacctaaagaacgataaaattcactatcacttaaaatttcaagataattgcttaatccgataaaaacggcgtctgagttaggattcagcggcatatcgaaaaaactgatctgaatattggaaagcattggaatcagcactaaaacagctaataaaagcatgcttggtgctaaaagtcccatggctaattttaagtcagaatgtttccttggacgattcattgaaacctccccctgataatctgccaatagctatctacttttttcgaacaccattggcagaacttcttgttatttcgtatttttttgtgcgtcagctaaagcttgatcgacatcttcgtttccgacagttacttggttcactgcttttccgatcacacctgagcttgtgatatctcccattttcgtgaaattcttttccccgactagtccaaagacttgtacttcatcaaaagcactagcaatctcagatggcagctcgccaaaagacttgatgacttcattttctttgtaaccatccagttcgactacttgtttattcactggttgagcaccaccaggagacatcaagacccacttttccatgtttttcggttgagataagaaagctgtgaatgcttcagcagcctctttttgtttctcgtctagaccagaagaaatcgtcaatccagatactgtgccatagacagcttgatctttttgtgttgggatagcaaaaccgatattttctgagttccccgcttcataaacagaaggcaaaatgtaagttgaatagattgccattggtgctgttccattcatgaaagcatctttgatttctgtcacatcattagagcctggcatcgtgtattgggataagttttgataaaacgacaatgcttctctcatcttttccgtatcgatcgttacctcgccttcatcatccaaaacatttgctccatttgacaaagcaaattgagagaacgcttgctcactcattgttccttcagcagtaggcatagcaattccatattgtttattctctttatctgtgaaatgttgagcaatttttaaaatatcatcccaattttctggttctgaaaaaccagcttctgataatttttctttgtcataccaaataccttgaacccagccgctaattggtgcagcaatatagctttttccatcttctgaacgaacaaggtttttggctccgtcataataattatcttctccagcttcctcgataacgttttggactgccgtctgatcaatcagttcatctttatccatcactttagcaaaatcctgactgacttccattacttctggtaatttaccggaacgagctaacgtaacgatttttgtattgaacgctgattcttctaccggcacttgcttgattttgatgtctggattttctttttcaaaatcagcaaccagttcattgatcacacttaatcgttcctgttcgacagaagagtgcatgaattgaatcgttgtctgttgtgattcgttagagctttgactttcaccacaagcagtaagaagaaatccagtagctagcagacaggtagtaacaataatttttttcatttttttccacctcttattttattattttcagccacatatattcatacggctggaatatcaactttcgttcttgactgcaatggataatttgtccagaaaacaggtctaggtaatctccttttggtaaaagataacctgctgattgattggaaaaattatggataactaagactttctcttccttcgcttcgcgaataaaactgataaaagaatctgctgagtccagtaagtaaatcaaactattcggatggaaggctttttctttttttcgaatagatagcatctgggtcaattcaccatatactgctgttcttaatggatctgtctgcaactctttctcaatatctgctaacaaaaatttttgccgattgatttttcgattctctcctgttttttctacgcctttgtaatcatttcgacttcccagcacactttgaatataaattgccggcacgcctggtaacgttaccaaaaatgaatgagcagctaaaaagcgtttgcttctccattccgtcgtatctgttggagaacttaacgcatctagatacgtagcgtttatctcatatggactggtcgttccatctgggtttttcttgtagtttactcgggcaccctctttcttcagctgttccactaattcaaggatcgttttttccggcagaatacctcgtaccggattcaatccgataccgtcatgggaggctaaaaaattaaaaaaagttgtttttttcgatgcgaaatcgatggtttttaaccattctttcaacttacttgtattacccgaacgaatcgcttgaagggtcaaaggtggtagcgaaaactgatagaccatctgtgcttcattctcgccattcccaaaataactgatattatctttgtgtggcacatttgtctcagtgatcaataccgttcctggagctgcttcatcagcgattgcacggaataattggatgattttatgcgtttctggcaggtgtatacaagaagttcctagttctttccataaaaatcccacagcgtccaagcgaataaatgaagcgcctttttctaagtaaaacaaaagaatatcgatcattttcaataaaacttctggatttttaaaattcaagtctacttgatcttcgctaaaagtcgtccatacgtgtttttctttcccgtttttgtcaatgaacgttgtaagtaacgggctggtccttggtctagtcacgctgcttgtatctgtatccagtggcaaatcaataaaaaaatctttgtacgtatcattcaagtttaaatattcctgaaaccaagtactttcggcagacatatgattgcagacaaagtcgaacattaaccgtgtttcgcttctcatttcttctatatcttcccatgtgcccaaacggtcgttgattgcctgataatttacaacggagaaaccatcatcagatgtatatgggaaaaatggcaagaaatgtacaactctaaatgtatctgccaaatacttttgataaaatttcttaaatgtacgcaaagttggttgctgctcttcaaaaaattgatccccataagtaatcaagaaaatatcttcttcgtcccaatgcagtttgcctgcctggcctttcttctgctgataaacactgactttttgttcaatcatagaggcggttttctcagacaaatctgagtcgcgataaatcgcttgtaaaagttttgtatacatcggattcccctttcttttttgggagcgttcccaacgatttgatcatattatggaaaacgcttactgtcaatagcatttttttaaataattttgatatacacaaaaatacaaataagaaagcttatgtatcaataattaatagcttcttaaaaaaatatggtctctcatgatcatgcaagctattcctaaattttcaaaatcatagacaaaaaagaatgtctattgtactatggaattattctaaaacgctcccaaaaaggaggtgcatataaaattgaaacctactatttatgacattgcgaaaaaagctaatgtctcaaaatcaactgtctccagagtattaaataaccagccaaatatctctgataaagcaaaagcaagtgtacttcaagcaatcaaagaattgaattatgaaccgagcaaaattgcaagaggactgtcaggaaatggttttgacgcgattctagcattatctcatcgtacttctcatacgacctatggcaatccttttttttcagatgttattcaatccatttctgccgtttctgaacaaaataacttcgacttgattctacaaacggcaaaaacaccagaagaagagctagaaaaatgcgcgaaaaagatccaagaaaaaatgatccgaggaattattattttaagctctacgatggatgaaacacttctttttgaattggatcaatacaatattcctattgtggtaatcggaaaagtcggaaacgactacacgaacatctactcagtggacacggataatttccaggatagttacgatttggtggaaacactgatcaagaatggacaccgtcatatcggctgtctccatgctccgacagaagtttatgtatccaatgatcgtctcaatggttaccgtcaatgcttatttgatcaccacctagatatccgtaatgaatggattatagacggcggctttcgcttagaagatagcatggcagcaatgaatgatttaatgaagctacgagaaagaccaactgcgattttttctaccgatgcattaaaatcattgagtatttacaaagtggcagaacaatctggaaagcagatacctgatgatctttcgatcgcaggattcagtgatcccttattgtcctccctattttcgccacagttgactcggatagacattccgacaaatcagttaggaatcaaagccacagaacttttattccaactaatccaccaccaataccctgaagaaaaaagaatcattctttcaaccgagattactctcacagattcgatccaacaacaagaaatgtagaacagaattataaaagaacagaaacactgaggataagtcagttactctgttcttttttcaatcactcatccctcgttaccccctcccggtattttagcgaatttttcttattttccatctgttttagatagctgtggataactataatgtttgtgttaaactattttttccacagggaagaaaaaactatttttaaccacgttgtgtataagtttttatagttcgtttttttaaacacatttacccttatttcaatccatgttatttggggatacttatctctaaaacataaatagaataacagacatgtctactggttttgttttattcgaggaattattcaataatagctagcaaaatattaaaaataaccgctctatcttcccatcaatttattttgcattcaaaaaatgatctatctttacttttgttgattgacttctcttggaagatgatcgttccgataccttaattggatacgaaccgatgttgttaagatcctttcccacttttcttctagttagacaaattattttagacaaaccaaaaaagaggttgtgacaataatttgtcacaacctcttttttaaaatatctattttgtttgattgttcattgcgtcttctgcagccatttgcgcttcaatatctgaaatactgtagacattttcgcttgctacaccgacttcttttggttccatgtcacgataacgttgcataccagtaccagctgggatgatcttacctataataacattttctttcaaaccaagaagaggatctttcttaccgcggatcgcagcatccgtcaagacacgagttgtttcttggaatgatgcagcagataagaaactatttgtttctaatgatgcttttgtgatacctagtaagacaggtcgagaagttgcaggaacgcctcctgagactagcgtattgtagttttgatctttaaagtctgcgatgtctaataatgtacctggtaagatatctgtatcacctggatccattacacgaactttacgcagcatttgacgaaccattacttcgatatgcttgtcgccgatttctaccccttgcatacggtaaacacgttgtacttcacgaagcaagtagttttcaacagataatacatcgcgaacttgcaacaattgttttggatcgattgatccttctgtcaatggtgcaccacggtggatcatatcgccttctgctactttcatacgtgctgtataaggaacagtatacgtacgtgtatctgtttttcctttgattgttacttctttggtacgtgttgcaggatcttctgagatatcgatgacatcccctgttacttctgtgatcactgcttgccctttcggattacgtgcttcaaagatttcttggacacgaggaagaccttgagtgatatcgtctccggcaaccccacctgtatggaatgtacgcatcgtcaactgagtaccaggttcaccgattgattgagcggcgatcgtaccaactgcttctccgacttcaacgtcagagccagttgcaaggttgcgtccgtaacaatgtttgcagacaccatgttttgtattacatgtgaagacagaacggattgtcactgtttcgacacctgcatcaacgatttgttttgcgatgtcttcggaaatcaattggtttcctgcaatgatcaattcatttgtttcaggatgacgtacttctttacgggtgtaacgtcccactaaacgatcttctaatgattcgatgatttcatttccctcgcggatggcttggatttcaagacctcggtcagtaccgcaatcttcttcacggatgattacatcttgggccacgtcaaccagacgacgagtcaagtaacctgaatcggcagtcttcaaggctgtatcggtcatccctttacgagccccgtgagttgagataaacatttccaagacggatagtccttcacggaagttcgaaatgattggcaattccatgattcgaccattaggagcggccatcaaaccacgcattccggcaagctgtgtaaagttggaaatgttaccacgagctccagaatcagacatcatgaagattggatttttcgcttccaaaccttccatcagtttttgttggatgctgtcttttgcagcattccaaacagcaatgacacgttcataacgttcgtcatctgtgatcagaccacgacggaattgttttgtaatagtttcaacttgtttatgggcattttcaatgatttcttgtttttcattcagtacactgatgtcagcgatccctactgtgataccggcatgtgtcgaatgtttgtaccctaagtctttcatacggtcaagcatcttagaagtttctgttactttgaatcgtttgaagacttctgcgatgatgtttcctaagtttttcttcttgaacggtaatactaattcttgctctttgatatgtgcaggaatatcagtaccagcttcaacaaagtatttgtccggtgtttggacggtcaagttgaagtctgttggttcattcagataagggaattcaggaggcatgatctcgttgaagatgatcttaccaactgttgtgatcatcgtacgttctttttgccattcagtaaatggtttttcacctaatgagttagggttcacaccgatacgtgaatgtaaatgaacatatccgttgcgccatgcgataacggcttcgttttgatctctgaagaccattccttcgccttcgcgtccttcttcttccattgtcaagtagtagttacctagaaccatatcttgagaaggagtaacaactggtttaccatctttagggttcaagatgttttgagcagctaacatcaacatacgtgcttctgcttgtgcttcttcattcaatggaacgtggacagccatttggtctccatcgaaatcggcattataagcttcacatacaagtggatgcaaacggattgcgcgtccttgtactaaaactggttcgaatgcttggataccaagtcggtgaagcgtaggtgcccggttcagcaatactgggtgttccttgattacgtcttctaaaacatcccatacttcgtcttcttgacgttcgattttacgtttcgcatttttgatgtttgaagctagttcgcgttgaacaagctcacgcatcacgaatggtttgaataattcaatggccatttcttttggaagtccacattggtacatcttcaagaaaggtccaacaacgataacggaacgacctgagtagtcgacacgtttacctagcaagttttgacggaaacgaccttgtttccctttcaacatatgagaaagagatttcaatgggcggttacctggtccagtaactggacgtccgcgacgaccgttatcgatcaatgcatctactgcttcttgcagcatacgtttttcattttgaacgatgattccaggtgcattcaagtctaacaaacgtttcaaacggttattacggttgattacacgacggtaaagatcattcaagtcacttgttgcaaaacgtccaccttctaattgaaccattgggcgtaaatctggtggaataacagggataacgtccataaccatccagcttggttgatttcctgaagcgcggaatgcttctaaaatatccaaacggcggattgcacgtgtacgtttttgtccttgtgcagatttcaattcttctttcaattcggctgcttctgcatctagatcaacattatcaagtaattgtttaatcgcttctgcacccatagcagcttggaattcttgtccatattgttcacgtttttcgcgatattcgcgttctgtcaacaattgttttttctctaaattcgtatttcctggttcgatgactacatatgaagcaaaataaatgatttcttccaaagcgcgtgggctcatgtctaatacaagacccatacgtgaaggaatccctttaaagtaccagatatgtgaaacaggagctgctaattcaatatgtcccatgcgttcacggcgaactttcgaacgagtaacttccactccgcatcgatcacaaacgattcctttataacggatacgtttgtattttccgcaggcacattcccagtcttttgtaggaccaaaaatccgctcacagaacaacccttcgcgttcaggttttaaggtacgatagttaatcgtctcaggtttttttacttcaccgtaagaccagcttctgattttttcgggagaagccaaacctatttgcatactttcgaatttatttacatcgatcaaaaggggttccctccatttcatttaatggcaaaccgcaagacggctgatcttcgaccgccttgcagctcatagaccggattagtctaaattatcttctgcggtttcaaagttttggatgacatcgtctttttcatcttccacttgttcagcagctttcttttctaattctttggcagtttgctgttcggcaaattttgtcaaagcatcaacagtgatcaaatcgtcgtcttcatcgtccatgtcgcgaagttcgatctctgtttcttcgatatccaagacacgcatgtccagacctagtgattgcaattctttcaccaatacgcggaatgattccggtacacctggttttggaattggttcacccttgacgattgcttcgtatgttttcacacgtccgactacgtcatctgatttgtatgtcaagatttcttgtaaagtataagccgcaccgtaagcttccagtgcccatacttccatttcaccaaaacgttgtccaccaaattgagctttacctcccaatggttgttgtgtaaccaatgagtaaggtccgattgaacgtgcatgcaatttgtcatcgaccatgtgagcaagtttgatcatgtacatcacaccgacagacacacgtccatcaaatggttcacctgtacgtccgtcgtacagaacagttttcgcatcgctggccataccggcttcacgaactgtttcccatacgtcttcatcacttgcaccatcaaatactggcgttgctacgtggatacctaactgacgtgcagccatacccaagtgtaattccaatacttgcccgatgttcatacgtgaaggcacccctaaaggattcagcatgatatcgattggtgttccatcaggtaggaatggcatatcttcttccggcataatacgggatacaacccctttatttccgtgacgaccggccattttatccccttcatggattttacgtttttgaacgatataaacacgaactaacatgtttacgcctggtgacaattcatctccagcttcacgagtaaagattttcacatcgtgaacgataccgccgccgccatgtggtacacgtaatgatgtatcgcggacttcacgagctttttcgccaaagatcgcatgcaatagacgttcttctgcagataattctgttaccccttttggcgtgactttccctacaagcaaatcgccatcttggacttctgcaccaatacggatgatacccatttcgtctaaatcttttaatgcgtcttccccgacattagggatttcgcgtgtgatttcttcaggtcctaattttgtatcgcgggcttctgattcatattcttcaatatggatagaagtgtatacgtcatcttttaccaaacgacggctcatgatgatcgcatcttcatagttgtacccttcccaagtcatgaaaccaactaaaacgttttggcctagagccatttcgccttgttccatagatggtccgtctgccagagtatcccctttttcgactttctcacccaaatgaacgattggacgttggttgtagcttgttccggagtttgaacgacggaattttgttacatcgtatttatctaatgcaccgttgtcgcggcgtacgcggatttcagaagcatcaacgtattcaacgacaccgtcatgtttacataacaaagcagctcctgagtcatgcgctgatttgtattccataccagtaccaacccatggtgcttgaggattgatcaacggcactgcttgacgctgcatgttggcacccatcaaggcacggttggagtcatcgttttccaagaaaggaatacatgctgtcgcaacggcaactacttgtttaggtgatacgtccatgtagtctactttatcaatagatacttctaagttttcactttgagcacgagccataacaacgtcttgagcaaatgttccatcttcattcaatgggctgtttgcttgggctacgatgtaatggtcttcgatatcagctgtcaagtagtcgatttggtcagtaacacgacctgtttcacggtctacacgacgataaggtgtttcgataaatccgaatttatttactttcgcataactggacaaactattgatcaacccgatgtttgggccttcaggagtttcgatcggacacatacggccatagtgggagtagtgaacgtcacgaacttcataaccggcgcggtcacgagtcaatccgccaggtcctaaggctgaaagacgacgtttgtgtgtcaattcgccaagagggtttgtttgatccatgaactgtgacaactgagaagaaccaaagaattctttgatacttgccacaactggacggatattgatcaattgttgaggtgtcaatgtttcagtatcttggatcgacattctttcacgaaccacacgttccatacgtgctagcccgatacggaattggttttgtaaaagttcaccgactgaacggatacgacgatttcctaagtggtcgatatcatcgacattgccgataccttccatcaagttcaagaaatagctcattgaagcaatgatgtcggctggacgaaccgtttttacagctgcttctggatagccgtttccgatcacgtttacttcacgttcagggtctcttggtgaaaatactttgatgacttggacagtcattggatctgtgaccacaccgtcttctgatggatagtaagtcactgaatttaggccattatcaatgaaaggagctagtgtttccatgacttggtgagtcagaactgttcctttttcaacgatgatctcgcctgtttctggatcaactaatgtttcagctaatgtcagattcaatagacgtgttttcaaatctaattttttgtttactttgtaacgaccaacgtttgctaagtcgtaacgttttggatcgaagaaacgagcattcagcaagttacgtgagctgtctgctgtttttggttcgcctggacgcaaacgttcgtaaacgtctttcaaaccttcttctgttcttgagtcgcttgcgtttttatgcaagtctttttcgactgtattgcgtaatgtttcgctgtcgccgaagatttcaaagatcgtatcatcggaaccaaatcctaacgcacgaactaatacggttaaaggaatcttacgtgtacggtcgatacgtacataagagatgtcttttgcatcagtttccatttctagccaagctccacggttagggataacagtagaaccgaatccttcttttccgtttttgtcgacttttccatggaaatagacacctggtgaacggactaactgagaaacgattactcgctctgccccgttgatgatgaatgttccttgttctgtcattaatgggaaatcaccgaagaatacttcttgtgctttgatttcgccagtctcgcggtttgtcaaacgcaatgttacatgtaatggtgcagagtagtttgcatcatgcgcacgagcttctgctactgtatactttggttctttcaattcataatctacaaattccaaagatagattgccattgaagtcatcgattggcaaaatgtcttcaaacatttctctaagtccctcatctaagaaccattggtaagagtctgtttgaatttcgatcaaatttggtaattccaacacttcactgattcttgcgaaacttctacgttcgcgatgttttccgtattttactacgtgtccagccaagctcttcacccctctaaaatgtcattcaaaaagactacccgatcaattgttacaataatatttcaaatattatttttaggtaacaacagacattttttgcggcttttaggcaaaaaaaaaccaaaaatagaacattctcttgaaaccttacttcgtgagcttctacttttgtttccttatattaaagccgaaacggacaatatttcgtttctgccttttcttcatcagatagtttttgcaacttcatatactacacttattttctataaaagtcaacacttcctggcgtttcttctgctttttcgcaacattttcttaatgttttcaattttatgttttcaattatctgacaattcttaattgacagacctttttatctcggttatactttagaaaattcattttgtggaggaacttctatgcgaaccaacatcaaccaaatcgcaccaacacaactgaataacttttactttagctactttagataggtttgtattcatcatgatggatacaaacgttaaacgacagtttgtatctatgatggctaaagaactttgtattgcagcaaaaagccacgtagacaaaatgctaagtggctgagcagtgaaaatacaaagtaaaagtatcaagcattctactttttcaatttattttccgacttttcaatccatttggacattttgtctgaatggattttttgtttcccaaaattaaggaggaaaaagaaatgaaaaaaaatataatcatcggattaggcgctgccctgctactagctttaggaggttgcgcacaaaaagacaattccgcagaggcatcagatggacaaaaaacaattggcgtattgcaacttgtacaacataactcgttagatgctgcctataaaggattcaaagaaggattagcagaagaagggtataaagaaggcgataatctaacaatcgattatcaaaatgcccaaaacaatcaagacaacctgaaaagtatgagtgagaaactcgtcaaagaagatcctgatttgctacttggaatcgccactccagcagcacaatctttattaaatgaaacaaccactatcccgatgactgtcacagcggtcacagacttggaacaagcccatttagtcacatccaatgaaaaacctggcggcaatgtgactggcacgacagatatggtgccaatcgaaaaacaaatcggcttactgttaaatatcgtgccagacgccaaaacaatcggcatcatgtataacaacggtgaagcaaactctaagatccaagctgatttggcagaaaaagaattgaaaaaagcgggcgtcaaagtcaaagtactgacagcaaattccacaaatgatgtccaacaagtgacgaaaagtctagctaaagatgtagatggaatctatattcctactgataacacgttcgcaagtgcggcaagtgttgtcggtgaagtcgcaaaagaaacaaaaacacctgtcgttgctggcgcagttgatcaagtcaaagacggcggtctagcaacagtaggaatcgactacgaaagcttgggcaaacaaacagggatcatggcagcaaaaatcttagacggcaagaatccaagtgaacttcctgtcgaaacagcgaatgatttggaactgtatgtcaataaagacatggccaaagcattaggcatcaatccagacagcatcaaagaagctgaataaaacacaggaggattctcatgacaaatttgctctctcttttcttatcatctgcatcgcaaggggtcttatgggccctacttgcgattggtgtatacgtcactttccgtatcttggacattgccgacttgactgctgaaggaagctttcctttaggtgcagggatcgcggcagtaagtattacaaatggctatcatccattgacagcttgtcttctaggctttttagggggtgcggcagcagggcttgtttccggactgcttcacacaaaattgaaaattcccgcccttcttgcagggatcatcaccatgactggtttatattctgtcacatcccgtgtgatgggtgcgccgaacatctctttattgggtcagccaacgatctttcattgggtcgagtcattcggcataacaaaagacaacgctgtactgatcgtcggtctgctttttgctttgatcgttgtatgtttacttgttttgttcttacgtacagaaacaggacttgctattcgtgcaactggcgataatctggcaatgagcgaagcaaacgggatcaacacagataatatgaagatcatcggttatatgatttctaatggatgcattgctctttctggctccttgcttgcgcaaaacaacggctttgctgatttaaattctggtattggaacgatcgtaattggacttgcttctattatcatcgcagaagttttgttacgtaaccagccactatttctccgtctcttgactgtcgttttaggtgcggtcatttatcgttttattttagcgttagtcttcgaactgaatgttgaaccaagtgattcgaaacttgcttctgctttcgtgctagtgatctgtctttctttcccgcagatccagcaaaaattccatttacctcaaaaaaagaaaggcggtagtgtcaaatgaatgacgtcttaacattggaaaatctccatcatacctttgaaaaaggaacgatcaacgaaaatcatgtcctgaaaggcattaatctttccttagatcccggcgacttcgtgacgatcatcggtggaaatggggctggtaaatctactttgctgaacagcatcgccggtacattttctgtcgatcagggtcaaattttattgaatggaaaaaatatcacgaaaaaatctgttgtcgaacgttcgaaatccatcagtcgcgtattccaagatcctaaactagggacagccgttcgtttaacggtagaagaaaatcttgctcttgctatgaaacgaggaaaaaaacgcggcttcttccgtggtgtcaaaccacaagaccgaacatttttcaaagaccagctggttcggctaaatttggggttggaaaatcgtttatcctcagaaatcggtttgctgtctggaggacaacgtcaagctattacgttattgatggccacattacagcgtccagaactgatcttattagatgaacacactgcagcgcttgaccctgctacttccaaaacggtgatggaattgacagaaaagctgatcactgagcagaatctcactgcttttatggtcactcatgacatggaagacgcgatccgctatgggagtcgactgatcatgctgcatcaaggaaggatcgtcgtagatatccagcaagaggaaaaacagcagctcacagtgccccaattattagcgttgttcaaacaaaacagcggcacggcattaaaagacgatcaagtacttttatcttcataatcagaaagaggatgggacaaaaaatgaacgcccaccctcttctttttttctctttccttctttcgttttttgctttatgtatcaaccgttgtttcttcgaaaactattttgttctctccttcttcctgatagaatggatgggaaaggagcttgatgccatgacaacgaaagacaaggtacttcaattattgaaaaagacaccagattttctttccggagaaaagttggcacagcaactggaagtttcccggacaagtatttggaaagccatcaaagaattggaaaaggcaggctatcgttttgagcacgggcctacagggtatcgttacctgccctctgacgtactagatgcaaaagaaatccagcaagagctacggtcgtttattcctgatttgaaagtacaaacgatgttgacttctgaatctacgatgaaagatgccaaactggcagcagctcaaggagattctgtttcgaagttatttgttgctgatacacaagaacaagctcgtggacgttttggacggccttttttcgctgaacctggacgaggaatctacatgagtctcttgctccatccagacaaacggtttgatgaattgcctcaatatacgatcatcgcagccagtgcctgtgtgaaagccattgaatctgtaaccggtcgttctgcttcgatcaaatgggtcaatgatatctacatggatggaaaaaaagtctgtgggattttatctgaagcagtcagtgatatggaaagcggcaggatcagtcatatcatcattgggatcgggcttaatttttctgttcctcaaaatcattttccagctgatctccaagaaaaagccatctctgtctttcccgacggacaagctagtgtcacaaggaatcagctaatcagcaaaatctggcaagaattgttcacttatctttctcacccagaaaaagcgttggacttctataaagaaaaatcattcgtattgggaaaaaccgtgtcgttcaatcaaaaaggaacgacttatgtcggtcttgcaaaagaaatcggtgatcatggcgaactgatcgtccaaacaaatgaacagaagatgagtttgtcttctggcgaaatcagtctcacatctatccgtacgcaataattatcagatttcacaaaaggacacctgatctcatacagtgtccttttttctgaattctcttcaaaagactctccttattctatcagctgacagtttctctatcctctagaaaaaggtattctaaaaatatctataaagcatggtacactttctttaaatgaatcaatgcaaaaaacaagagagtcatcagtttacacgatcaaaagagatagcaggccgcttcctttttcaatcttatagatagaccatgggtaacgataaaaacaaaaaagaacttgcgacttattttgccgtaagttcttttttagctagtgccttaatctcttaatcccaacaaacgtctcgcatagatcacctgaccagagtgcatagcagcatcatcaataatagaaacgagacgcattcctcgtgtgactggtggtgtccagttctcgtcaattacttcatctagctcggaaggttccagccttcttaagtaagaaatagcaaaatcagcagctcctcgcaagtatcctagcagatcttctatttgattagcttggatctgctttgcttgttccagactatgcttccaatcttgttcgttatctgctatcgtcatcggaaaccggctttcccagtcttgactatgccaaattggagaagttcctgctaaatcagcaatctggaaatctaattctcgagcggtatgccaagccagccaagtcattgatttgatctgcggggctctatcttccactggaaaacgattggcctcctcaatagagacgccttcaaacaaacgttcaaaccgatcgtatgcccgatccacactctcgcatagcatatctaaataatccatttattttcctcctttttatttatcctacttactttttcctaattctaggatacctacttatatgttactacacacccttattttttacactttaacagtcaccatcatcaatagtttggagattgaaagaaaaagatagtgtcgaactatcaattgaacaagaagcaacaatatgaacgtttcattaatattctttaaataaacaatgatttttcaaacgaacagtttaagactaggagaaaaagagtataataggaaaatgtttgaaaggaaaggaaggggaaaaatgaaaaaaagggcaagtttactagtcctagttgctttgttgttcaatatcttttcgtatggtgtggccgtttcagcggaaacatacattcctaaagaccctgggaatatttataatgatctaactggtaactatggcttgttaggaattgctagtcaattccacgtatttgctaaaaataagacaactgtgaatgcacatacagacggaaatatagcaacacatgaacttgatgcaaaaaataattttggtacagagcttcatgaaggtttattgaaccaagaaataaattatatacaaaaaactgattctttcgctaattcttcaggcatacctacaggtagcacaagaatgaataaatttgtcgttggcagtaacgtggatgtagcacttcaagatggtcatcctacagtcaatggatccaggcttgatcacttaactccagatgatttttataaagatcgtgctgggcatgaatatattgatttcgagcaggaatttgctaaattgaatgtagcagcaaatgatcttgcaacgatcactccagctaaaacatatactgctgcagattttccagacatgaacaatcggacaatcgatttaactgatttatcagataccgggtttttattggtaaatatcgatgcagaagtgttaacgatgaatacgccacttcaaatcattaatccaaatgatcaagtagttgtatttaatgtcatcaacagttcttctgcattgaacgtacagtcaccaatcaaatacaatgatcgttcaaatcatgaaacagaagatttttcggatgcgaatatctcttggaattttggaaatgagatgactgatttgacaatcagtgctccttttcaaggaacaatccttgcgcctaatgctactatccgcattactcaaaaccaagacggaacgattataggaacaaatgtgattttagatgcagctaccaatcgttgggatcctaacgaaatatttatcagcgacaatggtacagatacgacagacacaagcgacagtacagatacatctaccacaagtgatagctcagattcatcaacttcaagcgacagtacagatactacctctaccacaagtgatagcacggatacatcagcttcaagcgacagtacagatactacctctaccacaagtgatagcacggacacatcagcttcaagtgacagtacagatactacctctaccacaagtgacagcacggacacgtcagcttcaagcgacagtacagatactacctctaccacaagtgatagcacggacacatcagcttcaagtgacagtacagatactacctctaccacaagtgatagcacggacacgtcagcttcaagcgacagtacggatacatctaccacaacaagtgatagcacggacacgtcagcttcaagtgacagtacagatactacctctaccacaagtgatagctcagattcatctaccactacaagtgatagcacggacacgtcagcttcaagtgacagtacagatacatcctctaccacaagtgatagctcagattcatcaacttcaagcgatagtacagacacgtcgtctaccacaagcgatacacgtcatgcaagtgtctccttctcaaaaacaagttcggataacaggacgaactttaacttaactaataaaacaagcaatgacaatggaaacaaatcaaaaagagcacttcctaaaactggaagtcaatcgaataattggataacactcgcaggcgttatattacttgtaatcggtttaagaatcacttttatgagttataagaaatcgaaaaggtaaaaaaatattcaagataaaaaagagcaacgtcgctaacggacgttgctctttatttttgctttttatcataaatacaagaactacaattcaatttgtcaaaaaacacgtagatttccttctgagaaatttatttacgtatcgaacctttccctattcagtctttgcgatccaaaatcagttgggtaagggaaaagagattctcttttgttcgaagagaggtggcaggtaatttctttatttccttcaaagccttttctgtgtaagaggccgctaacttcctagcttcttccacgcctcctgtatgttcaacgattttgcgtacggcgtcgacatcttcttctgtcattgccgctttcttctctaaataaggtagtagctttggtttgtttttttgcaaagagtagatcaacggtaaagaatagaccccttgacgcatgtcttctagtacaggtttgccgatttcctggctctcttttgtataatctaaaatatcatcgataatctgaaaggccatcccgatagaaagtccgatatctcctgctttttttgcgaagcgctcgcttgttccactttcaaaagcgccaacagaacaacttaattggaacagttcagctgtcttacctgaaatattttccaaatattcttttacagaaagttcataattatagcgatcatccatctgccctaattcgccattcaatactttttccatactgcgagaattcaattggagacttttcaaggaagtggagtaatcagacaatagtttaaaacagcagacaaataaatagtctcctgcatagacagaaacgacattaccaaactgactacggatattaggctgaccacgtcgcagatccgcttcatcaacgatatcatcatggatcagtgtggccgtatggagcatttcgatagaagctgccaaagcgatggctttgtctcgatcttgctctggtccaaattgtgagaacaatagctgataggcaggacgcaacagctttccgccggcatggatcgtttctttgattgcttgttcgacaggtttgtttttcaggcggacagtttcttccatccgttttagtgtttctgtcaattctttacttaaagcaggatagttttcccacattggatgtagcttcataaaaaaactccttgtgtgacgattattttttggtaaacattgggctccatttttgtttggttccctgctcataatctttttggaatcgttgaagtgtctgcacatgtcgtaaaagataattcgctgcgatcccgattgcaatccctgataaaatccctaaaactgaaaggactggcaagtacaacatgactgtccatgattgtgcaatgaaagaagccatcaaaagctgtccgacattatgcatgaaaccgccggccgcactaattccgatgatactgacacgttttggtcctaattgcttgaccaataacattccaaaataactaagcaaagcaccactcatactataaaggaatgtggaaatcgttccgcctagcaaagtagtcaggaatagtcgtagccaaagtagtaagaagctgtctcgttttttcatggtaaaaatggcaacgatcgtgattagattggctaagcctagttttgcaccaggcgcaaaagaaaaaggataagggatcatattttccaataaaccaatgatcactccttgtgcaacaagtagcgaaatataaatcattttttgtaatttactcatggtgtgtgaaggtctaataaatcagactgtcttcgtcacctccatctgttgaacggacttcgatcactaatttatgtggcaaacagacgatggtttcgccatttttcgttgcccagcctcgacgtacgcagatctggtcatcgcaatctgcttcttttatccgtactcgatcgccatctatctcgatcaagttataatctccgtgttcatctttgtaagtatatgtgttgctctcttctccagccatcaaagggaatgttttgatttctgtgccatccacacgcagtaccgcttctttttctgctgttgcggtgttttgctgaagaccaaaaatcatgactggtaaaaaagaaagaacagtcaaaagcaaaataataaaaacatcccaaggtttgagcagacttttttcagcaaattctttaaggctcatttttgttctcctttttccagattaactcacccaattttagcataaaaacaagaggttgtgacacctgtgtcttgctttgagtaataagaacgaagaatagaaaacagctttccatgttttctaattctttgggcttattaccgagaagcagcaggtggaacaccgtttataacaagaggttgtgacagaagtgggcaacttcaagaaataagaaggaatttacgaaaattacttttcaagtttttgtgaaatttcggcttatttttcgaagaagctacttctggaacaccgtttataacaagaggttgtaacagaggttgtgacacctgtgtcttgctcatggaggcttatctcgggcatcttattcctttaattttacataaaaaggaggctgtgacggtttgtctcagcccctttctattgaaatcttgcattcaaataacgttctttatctatttatttcttgccgtactgggaacttggtctaccgtaccaccaattacctagtgtacgttgtagccatggaattacccagcgatccaacccaatcgcacgtccggaaccgttcatcaatgcgaaagcaacaaaaatgaaccaaatgtttacccagtaaaacatgcctgataagcagaacgtgatcaccaatacaatcgttgtcgcactgcatagccatgtgaataatccagcaatcaatgctaatgccaaggcaatttcaaagaataccatgaatttttggaagaacattgctacatcattgtttggcatgatcacttgcatgatctttgtgaaccagtctggtgacttctcaatcacagccattggttcttcaccgtatgcataactcaaaccaaaatgtgcagcttgagtcgctgcttctccggcacttgcccctgctccgctggcagctgtggttgcatcaccagcagcagaagcaccactggcaacatctgttacattgtattcccatgtccaagggaacacactgtttccagtgaaccatgatccttcaccaaaccaagtacttggtttgaacacttcaccattcccaatgatttttttggaagcttcaacgaaccaaactaaaccatagaaaatacgaagtggcacactccataagacattgccgtaacgagaagaatgtcctcgagtcacgttgcgatcatctttgatatggaaaaactcatgcattaaatattggaacatataataaccagaacgaatatcaaagaagtatttcaaattcacgatatgtttcattacgatagctaaaaatccgcttaaatggatcttatcaaataggttagctaccccccatttggcaccaatagaaaccataaatccttgatagtttcctttaaatttatgcttttctccgcctttgatcgaagccacgatattcgctgcggctgtgtgtcctgtttgttcagcagcttgaacgatctgcggtgtcggtgttcctgggaattcttcataaaagactaaatcaccaatgatatagatgtttttatcttcgtagccttttgcctgcatatattcattggcgatcaaccgctgtccgcgtgctgattctaatccaaagtcagcagcgtcagaagttcctttgacaccagctgtccaaatcagtgtgtgagtcggaatgttgcgtccgtctttcaatttgatatgatcagcagccacttctacgattggtgcattcaataataattccacgttgtgcttacgcaaatagcgttcagcttttgcagcatcatttcgatccaacatattcaagatcgtcggcattgcctctacgaccatcagtgtgatttcgtttggatctaatttataatctttggctaggcgatttttccagtcgatcagttccccaatcatttcaataccggtaaatccagaaccacagacaacgaaagtcagcatggctttacgcagttcatcatctggttccaatgcagcttttgctactgtcttctcaatatgttcccgaatccttacagaatcttcaaatgaccaaagggtgaatccgtgtgctttgacaccaggtgtaccaaagtcattcggctctccgcccattccaaggatcagctgatcaaaaggataggaacctaatttggtcttgacgatttttcgttctttatcgataccgattacagtgtctgtgacaagttgtacattcttttgacgagcaaacaaatgctgcagatcgtattggattgcttctggttctacacgtccgccagctacttcatgcaactcggtcatcatagtatggtacgaatgacgatcgatcagagtaattgctacatcttcttttttcagtttctttgccaagtattttgtagctgaaacaccggcatatcctgctcctacaacgacaatattttgctttgccattgatcatccgctccttatagactatctatataatgaatatatgataattcttttagtttgatacttattacacaatctccatatattatatagatgttctgttcttttgtctaactccttttggatttttttcaaattttaaaataaagcgttttttcacgaaatttgctgaaagaaaacgtttgaaatattacatgggttatttatcaaaaatagttgacttataggctaaaaagattagaatgtataatgaatcacaaagaaaaattgtggactagaaatggaatggtggggtattaaaatgaagaaaaaacgttttgtaactggatttgccgtattagcattttcagctctagtgttaggcgcttgcggcgcagatgacaacggaagctcaaactcttcttctgaatcatctacagcacaatcttcgactgcaaaaagcacaacagaatcatctgcaaaagttgtagctggcggagatttgcaagacggcacatataaattagaagaaaaaaattattcaaatggttaccgtgcagtctttgaaatggttgtaaaagacggcaaaatcactgaatcaaaatatgataacgtcaatgaaaacggcgaatcaaaaacaaaagatgcagaatacaacaaaaacatggaagcaaaatctggcacaaacccagaaaaatacattcctgagttgaatgaccaattcttaaaagcacaaagcgcaagcggtgtggaagtcgtaactggagctactcactcatctgaaagcttccaaaactacgcacaacaattgatccaagctgctcaagctggtaacacagatacaatcgaaatcgacaatggtgctgatttgaaagacggcacttacaagcttgaagaaaagaactactctaacggctaccgtgtgcaattcgaaatgacagttgctggcggcaaagtaactgaatcaaactttgattatatcgacaaagacggtaaatcaaaacaagatgatacagaatataatgaaaatatgaaagcaaaaagcggtacagaaccaaaaacttacatccctactctgaacgacgaattcgtcaaagcaatgggcgaagaagatggctcacctgctaatgtagaagttgttacaggtgctacacacagctcacattcattcatcatgtacgcacaacaattagtgaatgcagctgaaaaaggcgacactcaaacaatcgaagtagataatatcgtaacagaaaaataatcacataatcatactaataaaagttggagggtgggacgatagccagattaggcagtcgtctcacctttcaaaatgaagagaggaaaaagatgcggaaaaaactactattttccttaatcacactgggcatctcttttatggtgctaactggctgcagcaactcagcaaataaaacaaccactgaaagttcagcagctaccaagatattgaaagatccatattctgatgaacagttcttgttagggacttacgttcgtatccgtgtgtatgatgaaggcaaagaatcaacattgaaacctgccttcgatcgagtaaaagaacttggtgataaaatcacgatcaatcaaaaaggttctgagatcgatgaagtgaatgagcaagctgggatcaaaccagtaaaagtttctgatgacgtctacacgttagtcaagcgggcctacgaatatagccaagattctcaaggcggattcgatatggcgattggtgcaatcacacaattatggcgaatcggttttgatgacgccagaaaaccttcccaagaagaaatcgatcaggcattgaaattagtggattatcataagatcgaactaaatgacaaagaaaaaactgtttatctaaaagaaaaaggaatgatcatcgatttaggtgcaatcgccaaaggttacattacggacgaagtagtgaaagtcttgaaaaaacaaggagtgaccactgccatcgttgacttgggcggtaatgtctatgtcttaggccacagcccaagaggcgaaaaccaagactggacagtcggcatccaagatccgaacatggctcgcggatctgttttaggttctattaaagaacggaacaaaacattagttacctctggaatttacgagcgttatttagaagtagatggcaaaaaataccatcatttgtttgatccaaaaacgggttatccgttcgacaatgatatcgcaagtgtcacgatcataacagataaatcaattgatggtgacgggttgtctacagcagtcttttcaatgggtgtgaaaaaaggactggaatacgtcgaaagcgaattgaataacgggacggaagcgatcttcgtgacaaaagacgataaagtatatgtgaccgatccaatcaaagacaccttcaaattatcggaggactcccattacacgatgggtgaccgttctgaactaaaataaggagtacgaaccatgacactaaaaatctttttagaagtagttgaaatacgaacaaaggtggctagtgtatttccttttgcggtaggggtattattctctatcgctttttttcatgagatacattggctaaacacttttttattttttattggaatgctagtttttgatttagcgactaccgctatcaataattacatggattatgaaaaggctcattctgaagtatataagtatgaagaaaatgtcattggccgcagaaatctatctcctgtattgattcgaaacatgattttagctatgattgcatttgtttttgttatcggcgttattctaacgatcaatacgggttggcttttacttttgatgggatttatctgttgttttattggagtattctatacattcggaccgattcctttatctcgaatgcctttaggggaaattttcagtggggtgactatgggccttggaatttttgccatggtcgtttatgtcaatacattcggttcagatgtctatgatctgacagtcaacttttcatctggacaatttgctttggtaggaaatctttgggctatagcagcaatcgtattagcttccttacccttggtgtttacgattgccaatatcatgttggctaataatttgcgggatcttgaccgtgatattgaaaatcatcgctatacactagttttttatatcggacgtcctgcgggaacagtcttattccagctattgatgtatgcttgctatttcgtgattttaatggggttgttgagcggtatctatgaatggccgatcttggtcaccttcttgaccttgccaattgtgaagaagcatttggatcaattcaagcaaacgttaccccagcctatcagtttcagctattccatcaaaaatatggtcttattcaatgccagttatgtattggggctattactaacaatcattatgcaagccatttaacagcatgaagaggttgtgaaaaaactgccctgcatcaagtaataagaacagccaaataaaaatagctccttatatttttcgtttggttgggcttattaccgcagatgcaagcttttgaacaccgtttatcaggaggttgtgaaaaagtcgcttagtttcgagtattaagaaaaattttgtgaaaatggctttccacatttttgcataaatttggcttaataccgagaaactggcttttgaacaccgtttatcagaggttgtgaaaaagtcgcttagtttcgagtattaagaaaaattttgtgaaaatggctttccacatttttgcataaatttggcttaataccgagaaactggcttttgaacaccgtttatcagaggttgtaaaatcagtgttttgtcctgagtattagagaaacaaatggaaaaatagttcctcatattttgccgttttttgagctaataccgaaggacagctgattgaacactatttgttcggaaaaagtgactaactatgacacaatttttttcacagtcccttttttcacttgatttgattcgtaccagcgaacttgacgagaactttcttggtttggtaactatatggtattcttttaacatcctcgtttgcttcttctaatttatttatacaaagtcacacttttttaaacatctgttcttcgatacatttctatttcttttaaacatcgataccaatattttgaacttaagagtgcataccaaatggattcatttactcttcgtcagttacgaagataatcaaaatctccaacttccctacttatttcgttttgagaattatcgaagcaatcttacataaataactaaaaaacaaaaaaccagaaaatcagtatactgattttctggttttacatggtttgttcaataaaaagctgttggaactgttaatattaaattatcgcatcgttacgaattcttccgctcctgttggatggatggctactgtattgtcaaagtcttctttagttgcacccatcttgatagccacggcaaaaccttgcagcatctcatcgacaccaacaccaatagcatgtaagccgacgattctttcttcttttccgacacagatcaatttcatttcgcatttttggcgataatcatttaatgcaaagtacattggggtaaagcgtgaacgataaactttcaattcattttcgccatatttttccaatgcttcttcttctgtcaaaccaattgttgcaattggtggatgcgtaaagacgactgtcggaacaagtttatagtcaagataagaatctttctttccattaaataaacgttctgataaacgtctaccagctgcgattgcaacaggagtcagatctaatttaccgatcacatcaccaacagcaaaaatatgttcatccgttgtattttggtatttatctactttgataaacccttttttgtccaattccacatttgtattttccagacctaatttttcggtattcggtacacgtccaccggcaaaaagtacacaatcaccagttaaggtttcaccattttcaaatagcaccgtatattcgtcattgtttttagtaatttctttagcaatatgatgtgcgtaagtttttattccagcttcttggtacatttggatcaaattgtccgaaagcattttatcaaacgttctaagtggtcgttcttttcgatatgcccacatgacttcactacctaaaccacgaaatacacctgaaagttcagccgcaatgtatccagcacctaaaacgattgctctcttaggtaactctgttaattcaaaaaatccatttgaatcaattgcgtattctccaccaggaatggtcattttacttgcacggcctccagtagcgatcaagattttaggagcacgataggtttcaccgtttacttcgatcgtttgactatcgataaaagtagcgtaaccttttatagcctcgacatgattgctatctaatcctctttgataagcaccgtgtagaaaatcaatatatttttctcgtctttctactagaccggcgaaatcaacattttttaaatctgcttggataccgtaacttgaggcatctcgttcaattgtttccaaaatcgtacttgcttgccacataacttttttaggtacacaaccgacgttgacacatgttccgcccaattcattcgcttcaatcagcaaaacttttgcgccatgcatccctgctctgtttgctgaagcaataccgccagagccgccaccaattacgatgtaatcatatatttgcattttgttcctccttattgaagagatcaatcaaaacctttatttaacgatcctttttctacagaaaacaagtgtaacacttttcttgaattttgtatgcgaagatgcttaaaacagggatatatcagctttttccttatttacgttttcggatcatatctccaggtttcaccggctgtgcgactggcatagttaaaatcatcattggatttggtgctcggtcaatggattcgccttcttcattatgcataacttcaacggtttgactgaaatgactgaatcctggaccataaaattcgatttcatctcctacagaaaacaagtttctctgacgtatcgtagcaatctgtgttgcctcatcataagataatacttcaccgacaaatttatatactgggattttacgacgttcaccgaataattgttcgttttcagttggtgtattgtagtaaaaacctgtagctaattctcgttgtgctactttccataactcgtcgatccattcttgcttgcagacatagttttcaggatcttccatataactgtctacagccgctttatagacatttgacaccgtagatacataatggatcgatttcattcttccttcgatcttgaagctgtctacgccgttttcaatcaattctggaatatgttcgatcattgacatatccactgcactcatcgagaattcttcttccacttcgcctgtatcagttaaactgtttcgttcttgaccaaaaggcatatcgaacaatccatacttccagcgacaagattgagaacatccgccacggtttgcatcccgcatcgacatatggttggacaatgtgcatcgaccagaataagagatacacatggcaccatggataaatgcttcgatttcggtatccgtatttttacgaatctctgccacttcctccattgaaacttcacgagctaaaacgacacgttccaacccttcttctttccagaattccaatgtctcaaaattagttgctgaagcttgagtggataaatggatcggcagacctggggcttctgtcgcacaaatttcgatcaaagctggatcagaaacaatcactgcagaaataccgacatcacgcaaactgcggaaaaattcccctgctccatcttcatttccttcatgggtgaccatattagcagcaacgtataccttcgcatcatgttcttttgcaaaagcaactccttcagccatttcttcataagtaaaattacctgcacggcttcttaaaccatatgcattcccgccaatatatactgcatctgctccataatggatcgcggtttttaacttttccagtgttcctgctggcgctaggatttctggtcgtttcaattttctttttactgtcatttctttcatcatactccttatttgatagcagaaggatcaatataaaagaatcctgtatctaattcacggttttcaggatgcaatttactgatttcgctagtcattttttccgctttttcttgatcccagctaccttctaaaatttgtttttttgcttcggcgaatagtcgagtgatgtttacgaatttttcgcctggagtaaataatccgtccaatttccatgtacagtaatgatgctgataaagttcattcaattcattcgagagattcagatcattgctggcaaaaatatgtgtgccatgactatcttcataaatagaataatgtgtctcttcttttttaggttccgagataaaaagacctctttcacgatctttttgttcgtcttgtttcgtatagttatagtaattctgtagcagtggacgtttggattgatggatgcatgtagcaccatacacaagggtttctacaggaatatcgagtttttcttccatcgccttcatctcttcaaaaggaacttcacgagcaagtactgctccaactgcgccttttttcgcccagaaattgatttgacgtgcgctcgttactaatgtttcagcatcataaatatacggtatacgcaattcaggattttttttcatcgtataaataatacctgtatcaccaactgtgatcacatctacgtttatttcttttaaaaaagccaaatattcaggtacatttttcattttttcaggatgaatgatcccatttacagcaatattcgcttttttaccatacttgtgtgctaattctaccaattgtcgctgttcttctcgtgtaaatgaagcaggcagacgcaatccaaattgctcttcaccgaaatatagtgtatctgcacctgcagcaagcaactgttctgcttgttcaatagtttctactgtggttatgagttcgatcataattttctcctcctacaacttcataatagtagcatagctctaaaaactttccaatacttcttctatttaaagtcggatttttgaaaattatttcacaaaaaatcaaaataaagttcgatatattctgtccaaatataaaaagagattgtgacaaaaatcttgtcacaacctcttaatcaagtcttactattataaaaattcagctacacaggccaagtaactatagggaacctactgtttcctttttaggtccgcgaacattcaatgtgatcttaccttttgaagcacctactgttacgtggtcacctaaacgaatttctccgccaagcaaagcctcgctcaatcgatcttcaatttctttttgaagtgcgcgacggattggacgtgcaccatattcaggatcaaatccagctttcccgatcacatcgattgcagatggtgtgattttcacttgaatatcttgttctttcaatcgtttgataatcgctttgctcatgatttggacgattgtatggatttcatctttactcaatgaatggaagacgacagtctcatcgattcgattcaagaattcaggtcggaaagctttctttaactcttctaagatacgtttttgcatggctttgtgatctttagtaacatcttggacattgaatccgacatttttttcttctcgaatttgtgtcgctccgatatttgaagtcataatcatgattgtatttctaaagtccacttttctacctttagaatctgttaaatgaccatcatccaatacttgcagaagtaaattgaaaacgtctggatgtgctttctccacttcatctaagagaatcactgaatatggtttttgacgaattttttctgtcaactgtccaccttcatcataccctacgtatcctggaggagacccgattaatcggcttgtactgtatttttccataaattctgacatatcaacacggatcagggcatcttcacttccaaacatgacttctgaaagtgctttggccaattctgtttttccgacaccagttggtccaaggaacatgaatgaaccaattggacgatcaggatctttcaatccgcttcgtgcacggcggatcgcacgtgaaactgctttgacagcctcatcttgaccaacgacacgttcatgcagaagtccttccagttctaacaagcgttcgctttcttttttctccaactgctgtagagggacaccagtccactccgatacaactgtagcaacatcttcttctgttacacgatcagaataaccttgctcctgttttgcttcaattgcagaaactttttgcagctttttacgtagtgctttttcttgtctgcgtaattgagcagcattttcaaagtcttgtttttggatcgctgcttccttttcttgtactagttcatcgatttctagtttgatcacagttgattttgttaagtgatcggtttgatccaaacggactttcgctgctgattcatcgatcaaatcaattgctttatcgggtagttgacgagaagtgatataacgaacagaaagattgactgctgctcgtacagcttcatctgtgatctccactccatggtgctcttcatatcttgtacgtaatccttgaagaatcacttctgcttcttcaggagttggctcatctacttgaatgcgagcaaaacgtcgctctaatgcagaatctttttcgatatatttttgatattcatctagggtcgttgctccgatcgtttgtaattctcctcgagctaacgccggtttcaagatattcgaagcatcaattgctccttctgctccacctgcaccaattaaggtatgcaattcatcaatgaataagattacttgaccatcattatagatttcgtcgatgacctttttcattcgatcttcaaattcaccgcgatatttcgtaccagcaaccaaagatcccatatcaagcatcatcaggcgcttttcttgcatgtcttctggcacttcacctaaaatgattttttgagctaacccttcagcaatggctgttttgcctacaccaggttcacccaccagtacagggttattctttgtccgtcggctaagaatctggataagccgtttcacttctctcgaacgaccaacaactgggtccagcttgttttcttttgctaatttcgtcaaatcacgtgctaatgaatctagcgtaggtgttccttgcggtgtttgccgtttatcttgtacatttacatttctacgacgattcattccttttccagcagaatcaccagctagccccattttttgtttcagaacttgacgggcttttgaaaggctgatacctaagttgatcatgattcgagtagccatgatactttcatcttttaataagctcatcaaaatatgttctgttccaactttttgagaaccagttttcttcacttcgctgctagctaaagcaaaaacttgtttcattcttggtgaatatggaagaaagactcctttagggtaagaacggataccaccataaccaatcagatgttcaatttcttcataaatttccgtttcattcaaatccatttcacgtaatacttttccagcaattccattttgctcgaccactaaggctagtaaaacatgttctgaactaactgattgatgtttcaaccgttttgcttcttcttgtgcaatttctaatactgcttgggctctttcagtaaaaagttcttccatctaatctcacttcccatcttcataacttaaacgttccagaaatgctcggagaatccgagcacgtgtatgatcttcatattcattgaaattcaatgtgttttttgcaattgcactcaacatcaagtttccttctttttttgtaattatttggtcttcataaagtttttgaataatagcaaaagcatttttctcactgattgtatcatcaaataactgatttatctgctcaagtaattgttttttatctgaaatccttacttttgcaattcgtatataaccaccaccaccacgtttgctttctactagataaccacgttggatggtaaaacgggtattaatcacatagttgatttgtgaaggaacacagttaaagaggtctgccatttcaatccttcgaatctcgatcatttcactattttccagaattttctttatatatgattcaattaaatccgaggtattctgatgtgccatcttattcattccctttgactaatattgaccttaattataacgaatttgataatagaaagaaagaagaacgctttttgttaaataaatcctttagaatcaacaaaaaaaaatacggaatatactattccgtatcgacgcgcccaagaggagtcgaacccctaaccttttgatccgtagtcaaacactctatccagttgagctatgggcgcatattcaatttaaaaaaattataaatcatttgaaaacaaaaagcaagataaaaaaaatcgggaagacaggattcgaacctgcgaccccttggtcccaaaccaagtgctctaccaagctgagctacttcccgtttaaaaaataaaaaagactacgcgcccaagaggagtcgaacccctaaccttttgatccgtagtcaaacactctatccagttgagctatgggcgcatatttgaaatgccgaggaccggaatcgaaccggtacggtgatcactcaccgcaggattttaagtcctgtgcgtctgccagttccgccaccccggcgcgattgctttggcaaagcggaaaacggggttcgaacccgcgacccccaccttggcaaggtggtgctctaccactgagctatttccgcgtgtttaaagatgccggctaaaggacttgaaccctcgaccctctgattacaaatcagatgctctaccaactgagctaagccggcatgtaaaacttaaattatgcgggtgaagggacttgaacccccacgccgtaaggcgctagatcctaaatctagtgcgtctgccaattccgccacacccgcaaaaatatgagccgtacagggctcgaacctgtgaccctctgattaaaagtcagatgctctaccaactgagctaacggctcatatggaggttaacgggatcgaaccgctgaccctctgcttgtaaggcagatgctctcccagctgagctaaacctccatggataacttaagcgtggcgacgtcctactctcacaaggggcaacccctcactacaatcggcgctaagaagcttaacttctgtgttcggcatggttacaggtgtatccttctcgctatcgccaccacactgtggtgttatcttttattgagtaaattttgttcactcaaaactggatttgaagtcacataagtttttttccgagttcttttcttttaacctattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgattagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctgtcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcaacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaactaccatattggagtcctacaaccccaacaagcaagcttgctggtttgggcttttcccgtttcgctcgccgctactcagggaatcgaattttctttctcttcctgcaggtacttagatgtttcagttctctgcgtctacctcgaatgtgctatgtattcacacaatcgtaacatcctattaaagatgttgggttcccccattcggaaatctctggatcatagcttacgtacagctccccaaagcatatcggtgttagtcccgtccttcatcggctcctagtgccaaggcatccaccgtgcgcccttattcacttaaccttatcaaccttacggttgggttttgatccttcttctagcgatagaagttagatcaagaaaataagcaattgaacttattaaaaaactctatccagctcacaaatcagcctgtacggcaaaaagatcgatcgtctcataaaatcaaagattttatggccgtccgcctattttgcttcaggctaaacaatttgttcagctttcaaattcaacgcggtgttctcggtttgtattacttacatttacttcaaatatccagttttcaatgaacaaaagtgtttgagagtaaacctctcaaaactgaacaaagtaaaaacaaattgtgtagtctccgtaatattccttagaaaggaggtgatccagccgcaccttccgatacggctaccttgttacgacttcaccccaatcatctatcccaccttaggcggctggctccaaaaggttacctcaccgacttcgggtgttacaaactctcgtggtgtgacgggcggtgtgtacaaggcccgggaacgtattcaccgcggcgtgctgatccgcgattactagcgattccggcttcatgcaggcgagttgcagcctgcaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtcttgctagagtgcccaactgaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcactcatcgtttacggcgtggactaccagggtatctaatcctgtttgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacagttactctcatccttgttcttctctaacaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgcatcgtggccttggtgagccgttacctcaccaactagctaatgcaccgcgggtccatccatcagcgacacccgaaagcgcctttcaaatcaaaaccatgcggtttgattgttatacggtattagcacctgtttccaagtgttatccccttctgatgggcaggttacccacgtgttactcacccgttcgccactcctcttttccggtggagcaagctccggtggaaaaagaagcgttcgacttgcatgtattaggcacgccgccagcgttcgtcctgagccaggatcaaactctcataaaaagttcgaacaatcttgcgattgttaagctcaatttgtttgctagcatattgcttgcttgttaaaaatgtttgttgtcttgaattgaatcaagacgccctacacatttggtttgtcttactttgttcagttttcaaaggtctacttcatcaggagtgcttcccgattcgtttttggctgccgtagcaacttttatatcatatcagagagacaagtaattgtcaactcttttttaaaagtttttcgatttcgtttttcgaaatcttccagcaactcatttatcataacttatcgtttgttatttgtcaagaactttttgaagtttttttcgatagaatcaagcttcgcaagtggttcttttttaacgactcagttatcttatcatgtcatttccaacatgtcaacaacttattttttattatttaataagttattggtgttcttttgaacaaataataatatatcaacatcacatgtgaaagtcaataagaaaatgcttatttatcaacatttctagcttacatgatcattggttagttctggtcctttttcgttcgtctttataactccgagagacgtaaaatccttttgttttcagtttaatgttcatgttcttgtcttattcacaccaactagatgtctcaccttctaaaattttccttaacaaagtgctgcttttatctatttctgcttttttttgctagaataatagtaacaatatgactctggaggatttatttatgaaaattttgattgctgacgatgataaagaaatcgttgaattattaagtatctatgttcacaatgaggggtatgaagcagtaaaggcttatgatgggaaagaagcattatctaaaatcagaacaatccctgatattgaattacttattttagatatcatgatgcctgagatggatgggatgcaagtagtgaaagagctacgaaaagaatcccaaataccaatcattatgctgacagcaaaaactactgatatggataagatcaaaggactggtcgctggtgcagatgattatgtgaccaagccatttaatccgttagaagtaatggctagagtaaagtctttattacggcgtacaaaaatgcagattgccccagatcagcctgatgtattagaagtaaatgcattaatcatcaataaagactctcatgaagttaaaacaatcgatgggaaagaaatccagttaacagctttggaattcggtatcctctacttgcttgctagtcatcctaatcgagtatttagcgcggatgaaatttttgagcgtgtttggaaacaagaaagtattgtctctgctaaaactgtcatggttcacgttagtcatttaagagataagattgaagaagcaactggtggtgaaaaagtcattcaaaccgtttggggagtgggctataaaattgacgcaagatagtaaacgagcaactgaaaaacgccgtcggatcaatttgacttcaaaagaaatcagcgaattgttagcggaaggaatcatcacgattatccttttgcttctattaaatgtttctattctggttgttatcagttcggtgatcaacagttcaccttctttgacgaatgcgatttgggattcaaagaatatttttgcagaacgattgaacactgatttgttctggaacggccggaattttattattccctttttctttctattagatattggtgttttgtattggcgcttgattcgaagatatcgccaaatgcaattgcggcatatcatcagcgaacttcactacatcgcaaacggaaattatgatcatcgtatcccttttgaactgagtggtgacttaagccgagtggtaacaagtatcaatggattggtggatagtaccgtagcagcgattgaagacgaacgtaaaatcgaaaaatcaaaagatgaattgatcacgaatgtcagtcatgatatccgtaccccactcacgtccatcattggatacctaggactgatagaagatggccagtatcactcagaagaagatcttttaaagtatacgcatactgcttatatcaaagcaaagcagatgaaatctttagtggacgacttatttgaatacactaaggtacgccagcctgctgtcccggtgaatttttctgcctttgacatgatccagttgatcgaacagttagcagctgattttgagttggaagcttctaaaaaaaatatccaaatacttgttcaatcaaaagtagactcccttatcatggatggcgataccgaaaaacttgtacgtgtcttcaataatcttttgacgaatgcgttgaaatacggaaaaggagcaacgaagatcgtaatcgaagtagaacgtatcggttcagaagttgttgcaacagtcaaaaataacggagcaatgatcccacaacaggcaatcgataatctattcgaccgtttttatcgtgtagaagaatctcgttcacaagcaactggaggaactggacttggtttagcaatcgctcaaagcattgtggctttgcacggcggatacatttatgcaaaatcagataagcaatggacttctttcatcatgcaccttccaatcaagaaaaatgaaaaattacctattgatacacaggaagttattgacgaaagctgaaatattcgctattcttattacaattattagaataaatgaaaaacacagaacccagtacactttattctttttcagagagctgatggcaggtgtaaatcagcaaaggataatttggaagttccagttcgtttacgtgccctttcgaaataagaaaggtcggttcaacagccgttatgtgttcaacaagtgcagctgacgctgaacttgggtggtaccgcgaatttcagactgattcgtcccaagaataatgggatggatcagtctttttttattttcaaaaaggaggaaatcatatgttagatgtaaaaatgatgcgacaaaatattgaagaagtacaagaaaaattgatgactcggggcgtaaaaaaagaaacattagctgaattcatggaactagatgaaaatcgtcgtaagctactagtcaaaagtgaagaattaaaaaaatatcgaaatgatgtttctgctgagatcgcccaattgaagcgtgcaaaagaagatgcttctgctaaaatcgctgaaatgaaagaagtcggtggcaacatcaaagcattggatactgaaattgctgaagtggatgaaaaattgaaacaaattgcaactactttgccaaaccttccccatgattctgtgccagttggaacagatgaagaggacaatgtagaaatccgtcgttggagcgaaccacgtacatttgcttttgaaccaaaaccacactgggaaattgcagaaaatcttgatattttagattttgaacgtggcgcaaaagtagccggtagccgttttgtctattacaaaggattaggtgctcgattagaacgtgctgtctacaacttcatgcttgatcagcatatttacgaacacggctatactgaaatgatcactccttatatcgtcaacagtaaagcgatgtttggtacgggacaatttccaaaattcaaagaagatgttttccaattggagaatactgatctaacattaatcccaacagctgaagtaccattaactaactattataatgatgaaattttagatggtgcagatttacctatttatttcactgcactaagccctgcttttcgttctgaagccggaagtgctggtcgggatacacgaggactgattcgtcttcaccaattcaataaagtagaaatggtcaaattttcggatgtagagcattcttacgaagaattggaaaaaatgacagctgatgcagaagatatcttgaaaaaattgcatttgccttatcgtgtgatggccttatcaactggagacatgggcttttctgcagctaaaacttatgacttagaagtatggatacctgcacaagatacttatcgtgaaatcagttcttgttctaactgtgaagatttccaagcacgccgcgcaatgatccgttatcgcgataatgatggaaaaatccactatactcatactctgaatggttcaggacttgcagttggccgtacagtagctgccattttggaaaactaccaaaatgaagatggttctgtcacagttccagaagcgctcgttccttatatggggaatctgaaagttattaaataaagaggctgtgaaaaagccgcttagtttcgagtattaagaaaaattttgtgaaaatggctttccacatttttgcataaattggacttaataccgagaaactggcttttgaacaccatttatcgagaggttgtgaaatcagcgaattaacctgagtattagagaaaaaaatggaaaaatagtccctcatattttaccgtttgttgaactaataccgagggtcagctgattgaacaccgtttagtggagaggtcgtaagcctaccccccagctcctagttacaaggacaaattcaaaaaacagctcttcatattttatgaatgttgtacttgtgattcggaggtggcaagggaacactgtttattcaaaaagaggctgggacagaagcgtttaactccaagaaataagaagaaattcacgaaaattgcttttcaaatttttgtgaatttcttcttatttccgaaggagttgcttctacttccgccgtttatacgtgtttagagcgtgagacaaaagtgttctttacttttgtcccacgctctttaatgtttttaagattcaactgaatagtttggtgcttcttttgtgatttgtacatcatgagggtgtgattcttttaatccactgccgctcatttggataaattgcgcttcatcacgtaattgctgtagattggctgccccaacataacccattcctgaacgcaaaccgccgatcatttggaaaataatatctgcaacacttcctttataagcaacccgaccttcgattccttctggtactaatttatttgcttcattgacactaccttggaagtaacggtcttttgaacctttttccatcgcgcctaatgagcccatacctcggtatgttttgaatcgacgtccttggaagatttcgaattcacctggtgattcatctgtccctgccaacatacttcctagcatcactgcatgtccgccggcagctaatgctttgacgatgtcaccagaatatttgatccctccgtctgcaataatcgctttgccatattgacgagcaactgatgctgcatcataaatagctgtgagctgaggtacacctacaccggctaccacacgtgtcgtacaaatcgatcctggtccgataccaacttttacgacatctacacctgcatcatataaagcttttgtcgcttcagccgtcgcaacgtttcctgcaatcaatgttgcatctgcaaaagttgaacggatttcttgaatttttcggatcacacctgcactatgtccatgagctgtatcgatgatgattgcatctgcccctgcttctaataaagcattcgcacgctcaaatgtatcgcttgttacaccaacggctgctgctacaagcaatcgaccatgttcatcttttgctgcatttggaaattcgatcactttctcgatgtctttgatcgtgatcaatccgcttaaacgaccttcgttatctacgattggtaatttttcgattttatgtttttgcaaaatcttttctgcatcttttagagaggtacctactggggcagtcactaagttgtcttttgtcatcacatcagcaatcggcatgtgataatctgttacaaaacgcatgtcgcggtttgtaattatccctaccaattttctgttttcaagtgtttcaacgattggcacaccactgatacgatatttgctcatcaattcttctgcgtctgctacaagatgctgtggcgttaagaagaacggatcaatgattacgccactttcagaacgtttgacttttcttacttcatccgcttgctggctgatcgtcatgtttttatggatcacacctagtccgccttgtcttgccatagcaatggccatcttgctgtcggtaacagtatccatacttgcactgatgattggaatattcaacttaatatttttagctaattgtacgctcatatccacttcgtttggtaacacgtgactttctgctggtatcaataagacatcatcaaaagtaaatccttttttcgtgaactttgtttcccagttggacatttttagtaccactcctctaatttagtttatctattaaaataattgattttttcatttaagtcaatgatctacttggaatcaagttagctttctcatagaataccaatataaagcgtttacatctgtgtgtattaaaagagattgtaaaaaagctgtcctgcatcaagtaataagaacagccaatcaaaaacagcttctcatgtttttgaattggttgggtttattaccgcagatgcaaacttttgaacaccgtttagtggagaggctgtgaaaaagctgcttagtttcgagtagtaagaaaaattttgtgaaaatggctttccacatttttgcataaattggacttaataccgagaaactggcttttgaacaccgtttatcgtaaaaagggactgtgacaagacttttgtcacagtcccttactattatttaactatggataaacaaaatgaggttctttactacccctagatatctagcaaaatagctgatctttttgctagtttatcttcttgggacggataaacttccaataatcccgtattttttcttcaagtagtaacggattgctaaagcagttgccccgataatgataactactactggatctaatactggattgataactggtgtcaatagtgttgtcgcagaaaacagtacgacccaaagaagtgtcgttccacctaggataagcaatgtcttacccattcctggtttcttgcttcgatctgctccgggatattcatattgatagatgtatttgtacatcatataaaagacccagccaccgattgcagaacctagaacgagtgtagaaaagccataagctggcgttgttccacgtgaaaacaatccggtaatcgcaatcatgatacttaatagaccaagcaacagcaacgtattatctaaccacatcaataaaggggtggatgaattttttacttctgctggcttattgatgattgcttccgttctttcagagactgtcccaaacaattgacgggctgttcttccgcctttttgttctgcaactaaagtaggcagaatgtcatgaagggcttttactttttcttcttcagacaaattcgctgcttctaaagattttttcaaatcaaaaatgtactgttgatttcttttggttaattttgtttctaaactattgttttcttttacgattgctcgtaattgttctggttccattatctaatagtcctccttagccgttccttttctcaacggtcgtcacaaaagacattctaccatattctacagctagtttgatagcccttttacacattaaagcggaataacattacgtcgccgtcttgtacgacataatcttttccttctaatcgaacacgtccagcttcttttgctgcatgcatgtttccgtaatgatccaagtcttcaaaagagacagtttctgcacggataaatccgcgttcgaaatctgaatggatgattcctgctgcttgtggtgctttgattccttttttgaatgtccaagcacgtacttcttgttccccagcagtaaagtaagtagctaagcctaacaaatcataagcagcacggatcaactgatccaaacctgattcttcgattcctaaagcttctaaaaattccgctttgtcttcttcatctaattctgcgatttcttcttctgcacgagcactgaccacgatcacttctgcattttcttctgcagcaaagttgcgcacttcttgtacataatgattcgcgtctgcatctgctacgtcatcttctgagacattggctacataaagaattggttttgtcgtcaataaaaatagtgatttaacgattttttgttcttcttcagtaaattcgatcgttcgggcagattttccttcttccagtacaggtttgattttatccagtacagctagttctgccactgcatctttatctttggttttagcaacttttgctacacgagtatagcgtttgttgatagattctaagtctgctaacactagttccaagttgatcgtatcaatatcttctagtggatcaacacgtccttctacgtgagtaatattatcatcatcaaaacagcgaacaacgtgacaaatagcgtctacttggcggatatggcttaagaattgatttcccaaaccttctcctttacttgcgccttttacgattccagcaatatctgtaaattcaaaagtcgtcggaacagtttttttcggatgtacaagttctgttaagcgttgcaaacgccagtcaggtacttctaccatccctacgttggggtcgatcgtcgcaaagggatagtttgctgcttctgctcctgcttttgtgatcgcattaaacaaagttgattttcctacgttgggcaacccaacaattccagcagtcaatgccataaatttattcactctttctctgcatttttttcaattactttttttaatttcttttcaaaatctcgacgggtcatcatgacgatatgtccgcaattcatacatctgattttgatatctgcgcccattcgaatgacttcccagcgattcgtctggcaagcgtgaggttttttcatttcaacgatatcgtgcaagtcgtacataaaaatagcctcctttttgtttattcttcatcaaattgaatattcaagatatcaagaattcgagtcaaatctttttgagaaagatattcaatctcgatcttacctttcccatttttttcttggatagctacacttgtaccaaatttatccatcaaacgatcttcgctttctcggatataatatggtttttcctttgctagccttgggatttttttcttttcttttccatcattttgatttaactcagaaacaagctgttccagttggcggacagttaaattttcagttactgcacgattggctaatttcaagatcaatgttttattttttaaacctaacagcgtacgggcttgtcccatagataaacgctgatcttgtaccatttccttgacaagatccggtaaagaaagcaagcgcaaataattggcgatataaggtctgctctttcctaaacgactagctacttctgcttgtgttagtttcaggtttttcatcagcatctcatatgcttctgcttcttctaacggattcagatcttctcgctgcaagttttccagcactgctacttgcatcatcgcttcttcgtcaaagtctctaacgatagcagggatcgtttctttttcagctagtttggacgctcgaaaacgtcgctcccctgcaataatctcatatccttttactgcggaacggcgtacgatgatgggttgaaagacacctgattgttcaatagaattagctagttcctgcaaagatacttcttcaaatgttttacggggctgatacggatttggtcgcagctcattcaatggtagctggacaacggtatcatcttttacatccaccgtctctaagttttctaaatcttgaaacagtgcatcgattcctcggcctaatcctttacttttcttcacgacttaccacttcctttgccaatgcttggtagacttcagctcctcgagaacgtggatcgtagtcgatgatcggttttccatgactaggtgcttctgataaacgaatatttcttggaatgatcgtttcgtaaactttttcgcggaagtatttacgtacttcttctacgacttcatttcccagatttgttcgtgcatcatacattgtcagtaagactccctcgatctctaattctggattaaagtgtttttggactaaacgaaccgtattcagtaattggcttaatccttccaatgcgtaatactcacactgaacaggtatcaaaatcgaatcacttgctgtaaatgaattgattgtcagatggccaagagaaggcgggcaatcgatcaaaatataatcatactgactgcttacttctgctaaagatccttttaatcttgattctcttgccatcattgacgtcaattcgatctctgctcctgctaattggagagtcgcaggcacaatactcaaattttcgtgttcagtgatcaaagttgcctcatcaattggcaattcattgactagaacatcatagatgtctcttgtcacatcaggttttctgatcccgacaccactggtagcatttccttgtgcatccatatccactagcaatacttttttgccaaggctagcaagacaagcacctagattcaccgtcgtcgttgttttgccgacgccacctttttggttcgcaacagatattatttgtgccatctcttctcctcctatttgattggctgcttattaggcagtccgggctttcttgggtatttctttggggttggtttctttttttgaataacgatgatatgccgttgatcagagacattcggcaaggtaaccgcctcttctttgaggaatttaccacctaataaagcaatcgcttgttttgcttctgtcaattcctcttcactttttgctgctttcaatgcataaaaatagccttcttgtttagccaagggcaaacacaattccgctaacacattcaaacgagcaaccgcacgagcagtgacaaggtcaaatgatgcacgaaagtgaggattttgcccaaatgtttctgcccggtcatgatataaggaagcatcgattcctaataatcgggttaactcagataagaaggttattcgtttattcagagaatcaacgatcgttatctgcagttctggaaaggcaatttttaaaggtatgctaggaaaccctgcccccgaaccaacatcgcataaagataaaggttgcgtaaagtctacttcaaatgctaatgtaagtgaatcgtaaaaatgcttcagatatacgtctttttcatccgtaatagctgtaaggttcatcttttcgttccattcgactaatgtccgataataaatagcgaattgattcatttgatgatcggtaagctctatccctttttctgccaaggattggcgaaattcttctggtatcataaatattcctttcattgtgaaacagcaattgtttcacagattctctccctactttaacgcaaaatctctagacatgcaatccttccatatggattcttaaaaatttgaaaagtaagaaaagccgatagactttttctttctagtatgactcataaaatatacacagaagagagaactagctttgagcaatttctgcaaaaactagttctctcttctatttattattacgtattacgctggttcactgactttcgcaatcttcccttgttcgatatagaccattaggatacttaggtctgcagggtttacgccactgattcggctagcttgggcaattgtttctggttggattttctgcaatttttgttttgcttctgttgctaatccgttgattgctgcgtagtcgatgttttctggaatctttttcgcttccatgcgttttaatttttctactttttccatggcttttttgatgtagccttcatatttgatttggacttctacttgttcgatttcttttcgtgtcaattcttcattttctggaataaaccgtagaagttctgcataagtaatctcaggacgtcttaaaaagtcgcttgctagtacaccatcttttaatggtgccgcattaatcgttgctaaaaagtcttggacttcttctgttggtttgattcgtacattcatcaaacgtttgatttcttgttcaactgcttcttttttcttcaaataattcttgtattgatcttcttttactaagcctacacggtgacccatttctgttaatcgcaaatctgcattatcatgacgtaaaagcagacggtattcagcacgtgaagtcagcaaacgataaggttcgttcgttccttttgttaccaaatcatcgatcatgacaccgatgtaaccgtcacttcgtttgatcactaaaggttcttttccctgaactttcaaagctgcattgataccggcaatcagcccttgtccagccgcttcttcataaccgcttgtaccatttgtttgtccagctgtataaagattttcaacgactttagtttctaatgtcggacggagctggtgtggctctactacgtcatattcgatagcatatcctgtacgcatcatttctactttttctaatccagcaatagaatgaagcatgttgacttgaacatcctctggtaaagaagtagataaaccttgaacatagacttcttccgtatttaagccttctggttccaaaaataattgatgacgtggtttgtctgcaaaacgcacgatcttatcttcgatggatggacaatagcgagcgcctaccccttcaacgatccctgtaaacattggggcacgatgtaagttgtctcgaataatttggtgagtcgtctcacctgtataggtcagccagcaagattcctgatctagtttataggcactatctggtgtgctgaagctaaaatgattcggctctttgtcaccaggctgctcttctgtaacagaatagtcgatcgtacttgattttactcgaggcggtgttcctgttttgaaccgttcgatagcaaagccaagttcttttagatgattcgctagtccaatagaaggttgagagttattcggacctgatgaatatttcaattcaccgataatgatttctccgcgaagtgctgttccggctgtaataacaactgctttggcccggtagctcgctcctgtggacgtcactactccatgacaaacaccatcttcgacgatcagttcttcgacgattccttgtcttagcgtcaaatttggttctttttcgatcgtatgtttcatttctgttgaataagcatgtttgtctgcttgtgctcgcaatgctcggacagctgggccttttcctgtgttcaacatacgcatttggatataggttttatcgatattcttacccatttctccgcctaacgcatcgatttctcgaacgacaacgcctttagctggtccgcctacagaaggattacatggcatgaatgctaccatgtccaaatttattgtcagtaataatgtttttgatcccatacgtgcagcagcaagtgcagcttctgaaccggcgtgtcctgcgccaacaacgatcacgtcatacgcatctgcttcataatgttccaatcgtttgttcctccttttattttcctaaacaaaattgactgaataattgagtgattagctcatcttgtacactgtcgccgacaacttctcctagatagtcccagcaacgcgtcatatctatttgaacgagatccacaggcattcctgaatcaatacctgcaatgacttcttcaagtgagagggaagctttttctaacaacgcgatatggcgggtattagaaacataagtagcgtctctttctcctgtttctccgctgaagaataaatcagaaatagctgattccaaacgatctagtccgtcgtttttagctacggaaattgaaaaaactggttcattttcgatcaatttcttcaatttttcttgttccagctgtgctggcaaatctgttttatttagaagaatgatccgtttcaatccacttgtcgcttccaataattgttcatcttctgctgtcagtggttcgctttggtttagaacaagtaagatcaagtctgcttctgctaatgcttttcggcttctttcgaccccgatccgttccaccacatcttctgtttcccgaattccagctgtatcgattagcttgagcggtaccccccgaacattgacatactcttcgattacatctcgagtcgttcctgcaatatccgtaacgattgctttttcttctcttaacaaatggtttaacaaacttgatttgccgacatttggccggccgatgattgccgtacttaacccttcccgcagaaccttcccttgcttggatgtagcaagtagcgcttggattctttgttggatcatctgcgctttttcaagcaataacttcgtagtcaattcttcgacatcatcatattctggataatcaatatttacttctacttgtgctaatgtctctaaaatctcttgtctcaatgagcggatcaaagcagacagattgccgtctaactgattaagagctagtcccattgctttgtctgtttttgcccgaatcaaatccatcacagcttctgcctgtgaaaggtcaacacgaccattcaagaatgctcgttttgtgaattcgcctggctcagctaatcttgcaccttctcttaacaatagctgcaaaatttgattgactacaacgatcccaccgtgacaattgatttctactacatcttcccgcgtaaatgtctttggtgctctcatcacggagaccatgacttcatcgacaagctgattgctcttgggatcaacgatatgtccataatggatcgtatgacttggtacttctgataatcgtttgtttccagattgataaactttatctgctagttgcacagcttgatcgccacttaaacgaacgatactgattgcaccttctccaggtggggtagaaattgccgcaatcgtatcaaattctaaagtaatttcagccattttttcacttcctttttcattttgcgcacaaaaaaagtgcccactccaccctttatgcacaataaacggtgaacttcgcactttgactgcttgttcttgattaaattctggtcatagattatcacacttgctataaggaatcaagtgtttaaaacaattagatgaagttgagcctgttctgcttccattaccttatatttaattgtccttggatgtctctttgcgttctttggtttattcgaagagaagatactgtataaacaaggctttatctttcttaaaaaaaacggtacactaaatggtagcgctatctaaactatacacttttgaaaggagaaaatatgtgagcccgttcagatctgctgcattggaagaagaaagtgaccctcggatcaacgatgtcgttttatctacagggaatatcaaccagaaatatatcgtccgcgatatcgtttttgttgtggaatgcttagaagctgatttgtttgacccatcttttcccaaagatgaccttttcttaacaacgaagaggaaattaaagacgaaggtacttgaatatggtgcgaatgcagtaatcaactgtcattttgagtatcagcaaaaaaaacgcgacggaaagtattttctggaactttttgcttatggaacagtgatccaatttatccaaacaacgattggttaaatgaaacagacaaaaaaagcggatcaaaactgaagacagtttcgatccgcttttttctatcaaagttagtgactacttcatcgtatactctgataagaatgatttctagtaaaatatacttggtttgaaaaactttgtcaacgtgatttattcaaaaagtaatggaatcaataatattttttagcaggttctactactaaataacgataaggttcctcaccttccgaatgtgtttttacatgttcatctttgcttaatgcagcatggatttgtttacgttcaaatgcaggcattggttctaagaaaacaggctgccctgtccgttttactttttcagccgtgcgatcagctaaacgctgaatgatctcttggcgcttttcacggtaattgcctacattgactactacagacagcttatttcttgctaaacgatggatgaagacttgtgccagatattgcaatgcattcagtgtttttccatgtttcccaatcagtatgccttgcttttgtgtttctaaatggaaaacaaccatattatttgattctctttccattttgacaagagctggagcatcaagctgttttgaaatttcagtaagataaactgccaattccgttaaagctgcttcatcacctagctcacttacttcttctgttttttcttcaagaatcgtttcgttgactacctcgatctcagctgttggttcttcttccaaaatttcttctacagtctgttctactgtttcagaaactttttcgctgatacttggctggatcgaaagccgtgcattctttcgacccattcctaggaaacctttttttccttcttccagtatttcgatttcgacttggtctttggccaaacccaaatcagccagacctagttggacagcttcgtctattgttgcagcttcataaatcggcattagcattacctcccctattatttccgttttttcttaggattcattgctttcttaagagcacgttctctttcgcggattctccgtgcttcttcttcacgctcttttcgaattttgaaagggttgttgatcagcagcgtttgtacaacttggaaggcattggaaactacccagtataatgaaagaccgctggctaaattgacacccatcactaaaatcattacaggcatcacgaaattcatgatcttcattgatgcattcgattcaatttgactcatgctagataaatacgtacttgcaaaagtaaagattgctgctaaaatcggcaaaataaatgttggatccgcgttccctaagttcaaccataagaaatgcccttgtttcaactctggtacacgtgaaatagattgccataacgccatcaagattggcatttgtactaataaaggaagacaaccagcatatggattgacgccattttctgcatataaacgctgctgctcttctcttaacttactttgtgtttccggatctcttgaactatattgttgctgcagtgcttttaatttcggttgtaattcttgcgttttacgcatgctctttgtttggaaatgcatcaacggcaataggatcacgcggatgatcagtgtaaataaaatgatccctatccctgcattaccaaatgacaacgccttgatcgcctcagcaaagtaataaacaatataacgatcccaaattcctgtactctgtgcgctgacttccccagttccgcaaccggataagacgatgaccaaactaacgataccggccatcaaaagtaaacgtttgtatttcttcacttactcttttcctctctgtcgattatttttgcaagttttaagacgtggactaaattggagcgaacctcatcataagtcaaccccttcacacttggtctagcaatcacaataaaatccaactccggatcaatttcttcttttatagaataaactgctgctcggatttttcgtttgacttcattgcggtttaccgcgttgccgaccttttttcctacagataaaccaactcgaaaatgaggctgtcccggtttttccaaacggtaaacgacgaatttgcggttagcaaaagaatctcccgtatggaacacggcttgaaactctcgttctttttttactcgatacgcttttctcattagttttctttccttttctatctctcacttacgctcataatcataccataattacgattgtcctttcatcatttccctaaaaaagagtataaaaaaaaccactgaaaccccagtggcctaagctgaaagaacttttcttcctttgcgacgacggctagctaacacacgacgtccatttttagtactcatacgtttacggaatccgtgaactttttgacgtttacgtttatttggttggtatgttcttttcatatattccacctccaaaatgttcttatctattttataaacacagacatactttgatagtataacgacaaagtagtgattttgtcaatataaaatagaagatcgattgttaaaacttatccacaagattatttttttctatgggaatcctatgtggaaaaagttatgcacagggattatccacagataataaaaggctggttttacacagaaaacacacgtgtaaaaaaagtaatccacaatcaggcgatttcctgtgtattccgtctcctaactattggtatatctgtattttttatccacagacgcaagaggaaatctattggtttttacgagttttccacctgtgcattagtggtgtggaaaactttttttgacaactgtgtttttctcttttttctttttgtcgattgtgtggataattgtaattaaaaaatttttttcttcggtttctg

SEQ ID NO: 4 - DNA, 36262 bp, Enterococcus faecium
atgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctatggaaattataatcaaacagaaagtagagctgcaccctaatatgtgtgtgatgagctgtacggaacctgagcaatgggatgtggtaatagaaggaaatgatgaccttttagagaaatatatgtccggtaaatcattagaagcattagaactcgaacaagaggaaatcagaagatttcagaattgctccttgtaccctgtttatcatggaagcgcaaaaagcaacatagggattgagcagcttatagaagtgataacgaataaattttattcatcaacatacagaaagaagtctgaactttgcggaaatgtcttcaaaattgaatattcggaagaaagacaacgtcttgcatatgtacgcctttatggcggaatcctgcatttgcgggattcggttagaatatcggaaaaggaaaaaataaaaattacagaaatgtatacttcaataaatggtgaattatgtaaaattgataaggcttattccggggaaattgttattttgcaaaatgagtttttgaagctaaatagtgttcttggagatacaaagctattgccacagagagagagaattgaaaatccgctccctctgctgcaaacaactgttgaaccgagcaaacctcaacaaagggaaatgttacttgatgcacttttagaaatctccgacagtgacccgcttctacaatattatgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcatttcaaaatgcagttatggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataacttagtgtattttatgttgttatataaatatggtttcttgttaaataagatgaaatattttttaataaagatttgaattaaagtgtaaaggaggaattaattatgaagtgaaatgaatgtaacagggttcaattaaaagagggaagcgtatcattaaccctataaactacgtctgccctcattattggagggtgaaatgtgaatacatcctattcacaatcgaatttacgacacaaccaaattttaatttggctttgcattttatctttttttagcgtattaaatgaaatggttttgaacgtctcattacctgatattgcaaatgattttaataaaccacctgcgagtacaaactgggtgaacacagcctttatgttaaccttttccattggaacagctgtatatggaaagctatctgatcaattaggcatcaaaaggttactcctatttggaattataataaattgtttcgggtcggtaattgggtttgttggccattctttcttttccttacttattatggctcgttttattcaaggggctggtgcagctgcatttccagcactcgtaatggttgtagttgcgcgctatattccaaaggaaaataggggtaaagcatttggtcttattggatcgatagtagccatgggagaaggagtcggtccagcgattggtggaatgatagcccattatattcattggtcctatcttctactcattcctatgataacaattatcactgttccgtttcttatgaaattattaaagaaagaagtaaggataaaaggtcattttgatatcaaaggaattatactaatgtctgtaggcattgtattttttatgttgtttacaacatcatatagcatttcttttcttatcgttagcgtgctgtcattcctgatatttgtaaaacatatcaggaaagtaacagatccttttgttgatcccggattagggaaaaatataccttttatgattggagttctttgtgggggaattatatttggaacagtagcagggtttgtctctatggttccttatatgatgaaagatgttcaccagctaagtactgccgaaatcggaagtgtaattattttccctggaacaatgagtgtcattattttcggctacattggtgggatacttgttgatagaagaggtcctttatacgtgttaaacatcggagttacatttctttctgttagctttttaactgcttcctttcttttagaaacaacatcatggttcatgacaattataatcgtatttgttttaggtgggctttcgttcaccaaaacagttatatcaacaattgtttcaagtagcttgaaacagcaggaagctggtgctggaatgagtttgcttaactttaccagctttttatcagagggaacaggtattgcaattgtaggtggtttattatccatacccttacttgatcaaaggttgttacctatggaagttgatcagtcaacttatctgtatagtaatttgttattacttttttcaggaatcattgtcattagttggctggttaccttgaatgtatataaacattctcaaagggatttctaaatcgttaagggatcaactttgggagagagttcaaaattgatccttttttataacaggaattcaaatctttttgttccattaaagggcgcgattgctgaataaaagatacgagagacctctcttgtatcttttttattttgagtggttttgtccgttacactagaaaaccgaaagacaataaaaatggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccaactagactgtgcaaaatagagacacttgaaaaatctatcgggggtcagaaacttaatagtttttgacacataaacaaaatcgcgatataatggggttgagagtgtttcataaacttatgtcataaagttaaggagatttcgcatgattttagagaataaattgggattaaccaatcaagttgagttggctaaggttgaagaaaaactcagtaaacaaaaagcgaaagaattgtacgattgtggaaaaataaatgaaatcgaagttggtacatttaaaggtttatctgaaattcatgaatttctattttcggatatttacgattttgccggaaaaatccgatcggtcaatattgcaaaaggaaattttcgatttgcaccagttatgtatttagaacattcgttacagcatattgatcagatgccacaaacttcttttgaagagattatcaagaaatatgtggagatgaatatcgctcacccatttcgagaaggaaatggccgaagtactagaatttggctggatctcattttaaaggaagaattgcaaaaagttgtagattggaacttaatcgataaagcagactatctttctgcaatggagcgaagtcccataaacgatttggaaatacgctatctaatttccaatgctctgactgataaaattgacgatcgcgagttatatatgaaaggaatcgatgtcagctatttctatgaagggtattctgagtatacgatagatgatttgtaaaagtaggtggaccaaatgacgaaatatggatatgcacgtgtctcaaccgcttctcaaagtacaaaagaacaaattcaacagttgcttgagaacggcgtagagaagaagaatattttttcagaaaaatttacgggtacaaaacgggatcggccaaaattcaatcagctgttggctggtctgaagcctggagatgaaatagttgttacgaagcttgatcgatttgctcgtaacacgagagaagcattagagatcattgaacctttactcgatgataacgtaacgatcaaggttttgaatctaggaacgattgaaaatacgtccatggggcgaatggtgacacggacgttgttgagtgtagcagaaatggaacgtgatatgattgtggaacgtacccaagaaggaaaaatgtttgcaagaaagaataatcctaatttcagagaaggacgtccgaaagcaacaatcacaccgaagaagaggcacgcatatgaactgcttacttcaggtaaatcgtataaggaagttgaagctataaccggtttcagtcgcagtacgctttttagaataaagaagaaaattgaagaaagttaaaaaagaagtctcagcgaaccagacaggtaaatacttaatgcgttctagatatgagtctattagcatgttgtgaaatataatatttttttatttacttgatttctgctcaaaaaatgtgtatggtaactgtaaaaggtaaagtaattaaaggtatgctagccacgcttactatattaggataccatcatatatttataatgaacgatttgttcgtctaccaaacaacacatatcgttcagcgtaagtcacgtttaggaacgtggcttttttagtgttattatcgataaataatctattgactctattgattttatctccatatccctacggtgttgattgtctttagatctttcatttaagaaccaaataactatcataaaaatcagcactgctgctaatataataaacagcattcctattgtgatattactggatttgagtcaatatcttggacacattttagtagagacggttaagccattttttcttttgctaattcttcaaattcctgtggggttagatagtgaatcgagctatggattcgatttcggttataaaatccttcaatgtagctaaatagcgctcgatttgcttcttcaaaatctgagtagctagtcgtgtagacttcttcttttttcaatgaggcatggaaagattcgattccagcattatcataaggtgttccttttctactataagaatgccttattttgttggttttaagccattgttccacttctcttgctgtgtattggctgcccaagtcagtgtgtagaatcattccttctggaatgtgataatgtatttttgctttattcaatgtttgaatgacacaatccacagtcattcgttttgaaaatgtataactaataattcttttcgtgtgtaaatccatgattgaagataagtaacaccaaccatttttcttagtaggaatgtacgtaatgtcagctgcccatttctcacagatcgtttcagtagaaaagtcctgatttaagagattctcttttgaaatgatggaatggcaacagtttttttgacaaattttataaggtgcagaacttctttccgtatgctattccgattgtccttgacaatgagcctcctcggatgtgacgatcttcggcaggagctaacagttaaagttagactgcctcgctagcgttagcacatccgagctcattatcaaggattcgctgcgccaatctctggttacggtaaccaaccggtgtctcgtagccaagtgtaccgtgcaaccgaaggtggttccaccaattgacatagtcaaataactccaaatccaattgttgtaaggtttcaaatgtgtattgatagacaaattctactttcaacgacttataagttgattcagctacggcattatcaaaaggacagcctttatgactcaatgatcgattgatgtcaaaagttgttaataattcatcaatagcttggttatcaaactcttttccacgatcagtatgaagaatctcaacctctgtcagaggttgtttgatacggctaaatgcttttttactagaacggcatctttatgttctccacaagaatagccgagaatttctcgattgaacagatccaaaatgaaacagacataattccattttttcccgactcgtacataagtcaagtctgttacgatcgcttctaatgggttgtctcttaagaatttacgattcaatacgtttgtcgttttggcttcattgcaagtagaatgatgtactttaaaataagcaacagtatagctcgattttaatcctctatttttcatgattctactaatttttcgtcggctgatctgaatgcctcgttttgataaggctttttattttcttgagccgtaggcctttcggctgcggataaattcttcagcgactacttcttcaagttctgattcgtctttctttggttttgattgataataataggactgacgtgatagacctaatattctgcacatcgctgatatagggtaaagatgcttattcgcatcgattacttgtctcttcgtccgaatatcagcgctgcttgctttaaaatatcattttccatttctaattgctggtttcttttacgtagttctaacaattctttttgttcaggcgtaagattatctttttctttgaatgaaccactcgttttaaattgctttacccatttgtcaaatgctgaagccgttagttcatattctcgaatgatttctacacgtggctttccagctaagtaaagattgacgatttgttgcttgaattcttgtgaaaaagttcttcgtgttctcttagacataaaaattcctcctggtatgttttcttctagtctacacaccttaatttttctgtctagttaattgtagcctatccatgatcggtttattagacctttgaggtctatattttttaactacaatcgaccttaaatttaattgtttcattagcttttggacatgtttaagagatactgaaatcccttcttttaataaaacttgatggatctttgtggcaccatagcgttgtttattcgtaaaaaaaattgttgaaatcttctttttcaacttattatttctgatttctgtagctgtcaacggtttattcttataaaaataatagacacttctagggatttctaataaccgacacaacaaagaaacagtgtaatccttacaccatttttcaataaattgaacaagcgaatttaggttttccgagagaatatggctgcggctttttttaagatttcaagttcctcatttaaacgagcattttcttttctcagttcagctacttcttttccagtcagtcctgtggactgatcaggtaaatataaattcttccatttgtaaatcgttgcttcagataagccatattctttcgctaaccctcgaacagaacgtccagtttgattcagttcaacaatcatttgtttaaaattttcttcatatcgggtcataaaaattcatcctctcgtagataagtttaatttattcttgtctctacgaaaagctgtctaagatttgatactaacaccaaatgttgtatacccccaaacaatacacatattttgaaggattaggattaataaagctaaaaatatagtaagtatactaaatatatttactatatctagtatacttactatattttaatcttttgatcgtctattatatataatccgttcctcgtcgtttaaagtatcaacataggcgtccattgcaagtttgactatttcatacataggaatatcttttgcataactaagatcccgaatggtttttagtacgggaggatctacttgaactggttttctttctttcgcagtgtactttcgttcccctaactcgacattaatatcatctttaattgaaatatcttcagcaccaattttcttcttatctttgttcgttggtaataatgccatttagtttaatctcctttccaagaggtaggatatgattggccattgagtcagcatatttaggtgtataatcaaatccttcaatatcaccatgttgttcatagtattcaattctttcttctaattctgtaaagatgtctgcaaaaatagcccaccatcttcgatctacataatcatttaattggataccattctcaccatacatttctaaccgatccgagcctttaacaatgcttttaaaaatgtttgattcaccatacttatcaattgttttttgatagtttgcgtgttgagaggaacgtcgcactgagaaaagaacaggcaaaattccaatgatttgaagatgagactcttcaaaattcgtgacaatcggaactaaaactttattaataaaatcttctgttccttccattgcgtaccgttttaattcttgcattgcaataatataatctgcagcagttaagaatgcacgaaccacattatctgttgatggtgggcagtcgataaagatataatcgaaattttttctcaattcttctaaaggtttaatgaaggccaatgatctcttacgacgatcaggatatttttcggacaagtattcattaagttcttcagatccaggagagccagccataatatataaatgtggacttacttgagtaatacctgaaacccagtccccttttttgattgctgcagacatggatcgatcaaagctagtaatttgatacgttgatccaatgttggaagtagtatttctttgttggtcataatcaattagcaacacgtctttttcaaaaagttgactagaaacaatcgctaataaatcattgtctgtagtcttaccaatgccgccttttctacctgtaagcattacaacttttcctagtttatctgatgttttaaatgcagtccgtaagttttccatagttccctccaatttcctatactaaatatatttagtatacttcatatacttaatatattcgatatatctaatatactccaaattgataagaattcagactttataaggaatatagtggatatactaaatatatttgctatattcagtatatcagatatattcaaaatgtcaaaatatatttgtgcgttttgcgttgacaatttagagtgaaaagaggtaaacttaattctatagaaaccacagataattcactatttacaaagtagcaaaagcagtggtactctttaaacagaaaaattacataaaaaaaagagacggaaataattgattttagcagaatcaattatttctgaatcacatggttaggacatgtgttcacgctcgtctcaagaatatgtaagtagctaccaactacttatattaaaagttgatcggataccttttccgattgcctttattctaccaaaaaaaggcgagcaactcaacagaagaacgtttatttagtgtacttaaattaaatattcttaaacactgaagagagaacacatactatggctgagattaaagctaaactgtgttctctttttgtttgagaaaggacgttacaatcgatgttgagcgaaatttattcagctattcttaaaaacggcttacgtacatacaaatatcgaaacagcaccatgaaacctgcaggtcatattgattccagtaggagtggtgctatctttgcgtaccgtagcaagcaattaatgaatgttgggcgtggtatggtcattacttcggaagaagctattttagagaacgaaaagaaactaacgcattggacacctaatacctatcgctttggtacttatgcggatgattatcgaacagtggttaaaggtcattctgagaaaaacttaagtcaaatcaacacatttgtagttgatatcgattcaaaagagaaccatcaaggcgaaattattttagcctgtttagatcaagtgggctacatgccaacgctaattttagaatcagatcatggttatcaagtttattttgtactaaagacaccaggctatgtcacaaagaaaagcaatttcaaggtgatcgatgtagcaaaaaaaatttcaaaaacaattcgtctacagttggctgaaaaattgtccggagtggatctaggatgtaaccacttcggaattgctcgattcccacaagaaaataatattgtttttaaagaaatgaactatcagtattcttttgctgactggattcaatggtcgatgaagcttgaatcagatcaaaaaacaaaagaagatcgagaacgaaaactaattgtctttcctgagaaaaaagaaattcgtcaagtagatgaaccgtggttcgatatgttacttcataaagcaaacatcgtcggcggagaaggacgtcttggtcgaaataatgtgattttcacgctttctttagcttattactcttcaggttatgcattggatacttgcgaatacaatatgttcacattcaacgaacggttacaggaaccgctatctgaagcagaattagtaaagattgtacgtagtgcttattctggtaattatcaagcagcaagcagagaattcattattgaattgtgccagcaatgggtttcaccaaccttaaaaaataatgatctgttcattcaacgacgtggctggtggaaatttaaaaagccacgagatcaaagaaaatatagtcataaaaatgaatggaaagaagatctattggcttatctaagcgaaaaaagtcttgctagtgagccttatttgaacctgtcaaaaaaagaattggcttcacaactaacgatgcccaagcgaacacttgataagatcttaaatgagttacgagaggagaataaagtcttctacaaggtaacacgaggaagaaatggcggaatgatcattgcttcagtcaaaacgttgttcgcgagggttattcaactaagtaaagaaaagagactagattattcaacaaggatcacagaggtatttggactcaacgagagcttagtagaagagacatttagacaattatcaacccccttgaaccctcttaaagaagtgaatctttttgaagtagatacaggttgaaaaataaaaggtgcaaattgccttatacaatatatctatgatacttctgtaggtgttgctccctttgcctagctacgtgtaggtggtatacttataactgcgtatgcagtcttatgtatcatggaggaagttgtatgtcgttaaaaaattatgtctattcacatcctgttaatgtgtttatcattggtcgtttgggattatctgtggaagtgttctgtgagctttatggttttaagcaggggactttgtcttcttgggttaccagggaaaaaacagttgcttctttgccgattgagtttcttcatgggttgtccttagcttctggggagactatggatcaggtatatgattgtttgtgtgtgttagagcaggagtatattgagtataaaatagctaacgagttaagaaaaaggaagaagtatatccagtagtagtttttatttactcttaattgtcaaattaagttagacaaatcatcaatacttacgtaactcaaaaatacttccaaaggtgttcgataattcagtgattttctaggaatattatttcgtttcgatgcgacagattgaataaaagattcatctactgaattgaaatccatagatttcaataaaccatctctacgtaacaatccgttagaattctcgtttaggcctctttgagacggcgttcctggatcagcgaaataaatggcaatatcattggcattactgatctgtttccaatttgaaaattcctttccacaatcaaaagtgatggatttgaatagatttttcggtacagattcaaaccaatgatttaatttgttttcaatatcaatcgcttgtctaccacacggtttcaatgtgatgataacttttgataatcgctcaactaaggtaattacagcacttttatgtttcaaacctacgatagtgtcaccttcaaggtgaccaaactcatttgagaattggctataatctttttcacgttcatgaatagagcgacggaaagcttgttttccacgtctttcttgatgtccatttggtttacgcttgcctttcatcggtaagtcagaaggattaaatagcccctttttgaacatacgataaatggtacgagcagaacaacgaataggaaacgctgcacgaccaacaatcacatcgggtgtccatccttgaacaacctttctttgaatatattctgattgttcctcaggtaaaacaagcgggcgtctaccacagtttgatttgtttttcttatactgttgatagtactctaaggctgattttccttgcttgaagaacaggtatactttatggatcgtttgtcttgaacgattcaagaaatgcgcagttttcgcaacagattgatttattttgaaataagactctatcattacaagttcatccgttgtaagatgggtataggtcatttgtactcactccttataattctttggacggaactattttgagtgtagcacaaatgacttttttagttgtctagcttaattttacaatcggcgtacttaaaaaattggttcattgagcaacctatcgctgctaaagtagcaaaggaaaacgttaaaggaaagaatttagggaagaaatcgaaatgaaatcggacgactggattgaacacacctggcttcctctgaaaagaaatagcaaacgaaagaaattttgggtattgcaattatggccattaggaaaactttgtagttacggggcacgacttattcttgatttaaccgtttactcgattggagtatttggaacggcttattacttgataaatgatcccaataggattgcagcatcagacatttttacagtgctaatgacgttgatttttgtcatgctattgtctatttttactcaattagtcatgcaatttaccaggcaaaaattaacagcaggaaaacttttcaaaagcctattcgatttaattgttgtaaatgcaattctagcgactttaataaaacaaattgaacaatctggaagaacaacaaaaggagtgaaggattttttattgacgtttattcactttgtaaatggacacatgtatttgtttgaagtgggtattattctcttttttgtcgggtatgtatccacgaaacttattaaacgttcaattgaaaaagaaattgaaattgacctgattccgacacttcttggttatgagtacaatgttgattttggaagatatgacgaattgatcaatacggatatcgttcacacgagtatccatgaatctactgttaagggcatcagatctattttaaaaaatggccaggaaatgaaagcaatagatcgaagaaaagagatctacaatttttatgaagtcgaagcaagcctacgatatggcatcggaaaattgtggttagatggaagtaatattcgtcaaaacaaaccatacattttttggaacagtagtgatttagaacttccaatgaaagataaataattatggagaatcgtttgaaaatgattcctctatacaggattgtgcttatagttggcatggagttaaaaaccttaaagaaggagcagttattcaaagtgaaagaacgtcataatcagttactatgtagtaaaacgggtacgatgaacattgaataccgaacagaatatttagaattaacgaatcaaactgattttttgttgattcgaaagcaacaagagcaagaaaaattaatggctacttatagccaattgattgatgaatgggaacaattcaaggaatctaaaattccagaacgtctctaaaagcctttatttgtaaagagcataaggaaacgtgggaacactttttaaaaaaagtgttccaataggctgtgcctattacgtttctcaaaaataaatgtgggaacaaaatatttaaaaataggatagtgaaaggatagtgaaggatagtaaaaggagggtagtaggatagcaaaaaggataggctccttttcgctatcctttttaaattggaggaattaatatggaagtaagaataagaaatgtggatgagaaaatcgtaagagaaattgatcgaagatgtgacgaacggttctgttgcaaagttttaaatctactatcaaataaggtagaataatagaaaaagatggcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccataaaaattttattcttgctgagtctggctttcggtaagctagacaaaacggacaaaataaaaattggcaagggtttaaaggtggagattttttgagtgatcttctcaaaaaatactacctgtcccttgctgatttttaaacgagcacgagagcaaaacccccctttgctgaggtggcagagggcaggtttttttgtttcttttttctcgtaaaaaaaagaaaggtcttaaaggttttatggttttggtcggcactgccgacagcctcgcagagcacacactttatgaatataaagtatagtgtgttatactttacttggaagtggttgccggaaagagcgaaaatgcctcacatttgtgccacctaaaaaggagcgatttacatatgagttatgcagtttgtagaatgcaaaaagtgaaatcagctggactaaaaggcatgcaatttcataatcaaagagagcgaaaaagtagaacgaatgatgatattgaccatgagcgaacacgtgaaaattatgatttgaaaaatgataaaaatattgattacaacgaacgtgtcaaagaaattattgaatcacaaaaaacaggtacaagaaaaacgaggaaagatgctgttcttgtaaatgagttgctagtaacatctgaccgagatttttttgagcaactggatccaggagaacaaaaacgattttttgaggaaagttataaattattttccgaacgatatggcaagcaaaatattgcttatgcaacagttcataatgatgagcaaacccctcacatgcatttaggtgttgtgcctatgcgtgatggaaaactgcaaggaaaaaatgtgtttaatcgtcaagaactgttatggctacaagataaattccccgagcatatgaaaaaacagggttttgagttgaagcgtggtgaacgtggctctgaccgtaaacatattgagacagctaaatttaaaaaacaaactttggaaaaagagattgattttctagaaaaaaatttagcagttaaaaaagatgaatggactgcttatagcgataaagttaaatcagatttagaagtaccagcgaaacgacacatgaaaagtgttgaagtgccaacgggtgaaaagtccatgtttggtttgggaaaagaaataatgaaaacagaaaagaaaccaaccaaaaatgttgttatatcggagcgtgattataaaaacttagtgactgctgcgagagataacgataggttaaaacagcatgttagaaatctcatgagtactgatatggcgagagaatataaaaaattaagtaaagaacatgggcaagttaaagaaaaatatagtggtcttgtagagcgatttaatgaaaatgtaaatgattataatgagttgcttgaagaaaacaagtctttaaagtctaaaataagcgatttaaagcgtgatgtgagtttaatctatgaaagcactaaggaattccttaaggaacgtacagacggcttaaaagcctttaaaaacgtttttaaggggtttgtagacaaggtaaaggataaaacagcacaattccaagaaaaacacgatttagaacctaaaaagaacgaatttgaactaactcataaccgagaggtaaaaaaagaacgaagtcgagatcagggaatgagtttataaaataaaaaaagcacctgaaaaggtgtctttttttgatggttttgaacttgttctttcttatcttgatacatatagaaataacgtcatttttattttagttgctgaaaggtgcgttgaagtgttggtatgtatgtgttttaaagtattgaaaacccttaaaattggttgcacagaaaaaccccatctgttaaagttataagtgaccaaacaaataactaaatagatgggggtttcctttaatattatgtgtcctaatagtagcatttattcagatgaaaaatcaagggttttagtggacaagacaaaaagtggaaaagtgagaccatggagagaaaagaaaatcgctaatgttgattactttgaacttctgcatattcttgaatttaaaaaggctgaaagagtaaaagattgtgctgaaatattagagtataaacaaaatcgtgaaacaggcgaaagaaagttgtatcgagtgtggttttgtaaatccaggctttgtccaatgtgcaactggaggagagcaatgaaacatggcattcagtcacaaaaggttgttgctgaagttattaaacaaaagccaacagttcgttggttgtttctcacattaacagttaaaaatgtttatgatggcgaagaattaaataagagtttgtcagatatggctcaaggatttcgccgaatgatgcaatataaaaaaattaataaaaatcttgttggttttatgcgtgcaacggaagtgacaataaataataaagataattcttataatcagcacatgcatgtattggtatgtgtggaaccaacttattttaagaatacagaaaactacgtgaatcaaaaacaatggattcaattttggaaaaaggcaatgaaattagactatgatccaaatgtaaaagttcaaatgattcgaccgaaaaataaatataaatcggatatacaatcggcaattgacgaaactgcaaaatatcctgtaaaggatacggattttatgaccgatgatgaagaaaagaatttgaaacgtttgtctgatttggaggaaggtttacaccgtaaaaggttaatctcctatggtggtttgttaaaagaaatacataaaaaattaaaccttgatgggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatagtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgattcatcgtcattcctcctgctatctttttctattattctaccttatttgatagtagatttaaaactttgcaacagaacccttccaaactaggaacttcacaataataaatttaccgatttctatttcttgcattatttacgcttctttctaactggaacatattacattcctaaatctctttttactcgataaacggtttttcttgtaactcctgcgttcttgctattttagaaatagtttcttttttcttcagaccatcaacaatttcatcgtaaatcaatttgttttttcctgttgcattggcatggtattgaatctttttaccagtataacgaccatttttctttgcaatttcaatgccttgtttttgacgctctttgatttttttccgttcgttttcagcaacatagctaaacacttctatgactaaatttgttagcaagtctcttaatgcagggtcagttaccccattaaacgacggtaggtctaatatttcaatagaagcacctttactacgaaacaattgaagtaagtcttttgtatctttactatttcttgctaatcgatcaagactaggaataataatcgtatctcgttcacgtatgaaagaaataagctcttgcagctctggtctgttttcaatattttttccagagactttttcctcgaaaatttttaaatcgtcttcagcaatattatttttgactgaccaattttcaattagcttatgttgccgagctaaactttgatcgtcggaagaaactcttaaataagctaaatacatttgccatcattcctatccaatctatttactattagtatacaggtcttagggtacactttgcaataaagaaaaaccgctgaaaaatcaacgctttaagcaaatatggatttgtaccattagagtatacccaaaagaaacaacaaataaactgtagatagcgggttcaagttgtagtcgttgctggctacatcacctcctttaagtatttcttaggtaacagaaatgtgaacacaaaaataaggacattagtttattttaaaactaacatccttaatatcttaatttatccatattttgagaaataatacttttccattcagaaactaatttagtaaggaatcttgcaatgttttgtctcattaattcattatttctattatctataagatctgttagatatttttcaaattctaaaaagctatccgaattttcttcgacgattaaatacttaagagaatttatatcggaaaagatagattcaagtttactaatctcattttctaaatctatattttcacgtgtgattatctcatcactttttcttaaaaagctaaaaattgcatcagttgctttacacttttccattaaagaagtatattcttcaatttttcttctttctttatggtcattttttaaatcagtttcaatgtcttttttcatttgttctatactgagtttgttctttttgttcttttgagtaaatctaaaattcaaacacgaaaaaagtatgttagcaataacacctataatagcaaataaatcatttatactatttaatttcatttatcatcacaaacttagaactttacttatcatctcataagacaagtttccaaattgataattattggtagattttaaatcattataattttcgagaaattttatataagtacctctcatcggtttatggctattaaaagtgttaaaatcactatcttcaactatttcttgaaacctatttaattttttattaaaaaaatagcataaaaatctagttatccgcataaaaactggacttatcacactttatcaaggtcaaaaccactcaatttactactaatttactacttatgaatgagctttgatacgacgatttatccttgaaaagtgaagatataaagatacttccaataaaatttgaatatttaataggtagacacttcaaaaaatgaggtgtctatttttttacccgattttgaaaggaagtgaacttatgaaaacaaaaaatcaagaatcaaaaggtcgttccccactctttaagaccatcaaacattcattcagccaataaaaaagaaaggataggtaaaaatatggaacttaaatttgtgattcccaacatggaaaaaacattcggcaatttagaatttgctggcgaggataaagtcgttcagcgaagaatcaacggacggctaactgtcttatcaagaagctataatctctattctgatgttcaaagagcagatgatattgtggtggtgcttcctgctgaagctggcgaaaaacatttcggctttgaggaacgtgtgaagttagtcaatccacgtattaccgcagagggctacaaaatcggcactcgtggttttacaaattaccttttacatgctgacgacatgataaaagaataaagaaagagaggaaaaatgatgagattagcaaatggcattgtattagataaagacacgacttttggagaattgaaattctctgctctacgtcgtgaagtgagaatccaaaatgaagacgggtcggtttcagatgaaatcaaggaacgtacctatgacttaaaatccaaaggacaaggacgcatgattcaagtaagtattcctgccagcgtgcctttgaaagagtttgattataacgcacgggtggaacttatcaatcccattgcggacaccgttgctactgccacctatcaaggagcagatgttgactggtatatcaaggcagacgatattgtgctgacaaaggattctagttcattcaaagctcaaccacaagcaaagaaagaaccgacacaagacaaatagtcgctaggtagaaaggagactttttcgcatgaaacagcgtggtaaaaggattcgcccatctggtaaagatttagtctttcattttacgatagcgtcactcctgcctgttttcctgctggttgtcggactgtttcatgtgaagacaatccagcagatcaactggcaggattttaacctatcacaagcagataagattgacattccctatttaattatcagtttcagtgtcgcaattcttatctgcttgctggtagcgtttgtattcaaacgggttcgctatgatacggttaaacaactttaccaccgtcaaaaactggcaaagatgatacttgaaaacaagtggtatgaatctgaacaggtcaaaacagagggtttctttaaagatagtgctggtcgtacaaaggaaaagataacctacttccctaaaatgtattatcgacttaaaaatggcttgatacagatacgggtggaaatcacgctgggaaaatatcaagaccaactcttacacttggaaaagaaattagagagtggcttgtactgtgagctgacggataaagagttaaaggattcctatgtggaatatactttgctctatgacaccatagccagtcgtatttctattgatgaagtagaagctaaagatggtaaacttcgcttaatgaaaaacgtatggtgggaatatgataagctccctcatatgttgattgctggtggtacaggtggcggtaaaacttactttatactgacactgattgaagccttgcttcatacagattcaaaactgtatattcttgacccgaaaaatgctgatcttgcggacttaggttctgtgatggcaaatgtctactatagaaaagaagacttgctttcttgcattgaaacattctatgaagaaatgatgaaacgtagtgaggaaatgaagcagatgaagaactataagactggcaaaaattatgcttacttaggtctcccggcacacttcttaatctttgatgaatacgtcgctttcatggaaatgctgggaacaaaagaaaacaccgcagttatgaataagctgaaacagattgtcatgttaggtcgtcaagctggcttctttctaatactggcttgtcaacgtccagacgcaaaatatttaggcgacggaatccgtgatcagtttaatttcagagtggctttaggtcgtatgtctgaaatgggctatggcatgatgtttggcagtgacgtacaaaaggatttcttcttaaagcgaatcaaaggtcgtggctatgttgatgtaggaacaagtgtcatatcagagttttatactccccttgtaccaaaaggatatgatttcttggaggaaattaaaaagttatccaacagcagacagtccacgcaggcgacgtgcgaagcggaagtcgcaggtgtggactgatcttgctggctggtgtggcaatagccacgccagcacttaaccccccgtatctaacaggggggtacaaatcgacaggaaacagtcaaaaaaacattagaaaatcctttggttacaagggatttacaaaatttcagcgtatgtcaaatgggctttaaaagttgacatacgcctttttgattggagggatttttactgaatgaacaaacttggttacagcatttaaaagaaaaacgcttggcttatggactatctcaaaaccgtttagctgttgcgactggtattacaaggcagtatctaagcgatattgaaacaggaaaagtcaagccatcagaggatttacagcagtccctttgggaagctctggaacgcttcaatcccgacgctccccttgaaatgctgtttgattatgtaagaattcgctttccgacaacagacgtacagcaggtggtcgaaaacatcttacaactgaaactgtcctattttcttcatgaggactatggtttctattcttattcagagcattatgctttaggcgacatattcgtcctttgctcccatgaactggacaaaggagttctggtggaattgaaaggtcgtgggtgcagacaatttgaaagctatcttctggcacaacaaagaagctggtatgagttctttatggacgttttggtggctggcggtgtgatgaaacgccttgaccttgccattaacgataagacagggattttaaatatccctgtactcactgaaaagtgccaacaggaagaatgtatctccgtcttccgcagttttaaaagctatcgcagtggcgaactggtacgcaaagaggaaaaggaatgtatgggaaacaccctctatatcggttcattacaaagtgaagtttatttctgtatctatgaaaaggactacgagcagtacaagaaaaatgatattcccattgaagacgcagaagtaaaaaaccgttttgagattcgattgaaaaatgagcgtgcctattatgcagtccgtgatttactcgtctatgacaatccagagcataccgcctttaaaattatcaatcggtatatccgttttgtagataaagacgattccaaacctcgttctgattggaaactgaatgaagaatgggcttggtttattgggaacaatcgtgaacgattaaaactaaccacaaaaccagagccttactccttccaaaggacgctgaactggctatctcatcaagttgccccgaccttaaaggttgcgattaaacttgatgaaatcaaccagacgcaggttgtaaaagacattctcgaccatgcgaaactgacagaccgacacaagcagattttgaagcaacagtcagtaaaagaacaggacgtgataacaacaaaaaaataactcaaatacaaattcattgaatatagagaggagaacatttttatgaattttggacaaaacctttgtgcgactcgttccttagtgaaaagctaaggcactaataaaagaacgaaaaagtttggttattaggagaactgataatctgacaggtggaatgatgaagtaacgctctgaaacgcctgccctgagcctccgacaagcattgtatgaggaaactcagaatgtttgaagctcggtaaagacggctgaaagataccgtaatagttgatgaacatatatcttctatcgaaaactatccagaggtgggtagcgtatccaacaggtcgggggtctataaaatatctatggttagaatgttctataaggaactgacgaaacagcgaatgtacgggtctaaatttgaactttgtagaaatgcaaaggtacgagaaatcgtagctggtgtggcaaagtaagaatataggttatgaaatgccatataacgttacaggcggtatcaagccagcaggcttatagctagtgacctaaggatatatatgtatagataagattatcggaacgaggaaaggtattgggttctcatcaagagaataaactgacgaagaacaataagcagttgaactaatgctgaaaagcagagggcgaacctaagaaattcttgtaatgagaatggaggaatgccctcaagtcgtgtatatattagaaaagtattatgttgtttcaataaggattacgagtaagataaaaaagctcactcaatttcaagtaaaggagtgaagccttatgcctaaaaataaaaatgaaacattgtgtgtagaagatttaagacacgctgaatattacgaaatgcaaaacacctttgatgatttatatgccaaaagtaagaatggagatattttcactcatcttatggatattatcctatcgagagaaaatatattactggcatatcgaaatatcaaagcaaatgcaggcagtaaaacagcaggaacagacggtacaataattaaagatattggcaaattgccagcagaaacagttgtcaaaaaagtaagatacattgttgcaggcagtccacatgggtatcgacctaagccagtgaggcgaaaagaaataccaaaaccaaatggtaaaaccagacctctaggtattccttgtatgtgggacaggcttatacaacaatgtataaaacaagtattagaaccaatctgcgaagctaaatttagtgaaaacagctatggttttagacctaataggtcagttgaaaatgcaataaaagcaacctataaccgcctacaaatcagccagctacattatgtgattgaatttgatattaagggtttctttgacaacgtgaaccattccaagctgataaaacagatatgggctatgggaatacgggacaagcacttgatattcattttaaaaaggatattaaaagctccaatcaaaatgactaacggtacaataacatatccagagaaaggaactccgcaagggggaataatatccccactactagcaaacattgttcttaatgagttagaccattgggtagaaagccaatggcaggaaaatcctgttacaaaaaactatgtggttcatatcaataaaagcggtagcccatgtaaaagcaacgcttacaaagaaatgaagaaaacaaagttaaaggaaatgtatatggttcgttatgcagatgattttagagttttctgccgctacaaggaaagtgctgaaaaagccaaaatagcaatcactcaatggattgaacaacgattaaaattggaagtatcacaagaaaaaacaagaattgtaaatgttagaaaaagatactccgactttcttggtttcaagattaaaatgataccgagaagaaagaagttagttgttaaatcacatataagtgataaacaattcaaaaaccaaaaagacaagctggtatcacaggcaaagaaaattgcttctccctcaaaagggaaaacggaattagaagaaacaagactttataattcaatggtattaggtatgcaaaattattatcagattgcaacgaatgtaaatctggattgtatgaaactgaatagagctgtaatggctatcttcactaacagattaggtacaaacaaaaggggcagattgagaaaaacaggcagacaacttacgacaaaggaggcaacaagatatggtaaatctaaaatgcttcggtatgttgctggcgagggcgaacctattttccctgttggatatatccaacacagaaaaccaatggcaaaggtgtatttagcgaattgctacactctagagggaagaaaatttatccacaccaatctaagtgttgataaattactgatgtaccagttaatgaaattatctttggaaaatcgcacaatagaatacgcagacaatcgaatttcgctattttctgctcaacatggaaaatgtgctataactctggaagaatttcaacaagctaatgaaatacattgtcatcatattgtaccaactggagctggtggaaatgacgattataaaaatcttattttggtaaaagaggcggtacaccgtctaatacacgctaaaacagaagaaacaatacaaaaatatatagctctattgaagctaaataaagtccagctcataagactaaataaatatagagtattagctggcaatcaagaattaaacttgatataggtctactacataaatacttttcaatataaacacgatggaacgcggagtgcggtgaaagtcgcacgctccgtgtgaatggggggaaaagtttgagatatttataatatcaggaacttacctatccatatataactggtttctatcaaacgctcaatcactggtgcttttagcaatcgttgtgattggcttgtatcttggcttcaagcgtgagtttagcaaactgattggctttttaattattgcgattattgcggttggcttagtcttcaacgctgctggagtaaaagacattttactagagctattcaatcgcattattggtgcttaaataaaaccgttcttttgtggaatataagtggttttcttatgttccgcaaaggaatggtacaccaaacgaagtgcggtagggatttttgaatctctacaaagaaaggacgtgaatatatggacgatatgcaagtctatattgcgaatttaggcaaatacaatgagggcgaattggtcggtgcgtggtttacctttcccattgactttgaggaagtcaaagagaaaatcggcttgaatgatgaatatgaggaatacgccattcatgactacgagttaccctttacggttgacgaatacacttccattggcgaactcaatcgactatgggaaatggtatcggaattacccgaagaattacaatcggagctatctgctctgctcactcatttttcaagcattgaagaactaagcgaacatcaagaggatattatcattcattccgattgtgatgatatgtatgacgtggcacgctactacattgaagaaacgggtgctttaggcgaagtaccagctagtcttcaaaactatattgattatcaagcctatggtcgggatttagacctttcaggaacgtttatctcaaccaatcatgggatttttgaaatcgtctattaaatctgtcggtacattactactggcagattttctattttacggggtggctcaatcagctacccctattttttatgaaaggattgattacatgaagaaaatacgaagctataccagtatctggtctgtggaaaaggtactgtattctatcaatgattttagacttccgtttcccataacctttacgcaaatgacatggtttgtcgtgtcactctttgcagtgatgatacttggcaacttgccccctctttccatgatagagggagcatttctcaaatactttgggattcctgtggctttcacatggtttatgtctacaaaaacttttgatggtaaaaagccttatggatttttgaagtctgtcattgcttatgcactgcgaccaaagctgacctatgcaggaaaaaaagtaacgcttggcagaaaccagccacaagaagccattacagcagttaggagtgaattttatggcatatccaattaaatacattgaaaacaatctcgtctggaataaagacggggaatgttatgcttactatgagcttgttccttacaattactcatttctaagtccagaacagaaaatacaagtgcatgattctttcagacagcttatcgcacaaaatcgtgatggcaaaattcatgctttacaaatcagtacagaatccagcatacgttctgcacaagagcgttccaaaaatgaagtcactggcaagctcaaagcggttgcctatgacaaaatcgaccaacagacagacgctttaatatccatgattggcgaaaatcaagtgaactaccgtttctttatcggctttaagttgcttctcaacgatcaggagttttctatgaaaagtcttaccgttgaagcaaaaaatgctttgtctgattttgtctatgatgtgaaccataagctgatgggcgattttgttagtatgagtaatgatgaaatcctgcgttttcagaagatggaaaagctcttagaaaataaaatctctcgtcgtttcaaaatccgcaggttagataaggacgacttcggctatctgattgaacacctttacggacagacaggcactgcctatgaagagtatgagtaccatctatcaaagaaaaagctggataatgaaacgctgattaaatactatgacttgattaagcctactcgctgtttggtggaagaaaaacagcgatatttgaaaatccagcaggaagatgaaaccgtctatgtagcttactttaccattaacagcattgtcggagaactggacttcccgtcctctgaaatcttctactaccagcaacagcaatttacattcccgattgatacgtcaatgaatgtggaaattgtagcgaatcgtaaagccctatctactgtccgcaataaaaagaaagaactgaaagacttggataaccacgcttggcaaagtgataatgaaaccagctccaatgtggcggaagctctggaaagtgtgaatgagctggaaaccaatttagaccaaagcaaggaatctatgtacaagctgtcttatgtggtaagggtatcagcaaatgatcttgacgaactcaaacgtcgttgtaatgaagtgaaagatttttatgacgatttaagcgtaaaactggtacgaccatttggggatatgctcggcttacatgaagaatttttacctgccagcaagcgttatatgaatgattatattcaatacgtgacctctgatttcctcgctggtttaggttttggtgctactcaaatgctgggggaaaatgaggggatttatgttggctacagcttagatactggacgcaatgtctatctgaaacctgctcttgccagtcaaggggttaagggttcagtaaccaatgcgttagcgtcggcttttgttggttcgctgggtggtggtaaatcctttgcgaataaccttatcgtctattatgcggtgctttatggggcacaagcagtgattgtagacccaaaagcagaacgtggcagatggaaagaaaccttgccagagatttcccatgaaatcaatatcgtcactctgacttctgatgagaaaaacaaaggcttacttgacccttatgtgattatgaaaaatcccaaagattctgaatcactggctattgatattctgacattccttacggggatttcctctcgtgatggggaacgcttcccaatccttagaaaagccattcgtgcagtaaccaatagtgaagtacgagggttgatgaaagtgattgaggaattacgggttgagaatacgccactaagtaccagtatagccgaccatatcgaaagttttacagactatgactttgcacatttattattcagtaatggttatgtggagcagtctatcagcttagaaaaacaactgaacattatacaggttgcggacttggtacttcccgacaaggaaacttcctttgaggaatataccactatggagcttttatccgttgctatgctgattgtcattagtacctttgctttagactttatccatacagaccgaagcattttcaagattgtagatttagacgaagcatggagctttttacaggtagcacaaggaaaaacactatctatgaagctggttcgggctggtcgtgctatgaacgctggggtatatttcgtgacccaaaatacagacgacctcttagatgaaaaactgaaaaataacctcggcttaaaatttgcatttcgttccactgaccttaacgagattaaaaagaccttagccttttttggtgtagacccagaggacgaaaacaatcagaagcgattgcgtgatttggaaaacgggcaatgccttatcagtgatttatatggtcgtgtcggtgtgatacagttccaccctgtatttgaagaactgctccatgcctttgataccagaccacctgtgcgaaaagaggtgtaaatgtgaaaccatcaatagtaaacagaataaaatcaaactggacgctgaaacgtctaggtaaagtggcaatgacagtggctttcacacttgtgattgccatttttcttttagccatgctgggaacggtggttcaagctgcgggcttggtagatgatacggtcaatgtggcaaatgaatacagccgatacccacttgaaaactatcaactggatttttatgtggataatagctggggctggcttccgtggaactggtcggacgggattggaaaacaggtcatgtatggactatatgccattaccaattttatttggacaatcagtttgtatgtttccaatgcgacaggttacttagtacaggaagcctattccttagacttcatttccgctacagcagattccattggtaagaatatgcagaccttagctggtgtgagtgcaaacggattttcaacagagggtttctatgttggattcctcttactcttgattttggttcttggggtttatgttgcctatacgggactgataaagagagaaaccacaaaggcaattcatgccattatgaattttgtgctggtgtttatcctatcggcttcctttattgcctacgctcccgactacattaaaaaaatcaatgacttttcatcagacatcagtaatgccagtttatcacttggcacgaagattgtcatgccccattccgatagtcaaggcaaggacagcgtggacttaatcagagatagcctgttttccatacaggttcagcaaccgtggctactgcttcaatacaacagttcagacattgaaagtattggtgctgaccgtgtggaaagtctactttcaaccagtccagacagtaataatggagaagacagagaaaaaattgtagcagaagaaatcgaagacagaaacaatgtgaacatgacgattacaaaaactattaaccgtttgggtacagtcttctttctctttgtattcaatatcgggatttctatattcgtattcctactaacaggaatcatgattttctcgcaggtactttttatcatctatgccatgtttctgcctgtgagctttattttaagcatgattccgtcctttgatggtatgtcaaaacgagccattatcaaactctttaataccattttgacacgagctggaatcacgctgattattacgacagcctttagtatttcaaccatgctctataccttatcggctggttatccgttctttttgattgcctttttacagattgtgacctttgcaggaatctacttcaaactgagcgatttaatgagtatgttttcgcttcaaagcaacgattctcaaagtgtgggaagtcgtgtgatgagaaaacctcgtatgcttatgcacgctcatatgcaccgcctacagcgtaaacttggacgctccatgacagctttaggtgctggctctgccattgccagtgctacaggaaaacaaggacagtcgggtagttctggtaggacacaagcagatcacacccgtccagacggacaggaaaaatcaacacttggaaaacgtatcggacaaacaatcggagcagttgctgataccaaagataaaatcgttgattctgctggtaatctcaaagaacaggttaaggatattccgaccaatgcaagatatgcagtgtatcaaggaaaatccaaagcaaaagaaaatgttcgtgacctaacttccagtatttctcaaaccagagcagacagagccagcggacgcaaggaacagcaggaacaaagacgcaaaaccattgcagagcgtcgctctgaaatggaacaggtcaaacagaaaaaacagccagcttcttccgttcatgaaagaccagctactaagcaagaacaatctcatgatggacagaccgcaaaacaatcttctattcagacttcacgcatggaatctcaacaagccaaacaggagcgtccagcagttaagtccgattctttaagtttaaaagcggaacgacaaaaccgtactacacaagaaagaacagttcaaaagccagcaacttcaactacaccagcagacagagcttcacaaggtccagtcacaaaagagcgtccgtctactgttcaaagagttcaaagccaaaaccttagaaatagaccaccaataaaatccgccactatcaagaaaggcagtaagaaaccatgaaactgaaagctttagtgattggtggttctgggctattcttgatggtcttctcactgcttctgtttgttgccattttattttcagatgaacaggacagcggaatttccaatattcattatggaggtgtgaatgtttccgcagaagtgctggctcataagcctatggtagaaaaatatgccaaagaatatggcgttgaagaatatgtcaacatacttcttgcgattatacaggtggaatcgggcggtactgcggaagatgttatgcagtcctcggaatccctcggtcttccacctaattcattgagtacagaagaatccattaagcaaggtgtgaagtatttcagtgaattattagccagtagcgaaaggctcagtgtagatttagaatcggttatccagtcctacaattatggtggtggtttcttagggtatgtggctaatcgtggaaataaatatacctttgaactggctcaaagtttctcaaaagagtattcaggtggcgaaaaagtgtcttaccccaatcccatagccatacctatcaatgggggctggcgatacaactatggcaatatgttttatgtgcaactggtaacgcagtatcttgtcacaacagagtttgatgatgatacggtacaagccatcatggacgaagcactgaaatatgagggctggcgatacgtttacggtggagcttccccgactacttcttttgattgtagcggactgacacaatggacgtatggaaaagctggaattaacttaccacgaaccgcacaacagcaatatgatgtgacccagcatatcccactatcggaagcacaagctggcgatttggttttctttcattctacctataacgctggctcttatattactcatgttgggatataccttggcaataaccgtatgtttcatgcaggcgacccaatcggttatgccgacttaacaagcccctactggcaacagcatttagtgggagcaggacgaatcaaacaatgagaaaggaagatttaatgatgaaatttagaaaaaatcagaataaagaaaaacagataccaaaggaaaagaaacctcgtgtctataaggtcaatcctcataaaaaggttgtgattgccttgtgggtacttttagggcttagtttcagctttgcgatattcaagcactttacagctatagatactcatactattcacgaaacaactatcatagaaaaggaatacgttgatactcatcatgtagaaaattttgtagagaactttgcgaaagtctactattcatgggagcaatccgataagtccattgataatcgaatggaaagtctaaaaggctatctgacagatgaacttcaagctctcaatgttgatacagtacgcaaagatattcctgtatcgtcttctgtaagaggatttcagatatggacggtagagccaactggcgacaatgagtttaatgtaacctacagtgtagaccagctcattacagagggagaaaatacaaagaccgtccactctgcttatatagtgagtgtctatgtagatggttctggaaatatggtactggttaagaatccgaccattaccaacatacctaagaaatcaagttataaaccaaaagccattgaaagtgaggggacggttgattccattacaaccaatgaaatcaatgagtttttaacgacgttcttcaagctctatcctacagcgacagccagtgaactttcctactatgtgaatgacgggatattaaaaccaatcggaaaagagtacatctttcaagaactggtaaatcctattcacaatcgtaaggataatcaagtcacggtatcgctgacagtggagtatatcgaccagcagaccaaagcaacgcaggtatctcaatttgatttggtacttgaaaagaacgggagtaattggaagattgtaaaataacaaatattggtacatgattacagatactttgtaatcatgtactctttttgataaaaaattggagattcctttacaaatatgctcttacgtgctattatttaagtgactatttaaaaggagttaataaatatgcggcaaggtattcttaaataaactgtcaatttgatagcaggaacaaataattagatgtccttttttaggagggcttagttttttgtacccagtttaagaatacctttatcatgtgattctaaagtatccagagaatatctgtatgctttgtatacctatggttatgcataaaaatcccagtgataaaagtatttatcactgggatttttatgcccttttgggtttttgaatggaggaaaatcac

SEQ ID NO: 5 - DNA, 66247 bp, Enterococcus faecium
tcatagagtaattctgtaaaggtccaattctcgttttcatacctcggtataatcttacctatcacctcaaatggttcgctgggtttatcgatatctttcaggtgccctgctttcatttctgtaatcactgttcccgcctctcttctatatcagcggcatatgtgctatccaggcagccggttttaccagtgtattttttatacatgtccctggtatattttgttatattcctatcatactccggataggcataatgaagcctttccgccacctcaccggataccgccctgaacaattgatggcatagaaataatgcttcccatatgttttcataggaatccatccggtaggtggacaaaagtttctcccacaaatcctcggatatatacctttcaataaacttatagttcttgcctacacttaatttaaagcctgtttcgatgccgaccttccatgatatggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcaccgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtatcccacggctacaataatcacatcctgctgaaattgctttcctttaaaatgattcatcgtcattcctcctgctatctttttctattattctaccttatttgatagtagatttaaaactttgcaacagaaccgcatgagagatattgataaacaaatttttgcccaagcgaaaaaagaatttttaaacgttaattcaactcaccctgctatttttaaaacttttgaaatcaaaaaaattaaagcctacaaaggaaataagataggatctctgcaaatttattttgaagaaaatataccttcaattaccttagataattggttagagaaataatacctaacaatttaggaggcaattatcatgcaacccaaagaaacctttacaataaaggaattatctgaattatttgaaataagtaggcaagcaatctctaaacatgttgataaattagacccgtccttattagctaaaaatgagcgtggttataaggttgtattacgttctggagtattgcaacttgctagcaacttaggtaaccaaaggttactatataggttgcatgagtatgaacaagaaaacgataaaaacgtttatatatcaagcaaaaacgtgattgtaaacgagttgctagataagttgcgtgaagaaaatgaatttttacgagaacaactttccctcaaagagcaaaataattctaatatgcaaaaattactcgaccagcaacaacagctcaccctacaggcaaatcaacagatcgaaaaactgcaagaacagttacaattagcttatacggaagaaactccagaagatgaatcaactactattctttctgaagaaacagaatcgatagaaaaacacacaaaaaagaagaagcaaaaatggtggcaactttggaaataactggagggaacattcatgacaagaaaaaatcttctattcggttctattttactaggaattctaggattcagtccgatgttattgtcagtaatcaataaagggaataaacatggtgaattgaaattgaatccaaattattacaacagtcctaacgaagaattgtttgtaaaagagacggataaataataaaaaagactgctcttccgagcagccagttaaaaaaataatgagagtttattcttgaaaaagcaacgcgcttataaagcgctaccaaaattttatcatattttataaaaaataacaatccagtaaaaaatgactggtaaaaattcacaaagaaacggaaagaagcaactacagaaaatcaagccttaaaaagagctttttacctagaccaattaaaaatcacaaagtgagcgtctctatccattggtagaggggcaacttggtctagtgtacattatgtcaactatgcaattaaataactaactacttcatattagcttaataaaataatcaaaatcactaggggaaaaaatattgtataaaaaaatttttcattttttaaataagaatagtaaatataaaaataatttaagatatctattactattaatccagatagagcaaaccaagtaaatattccgtgtgtaaagctaaaaaaattcatttgaatcaattcaaataaacctaatatagtaacaaatatattaaaaataatagctgtcaataccagtaaattattttgtttattttttaaattatcttcatttaaaatagaatttatgttagtactataaaattcacaaattttttttagtgtctctatatctggtgttgttttgttattttcccactttgaaatagtttgacgtgtaacattaaattttcttgccacatattcttgagtatacccttttttcactcttaattctcttagcttagatcctaaatcctccattttttctcctatgtaaacgattatttacataaaattttatcataaaaatactaacgcgccaaaaaagttctttattttataaaacacactaaaataaaataattctagtaaaaaagataggagaaataagttatgaaaaaatttttatgtctttctgctttaatgggtgtcttattaactagtggaggaatagttagtgctacagaagctttaaatctagatgtacccgaagaccataccgccatttacggaggaggaatggaagctacagaagaaggattttcttctagtaaattgagatatgctgctggcggcggagatttcaactgtggggttaatggatttaaagtttatgcaaattactaccatgctagagctaaacatagtgcaacagctaaaaatggacgaggcggtcaagtacgatcagttcagaaagctggagtaagagcttatgcaacatgcaatgccacacttactggaaatactggttggtggaatgtttattaaaaaagagagtttaaactctcttttttatttacatttgaaaggaaattcaaaatatgttaaaaaaaataaacgctgttttatcactttttgtctgcattacaatactattcttttctactaatgttataaatggtataaagacttctgaagcgctatataaaaataccgctgaaattcatatgcaatataaagatgatatggactttaacagttatataaacgctttgtatgaaatatctacacaagaaaatattaatatttctcaatatagttttactgctgttaaccaactaactattcttgctacaaaccctaacgctaacaaacactggaaattttctaaaaaaaatatattagcaagaaacgattctaaagtccattatactaataacaaaaattctaagtaccaattaaaacttccaaataattttttaaatataaatatttatcctttttctcatgtggaaaatattggattaagtgaaatattatatgtacaaggaaactcaaacaaattaattcctgtactgaaaaaatatggaacacctactatttccaatatcaatcaatcagatacttttcaaattaatactaatattgttcttgttatctgctatcttagtatatttattgtaattactacaattatatttgctttttcaaaaatgaaagaaatcactctaaaaaaaatgttaggctataactcttttgatactataaaagattctattaaagagttaaacctcttattttgttctttgattataactttcattttatctatttttttgagcatatattacagtaacgaaaattttttcctatcatttcttctatgtagtatttttcattttataattagttttttatttatcatagttactctaagtatctatcatttatctagtataaaaaattatctaaaaaattcacgaccacttaagttaaatctttgtatattaaatatctgtctattcttaagcatgatccttctgttaatagcttctacaaaagtaataaatatccataatgaagccgaaaataattctcttaaatattgggaaagaactactaatttatataaaacaaatattactaatcaattaaatagaaacaacaccgtagaagaaaataactacttgaaaaaagctagtaaatttgtttataaaatacagaagaattataaaacttttattatcgcgccatacaattacgcaactatccaagaaaataataaagaattttttattggacaaaaagtttatccaaattttgaagactatgttagtcaacctgctggtgcaggaatatgtgttgatttaaactatctaaaatattacaatcctatttcttttgaagaatctactgacttaaatttaataaactctgatccactaactacttacattctagtacctaaaaaatataaagaatatgcaaaaatgattgaaaaaaattatttagaagacatacagtttagacttgaagactctcctcctcaagctccttataaaactcctaatttgaaaaatttaaaaataaaactaatatttgttaataataaccaaaagtattttagttttaataccttatatggaaaggcaaaagataactatacaataactgatcccatagttagagttattaatccagaaataacagaatcattattttggggaaatatattgactagtgatggtggattattttttgatcagaaacatacttcaaaccaaaacttttttaatcaaattaatccgtatataaaagaatttaacctagaaaatatcataaatttttcttattctgtttttcaagaaactggtgaattattatctcaaaaaaaagtaaataaattaaatgcatatctacaatatcttttaatattaggattatttataataattaattttcaaatgatttttgttagttttactataaattcaaaaaaaatagctttaaaaaaaatatttggatattcaccaataagtcaagttttagatttatgtttactcccttttacaatagagttatttgctactatgtgttttcaattgatattttcaaaaaacacttacttgtattttataatttttatgatctttttaataaatctaattacttctattattatttataaaaaaaatagttttaaatattttaaggagaatattttatgatattatcagttgagaatttcaccctgtcaattaataaaaaaaagatcacacaaaattggaacttttcaatatcagaaaaagattttattatagtaacaggaaaaagtggtagtggaaaaactactctgttaaataatttaagcctaatagataaacaatataccggtaacttattctattttgaaaagaaagtttctaaacatgatatacaacgtctacgaagaaatcatattagctatttatttcaaaactatgctcttcttgaaaatcaaacagtacaatacaatttcgaattagcaaaaaagtttaacagtaatatttccaatgatcatatttataatttattaacagatttttctttgccaaaagatatcttaaaagaaaaaatctttctcttaagcggtggagaacaacaaagaatagcattaattagaaatatgttaaaaccatttgatatattatttgcagatgaacctacaggaaatttagataaagaaaactcaacttttataatgaactttctgaaaaatttaacagaaaaagaaaaaaaagccgttgtactagtaacacatgacttaaatgttctaaactatggaactaatattatagaattataatttttacccgtgatgctagctgatttaaaactagcaccacgggtatttattttatattccatctctcctatcccaaaatttaaataatcacttaataaaaaggaggcacccaagtgattttattgaaaaaagagtatgaaaaattttatgatagacttatttattctttgcaattgcccaaaaaattaaaccgtcaattacaaaagacttatgaaactaaatcaactgaagaatgggagagttattgctagatttttggtagaagtaacaaaaagtggacatattatcataatgactcgccgaaagtctgataaaaaattggctaaaaatattgctgaatgtttaataaaactatcagttttagctaaatagttagtagtttacacaaaaaagcatttatgttttttgttgcaaagcaacaatttcatcttcggtgaaataagcgaaactttacaaaaagtggctagcatttgctagctttttttgtattgtggagcgtgggttttgagggggattcaagggggagcttgcgcccctttgacaagcggttatttgcaccaaatacggaggtatttggctagcaaatatagagcttgccaaacccttttggtgagctttactcattgtacctttttaggtacaatggtattgcgaacgatacgtccgtaggacgtactgaaagggtgggacttatgagcgaacaaaatcaaaatttggctagcgatcattctaaaaaatatacctatcgatccgagccaaaacaaatcagttttcgagtgagcgaatccgaatttgcaaagctgaagcagtcagctgaagctttgcaaatgagtgtgccggctttcgtgaaagccaaggcacaaaacgcgcgtctggtgacaccgaaagtggcgccagacattgcccaggcaatcgcgcgcgatttagccaaagctggagggaatatcaatcaaattgccaagtggtgcaatacacaccaacacgacgttgctcctgatgatgctcaacgtttatccgaaaacctaaaaatcatgcaaaaggagctacaaaagatatggcaacagttaaagtaagccgaaccacttcatgtagccgagcgatcaattacgcagaaccacgagcaaccattaaaacaggaataaactgtgacgtcgattatgccaaaagtgaaatgaaacaaattcgcatgctgtatggaaaagacgaccgtgtacaggcacacttattgattcaatcttttcgaccaggagaaattaccgctgaaaaagctaatcaactaggggcagagtatgcaaaaaaaatagcccccgatcaccaaatagctatttacacacatacagacaaagaccatattcataatcacattgtcattaactccgttaatctggagactggaaaaaaatttcaagctcatggtcaagcatttctaaacaaatgttatgacctaaatgacgagatttgtcttgcacataacttaccaatcactgagcgaggaaagaagccagaaaaacgaaccatgtctgaaataaaattaaaagaaaaaaatgaacctgtttggaaagacgaaattcggattgcgatcgatcaaacaatgaaaaacaaaaaaaccagaacctatgaccaattttgtaattccctcaaaacattggggattcattgcttcaatcgcgggaaaaatttcacttacgaattgatccacaaaaagaaaaaagtacgatccaacagactaggaaaggactacgaaaaggagacgattttacatgagctggacagacgagaacgaacctataaccaacagcgaaccaacgagctacgaagagctcgagctagcattcgcgaaactgcagaagaagtacgaagagaacaacgaactcttacgcctgaacaaccggaaattagaccggctcgaagaaaccatgaacaacacgttgaaagaggaacagaccaccaacaagaattatcgctctaaaacgttaaaagacatagaaaacgaaataaagaaacaacgtgcttttctcgttccttatacgcaagaaaggatacaaactacgattgatttacaagttaaaaaactccatcaagagctattagaccagcgaaataaggaacagaaaaaggtgcttactcaacgatcattggattttcttgcccccttatgttgcttagtcctgacactgttcgcattttggttagtatggggaggctaaaatggcattttatttaccctatctactcatttttgttagtatttcaggaagtatttggctcatctataaaatttttcaaacaagatattcattaaaaggctctaaaattcgatttaagcgatttttctttcttggctttatattttacttgataatcgtttcaagcggcttattcggcgttttagagggaaataagcgcgtttctagaagtattttattaggaaatgtcactcaaaagtatgaatcagcgcgtgataaaaagaaaaaagagcaagcattagcacaaaaaatggaagagtttaccacttgttatgaggaaatgaacgatatttttgtgaatcaagaaaaacgtttgacggataaaaacatggaaaaactcactcgtctttatcaaaacttgccagaaaaacagcgaaaagaggttcaagacaactatgagcgaaccaaaaaagacgtgcaatatgtaaaagatacaaagatagaagaagcctgtagtgatctatttggagacacaaacccttggtttgccagtgaagaagaaaaaaaagaaaaacaacaatctgtcacatatgaacgctatgaaatcttgcttcaacaagcaactaacatgcaaaatccgacaaaaaaagaaaccgccttaaactatctaaaaagtgtcaaggaatggttagatcagcaacaacaaaattgaatttgatttaaaatcatgttaaactgaatgtgcaaatgatcaaacattagatacacgaaagccccagagaggtcggattctctggggctttttttcaggttgatgtcgcctttattgattttacttcttgtttcggttattcaaccaataactgaataaagagacacaaactcctacaagaagggggcaaatgaacagttcaaacattagatacacctccttccagtcgcaagactgtcggataggcgacaagttattatatcttaaaaaattaaatttgtgtggtgtttttaagtatcacttgttttagggttgttagggcttgccctgaccgcctgtaaggcgcttctcgactagattaagggaaatggttctgttgcaaagttttaaatctactatcagataaggtagaataatagaaaaagatagcaggaggaatgacgatgagtcattttaaaggaaagcaatttcagtaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacatacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccgcatcgattacttgtctcttcgtccgaatatcagcgctgcttgctttaaaatatcattttccatttctaattgctggtttcttttatgtagttctaacaattctttttgttcaggcgtaagattatctttttctttgaatgaaccactcgttttagattgctttacacatttgtcaaatgctgaagccgttagttcatattctcgaatgatttctacacgtggctttccagctaagtaaagattgacgatttgttgcttgaattcttgtgaaaaagttcttcgtgttctcttagacataaaaattcctcctggtatgttttcttctagtctacacaccttaatttttctgtctagttaattgtagcctatccaataccataataaatcttcaaaagaacagaccattctttgattctattaagaacagataactcctcctccgtcatcaatcaatccacctgttctttcttcttttttggatcaatactctttaaaaacctctcctccaacaccagtaaatgacgataaacatcatccatcgaccagcctgaagaaagactaagacaatataaaaaatcacaaggtaacgtttttactgcacggttccttgttacccagcttgctactgtactctgcttatagccatgcaactcacaaaattgctctactgtcatacctaaccgcgaaataataaatacattgatcgggtagggatatacaaaggtattgatactcatagtcagaaagacctcccaccatattattacgtttgcgataataatactactctttcgtaagaccagcaagcaaagcggagaaaagaaggaacgtatcatagatataatgtaataggcaatttgcaccttttaatttcagcctgtatcgatcatgaatagatctgtttgcacgccgatcttattgggatctatcaagcgtttcagtgctgtctggataaacgtgtattcttttccaaaagcttctgagatcgcagcgaaataagccccccggctttctttttttagccggataacggagcgcatcaatccatgtatcgaagctaacataatacccccattacgaccagcacgaacacgaaaatgaattttgttctcttctcttaactgcttcagtactttgtccagggaacgttttgggatctttaaacgttcagttaactctttttttgtagaaataatgtatggttgttcttcataagattgatcattcaaataggacagtagatcttctgcccattcatgactatgtgaatacttgcgaacagctctttctttcttgaatttccaccaaccccgttttttgttgaatagttgctcttcagaaagattggcatcgacccactcttggcataataggacaactttttctctgtgcgctgcttgatattttccggagtaagcggaacaaatgattctggttaattctcgatcagataaagggttagccaatcggtcattgaattctaacatcgtcaattcacatgcttctacttcgtatcctgacgaaaagtatgccaaagacaaggtgaatatgacattatttcgaccatatacacccttttcaccttgtattttttgactttttagcaacagctggaaccagggttcatcgacttgacgaaattcttgagtagatggtaatacaaaaacgttcttgatctcagcttttttgtccgcatcttctctcattgaccagtcgatccattcttcgaaactataacgatactgtggttcaaagaataaaacattctcttcagaaggcattcgtgtgatcccaaaatgattggcatttacatcaacaggaaaccgataatcatttgaaaatttgtttcttagattttttgagatcattttggccacattgatcactttaaaatttgatttcttcgtcacgtatgcaggcttgtctagtacatagaaagcttgaaatccatgcggtgtacgtagaatcattgtcggcataaagccgatctcgtgactggccaagataatttctccatagtcaaagtttggatccaatgtgtcaaaatcaacaaagaaagtattgatttgacgcaaattgtcctcagaatgaccttttgtaaacattctggcttcatcagcatacgttccatagcgaaatacatttggtgtccaatgggtgaatcgattattgttctcgatcaccccttcttctgaagtgatcactagcccaatcccttcgatcatgtgttcctttgaacggtacgcaaaaatagccccctttcctgactgatcactaaaagagaccggttttaggtggctgtttttatatttaaatttacggataccattttgtaataccgtcgaatatacgacatccaaagaagctgccatgactgttattccttcccaaactaaaagagaacacaaataatcttaaagatttgtgttctcccaatagcttagaagtctcaaaggaacgacaaaataagcgtatatatattgagttgctcgtcaaaaaatggtaaaataaacctataggttcggattggtagtccgaatagatttattcaaatcacataagtggtttccagccactcacataatttccatgagacgaacgagaacacatagttgttgtatgtgattcagatgaagaagtgaggccaaattcacttttttatccgtctcttttttatatgtattatttatttgaatataacaaaacagttaaatttgtacaagaagaaattttaataaagtataagttatacttaaataaacctcatataagttatacctaattagacattattgtatatcttatactttaaatcacttcattaggtaataaaacaataccttcaaaataagctttccctgacaacaaatattttgtgacgcaaaaacataaagtataacttatactttatgtttttgtaatcagtaataacttatacttttattgttgaatgacttaaaaaattaaagcttatcaaatgcatcttttatttcttctctcaagtgttcctctttcgccacacctaatttttgtgtaatatacgcttccgataaagtgtcaataagtttttcaaaggtaatcctcccctgcactgattgaagttcctcaacgtagtcttgtagtacgtttaattttgactccaaagcaggagatatttttttgggttttgtaactttaaatctctcatctgtaatttctataggacgtcctcgttttttacttgctactgaagtaatcgcttttggtttcttattcatcaaagaagagtatccaaattcgttttctcctctaattgatacagattttttcttttttattcctggttgtaagagaccagcatattctgtatcaactttggtatcaacattaaattctttcctttcactcatattctttccctcctcgtaaaatatcatttgtctaatagtttttattcaaaatgtttctagattataaaatttattgaataacacattcctaacggaatttgtttcgatattgtgtgatttctcagagtacaatggatgtatggaaaggatccaacgggaatttgctatttcctcctgtagcgtttgtctaccctgtttagtctgttacccgaaccactgttatcactaccaactcattagctgtttcgataatggactagactttcaaatagtagtttggaaagcagcttctagctcttttatcaccgtattctattaggcgaggttgtggctatacagtgagtttctgggaaatcccacagtatcgaagcattttccaaaatttatatcgaaaggaggtccttcttccatgaaattatttgtcggtattgacgttagctctgaaaaactagatgtttgttttttaacagacgacaatcaattgtctatcttatctgaaatctctgttgccaatgacatcgaaggtgcttcattcatacgagaaacaattcttgaattcaatgacagctaccactttgatcaaattgtgattggcatggagtcaacgtccatgtacagcttccatccttccatgttttttcatgaagatgagaaactaaagaagctcaacacacttgtaacgattgaaaatccttttcgggtgaaacaatttagtcgcatgtttgatgagaataaaactgatcgaaacgatgcattaagaatcgctgatttcttgcgtattcaacgattcacaacttcccctatcaaagaagagaaatacatggccttacagcgtttaacacgtactcgctatcaacttattaagcaattgattcgtacaaagcaacattttcttgaaaatctaacgtacaaatgtaatacgcttgctcgagaaatgcgagacgaatcgacgagtctttttagtgcaaccctcatttcactcatgacggaagatttcacattggatgaacttgctgagcttcctttagaagctttctgtgatttacttcaagaaaaaggaaaaggccgtttcaagcaaccagaaaaaatcgctaaagcaattcaacgtgcaattaccatgagttaccgcctaggtgctcttgcacaagaatcaattaatgttgttttaagtgttctcgtacgagaaatacgagcacttgaaaaaaatatcaaagaattagataaagccatcgaacaagtaattgttgtcattccagaatatcaatgcttaaccagtattccaggcgttggtaaagtctatgctgccggtttaatcgctgaaattggtcaaatcgaaagatttgaagatcagacaaaattggcaaaatacgctggattaagttggaaagtgaaccaatctggaaactatcagtcgcaaaatacacctctgacaaaacaaggaaatcgatattttagatactacttagttgaagctgccaactctgtaaaaaattatcttcctgaatacaaagctttttatcaaagtaaatataaggaggttccaaagcatcaacacaaacgtgcactcgtcctaaccgcaagaaaatttacgcgtctggtggatacgctactacgtaaacaccaactctatacgccaccaaggagtgtgatagagaaataacaatccgttattgacgcaaatccttgaatcaacccgaaaaaaaatttgattttgatcgggtctagtttcgtgcgcttcaaaacatattactcaataaagaaaatcttaaatttcatcttgacttatcaccattagactagttattcttcaaatatttttctgcgtgattcaagttcggctagtatttttataaacggttcatgtgccctatagtcccattgatcataatttccgtttcgatactttttcaaagatattccttctctagaataacgttttagtcgtttttggaaattaacaatattcttcgatacagcggatccatataaatccatagcctcgctcaatacacttttatctaaatcatcgtctggttcaagcatgcatgcaattatagatatcacttcaagatcaatatcgtagttgttaatcataaatttttggtacccaacatattttccaattccatctaacgattcctcttgtgtttgaaaagctattatactataatcagaggccgccatagcattatctgaatatgcactaatagttggaggcacatcaataaaaatggtctcataattttctttaataggttccaacaatttttctaaaaccatgatttgttctttttcatcttcgaagttagcaataacatagttagaaaacgatctaaaacttgtatcacatgcaattaaatctagattttccataatcggcgttatacaaattgaaagattttcttcgttgattccatcaactattgttttatcaatatgatctaagtcaacagttcttgctaatatttgtgaagcgttggcttgcggatcaatatctattaccagtgtttttttcttatttactacagcattatcaaaagctagcattgtaactatcttggtttttcctactccacctttaaagttcccgactgtataagtagtcgctgtcatatttttacctactttctttaatctttatttaaagtataacttatatatttattttattcaatatttattttatactttatatattaagtataagttatacttaatatattcaatatatctgatatgtttcatttaatagcagatatatgggagcgtcaataattttgtgtaaataactcgtccttctgcaaaataatgggttactcagtaaacattgaagctaatgtatccgtcacttgttggaagcctttatggcttctatttaagaatttttgattgtatgtatcaaagatggatactaggaaacgctctagtgattcttcattttgaaactgctcttttctgcggctgtatttcttgatttgtttattgaaagattcgattaaattagttgagtaaatgcttcggcggataccaggcggaaactcataaaaagtcaataaatcttgattttttatcagtgactgcgtcactttaggataagttttctgccacttctcaatcatactccctaaaaaggtatttgcctcttcctttgagctagcttgataaacagccttaaaatcatcacagatttcttttcgatctttgacacgtactttatgagcaatattacgggaaacgtgaacacagcaatgttggtatttagctttaggataaatctggtgaatcgtatctttcatgccttttaagccatcggtgataaacagtaagacatcatgaacccctctggagtaaatgtcctgtaacaactcattccaaacgtaggtcgattcagtcggagcaatcgcataacttagtacttctttagtgccgtcttctcgtataccaatggcaatatagattgcttctttggagacggtttgccgttttaaaggaatataagtagcatccatgaaaatagcgacatacttatcatttagagttctaactttaaatgcatttacttcttcagtcagcactttagtcattttggacatggtttggggcgtgtagtgatacccatacatttcctcaatcaagtctgcgatttccgacatggtaataccttttcggaagaggtgaatgacggtctcctctaaggtatcattcgtccgtctataagcaggaacagtctgttgcttgaactcgccgttgcggtcgcgcggaatctggagatgaagttccccgtactcggtcttgaccgtacggtcataggagccgttacgagaattacccgtgttaaaaccaatgcgatcgtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacagaagggacttccttttttctatttacacaaaatattttacactctcagatatatactacagatcccttgaattagtgttccggctgaagtaaaaaaccattctgataaaatttaaaaataatgtttatggtataaattatacttaattaaacgtataacttatactttattatttaatatataagttacacaaaatatatttattatttctgctatattttatttaatagcagattcatacaacaaatttcttgattcagtgtttggctgacgtaaaaaaatcattctgataaaatttcaaaataacgtttatggtataagatatgcttaattaaacgtatatcttatactttattatttaatgtataagatatactataatttattgaagactaatctataataatatttttaatcgttgaatttccttgactaaaaaaacgaacatgtgttctaatgtgcatataaaacatatctttttttagaaaaggtgatttatcatggttatgcaatttggcgtaaacccaaggtttgactacacaaaagaaccctcacgggatattctttgtatcgattgtaagtcattttatgcgtccgtagaatgcgtagaaagaggactaaatcctttaaaggcaaagttagttgtcatgtcctatccttcagacgatccttctcagcgggggagtgggttgatcctggcatcgagtccggccgcaaaaaaagcctatggaatttctaatgtcagtcgatcacgagatcttccttttccgtatccggaagacctcgtaatcgcaccaccgagaatggcactgtatatgagaaagaatatggagattaacaacatttacaagaagtacgctgacgaacaaaatcattctgtatacagcatcgatgagagcttcgtggacgtcacagactcattaaagctgttcagtgcaaaggacgcaagagagctggcgagaatgattcaaacagacgtttatcgacaaactggaattttcacaacgatcggaataggtgacaatccgctcttggccaagttcgcactagacctcgaaagtaaaaaaaattcagatatgaaagcagaatggcgttatgaagacgttcatcaaaagctttggttagtagaaaacattacagacgtttggggtatcggacgtcggactgcaatcagactgaagcgaatgggtatatttactatgcatgatctggcacacgcaaattactatcagctgaagcaaaattttggtgtcttaggtactcaactatatgcacacagctggggcgtcgatcgatcattcttaggtcagaaatacaaagtaaaatctaagtcgatagggaacagtcaggtgttaaaccgtgattatacacgtcgaaatgaaatagaaattgtaatcaaagaaatggcggatcaagtagcaacaagattgagaagatcgggagctaaagctgaagtcatatctttgtggatcggattttcaatgggctatgtggatcgatcagggagtagagggtttcaccagcaaatgaaggtgccagcaaccaatagcagcaaacaaattgcaaactacttactgcagatatttgatcgtcattacaaataccaggacattcgaaatgtgggagtaaactgttcaaagctcgtttattctaatgctctgcagcttgatctctttgaagatccgaatgagcaagtaaaagacttaaaaatcgattatgttgtagataccatacgcaaaaaattcggatttaagtcaatcgtccatgcaaatagcattatggaaggcggacgtgcgattgctcgcagcagtcttgttggaggccatgcaggcggtatgtctggaattgcaggtgctgaaggtcatggtaaaacgtactaagaaaacttttacagactataatcaatacagagatcgaccattcggattgaagtgggcaacagcttacgccatggatgatcttatgaaaggtgttatagaaaacgaagcctgggctacgaaagaagttgttggtttggaattaatgaatcgtgaggagatcgacacgatacttttagagtctttcctttatcataaacctataacgctgcaattaaacactaaagacgaatttgggcgatttttggatcctgtcgaaggacaatttctaggtgaagcatatgaagactattttgtactgaatgaacaagcgatctattgaacagacgttcggcacatttctataaaagaagacgaaaaatggttcaaagttgattattttcaggacgaagaagctattcgcaacaagcaaataaaaaaagagcgtaatatagaagaagagatcaagttaatcaaaaatgagtattatcaagactttgcagacgacgattgaagatccgttgtccatcgtttggttttgaaatcgccttagaatgactctgtggcacacgattttctaaaataattagtaatggaggaaaaaaatatgtgtggtcgatatttctttgatttatcatcaagagaattgaaagactattatgatcaagtgattcccaatgctaccagcaagcaaattcgagttggatacaatgaaattttcccttcaaatcatgttgtgaccttagcagtcaaccaggaatcaaaaattgttcctggcgttaccaagtggggattccatggatttaaaaaaggccagctcatgatcaatgcacgggcggagacagtggaagaaaagaaaactttctcaaaagccttcagagaaacacgttgtgtattccctctttctggattctacgaatgggattccgaaaagcggaaactattgtttacttcaagtgagagtgacgttttttatttaggcggcttttatcgcattcataaaactggtgcaggttttgaaacggaatcgatcataatgacgaccaagcctaatgaatcggtttcatctatccacgatcgtatgccgctgatcatccagaaagatcacattgagaaatggatcactgagctagattttgcacgaaactatcttacagctggcatgccagaattatgtcgcactgaagtaacaaaataaaaaaagagcgaatcttttatagattcgctctcagactgtagacaaaaaggagtggcttaattgccaactcctttttgttagtctttgtagaaattttaaataaaaagccataggcttttttgctttccatagccatgtggctagtttttttaaattcatggcagcaaacgtaagcatcgtgtgcgtggcgactttttcgagacctcgatatttcgtccaacgcataccatgcttttcttttgcatctgcaaatattcgttcaatggtttgttttctctttttataaatttctctattcaacgccgtatggcgttggtgttcaagttcatccataagatccgcccaaacatgtcgagttactattttttgatgttttgtactcaaagtacagtttttaagtaatggacaactcctacagaattttggatttgatttataggttcgataaccatcacgagtgatagttgaaaataacaacggttgattattgggacataaatagcagtcaaaataggcatcataaacaaagtcttttttacgaaacattccttttactccatgaggtacagtatatggaagaatcgggtagagtttcaagtgtgacagaaaatgaacaaatttaggcgtcttatatcctgcatcagcgacaacacgctttatatttggaaaagctcttttcgactgtttgaccagatcgattgcgacttggctgtcatgtacatttcctggtgtgattaatgtagataagataaaaccattatcttcacaggaagtatgcgcggaataagcaaattgtttttctcgttcacctttaacatagtaaccactttctggatctgaatgacttattttttgaagactcaactcactttctgtgtcccatgtaaaaggacgttttcctacagcaatacgttctttatttatttcatcttctaattcatcttgataagctttagcttgaccgtaggtcatttcttttgtgaacttatgtttattggcatttgccttaatatgagtagaatcaatataaaggttgtcttccgtaacgaagccagcttttacagcttgttctagaatatgagagaaaatgtcttcaaataaagttgtttctctgaatcttcgaacatagtttttaccaaaagtagagaaatgcgggataggatcctcgaatgaataacctaaaaaccaacgataagcaacatttgtttcaacgtctttaatagtctgtctcatcgaacggataccaaataaatattggataaatactaatttaattaagaccactggatcaatactgggacgaccatgggtcgaatacgtagattctacaatgggataaatgaaatcaaactgaatcgcagcatcaatctttcgaactaagtgatctttaggtacaagatcatcaattgttaacatagcaaattgatttctaccttcaatcgattgttttctcatcattagaatcactcccagaatagtttatacaatgagtataaaacaaaaaaactgcaaacaacactcccaatttaggagtttgtctacagtctgagagcgaatcttttatagattcgctcttttttcattgctatgtttaattttatctagtatcacttcaaatgtttcaaaggtatctatatctaactgacacaaccaaagcagatacttcttttctttgtaactccagtcaacagcggggtaggaggagatcagatttttgtatctagctttttgctcatttgaagctagttgccaacgcctttcaaatattttttcttcttccatgattagcggccctcggttactaaatgatactactaactatactctacgtcgtttagtgtgtagtaattcaaatctaaagtgtaatctactgattcaaaaattaaggctttcccatcatattccactgaaattttacagataaaaggtacgtcatgtttttcaaatgctttcccataatgaattttaaaataagatttttcttctgaatcccaataggattgttcttcatccatttctttaattataacctataaaactactaaaagataaaatatatttgcacgtttaaagtgtaccctaaatagacatcataataacattgaaaaacatggttttccaatgtatgattagggtgtgttttaaatagtgtgagaaagcaggtaaaaattttgaaaattgcatatatccgagtctcgtcgatagatcagaatgaacaacggcaaattgaagaaatgaaaaagtttggcgctgaaaaaatttttatagaaaagcaatctggagcgacgattagtcatcggccgatttttcaggaagctttagattttgtcagagagcaagatatttttattgtagaagccattgatcgacttggccgcaattatgacgagattatcgattcagtgaattatttaaagaagaaaaatgtacgactcattatcaccagtttaccgatcatggctgaagcaatcggaaatcctcttctggataaatttatcaaagacctaatcattcaaattttggccatgattgctgaacaagagcgtactgaatcgaaacgacgccaggcacaaggaattaaaatcgctaaagcaaacggcgtctataaaggtcgtcctaagttatacagtgcagacacaaaagatcctcaacgtcgccttgtttataagagcatcgtccaggatcttgagaatggggttgctatctcaaagattgcaaaagactacaatgtgactaggcaaacaatttaccgaataaaaaaagaaatcgaccaactaattggatgatttctttttcgaatcaggtaattattaattagttttgtcaccaatacagacaatcattttagattcatctagctaagttgacaatatttatgttaaagaaaatttagttaacataaatattgtcaattaagaaattgtcctgattttaaaccatttaccatctataactcctggatagcaaaataaagcgcaacaaacctccacaaacttatattgatgctcgttatttaatatgatacgatgtgcctgcatacggtaggtaatacgatttgattatgaacacagatatgatagccttgtatcggctgagctgacttgtcttaagttagctcctagttggaagcggatctcatatctgtgaaggttcattgtcaaatcattcgttgccgtagtaattaatagagcaagggagctagtttgatacatggtatataagcatttaaccgctgaagagcgcgggaaaattgaagcctatcttgacgaaggattacgaccagctgaaatagcacgtagattagatcgccatcgttcaacaatcactcgggagattcaacgagggactgaagctagaaaagccaacagtatcgcacggttgccttatcaagcttcaagtgcacaaaatattgctaaattgcggaaaaagaactgtggagttactaaaaaagccacgattcacaatataaaaactattttaaaatatctgaatctaaaatattctccagaacaaattgcacattccgttaaaagcgtaaaggtatgtacatccacgatctataactggatttactcaaaaaccattgatttcaacatcaaaaagcttaggagacatggaaaaagatataaagtaaagtcatctggatcgaagattcgcattgatcgagctttctttgaaaatagaaccattgatttgcgcccagaagctgttcagcttcgtacagaatttggtcattgggaagctgatacagtagtttcaaaacgtggcatatcaacctgtctagcaacttttatcgaaagaaagacacgacaatacgtagcgattaaactccctaataaaacaggtcacgctatgatggcagcaattaaaaaactaatagaaatgtatcctcaaggggtaaaatctattacttgtgatcgaggaactgaatttgtaaatcaatttcaagtcgggcttattgaagacaccttcgggtgcaacatttactatgcaaatccgtatgcacctcatgaacgtggttctaacgaaaatcataatggattacttagagaatatttccctaaaccgtttaattttaagactgtctcgcagcgcatcgtcgatgacgctgtagaaagcttaaatactcgaccaagaaaaattctaaagtggaaaacaccagctcaaaagtttaaactagaatacgcgagaattacatgatattttcaagaggatatttcatttgttgtaaaaatgtttttacgaacaattacaattttttgaattttatataattataaagctaagcgaaagacgaacgatgtttatctaataacagtgaatagttgcacttaatcttaacattcgcccaccatctataacttagtataatatatattatgtaaactaaaataaaaagcaaactaaaaatccagttttaactaaatccttagtttgcttctatttttttgtatcaatcttcgttgaattattttttaatacatctgtcgttgcctcttttagctcatcaaattcaccctgataagtggcaattttaactacaaatcctacgacttcctgattttccatttttagtgagtagccgtttagcttgagaaaaatatatgccgctagaaatgcagtacgtttgtttgcattatggaatggatgttttttgatcagatttattaagagaactgctgctttgctgaacacatcaggatagagatcttttccaaaaatatgctgtttcggttgatttacagccatactcaaagcatttttatcaataacgccaattgtttcctttggtgaatatctttttatttgaataacattcaattttacaatgtctctttcgctcaaataaatcatcgatcaactaattccttgaacgccgcatcatattcagatagagcttgattcacatacatatcaatttcgagatctaaattgctttcttctttcacgattgcatccatcattttgtcttcatcaataaaaatagtatctccaggtttcaatcctttttgtaataaactctcttttgacaaagtgacgactattgaattacctacttctctaatcttcctttttttaatattcataaaatccactcccacattaagtatacaccgtatatccatacaactcaaatacttttaattttcagctcgaattcacaatgcatacccatgcttagcctctcttttacgaagacactatatatggaagactttatttatggaatagaatatgcctacatttactaattttttatagtgttttccctcaacttttattgtttacaaatggattcatgaagtttttgcatgatttttccttgcaaaatagcataaccatctttaactaataatggtgatcttccatttaaatcctctttaagatactgttcatatagcattttttgtctgggatcaagctccctatgttcgatagagtttctatatacccttattctatcaattgctacaaaaagatcaggaaaatcattttgcaatttcccaaaaaagaatttattcttatttggaattggttcataaaaaagcttatttagattggaggtgaagtttttaaaagacgattccgtgtttgaaatttttggtttttttacattttctatttctgtaaactcttcagaatccatagtgcggataaaataaccatatcttttacgaatgtgcgactctaagtcataaaatgagtccattatttctgtcatatcatttactagttggttcctatcttcgtacacaaaaatattatcgtctaaatttgaaattagttttataattttctttttaaccttattaaaaaaatcaaagttaattattgcaccagactcactaattatatttctttgttgatccacagaaactggtatttttacgtttgactccgtcatgcgttggttcgaatccagctaccccagttacaatcttttcttgattgtataaagcaacaatagtataacggcggtatagccaagtggtaaggcagaggtctgcaaaaccttcatcaccggttcaaatccggttaccgccttcgtactaaattatacactttcaacatgccggcgtggcggaattggcagacgcgctggactcaaaatccagtgcccgttgagggcgtgccggttcgaccccggccgccggtatcgatgatatacctttcttcttagaagaaaggtatatttttttgactttgaatatagtcgaatctaaaaaaccaattggaaagtaggcacttttccaattggcttacaatacataccaatcatttgctatcggcattagccataagtttaattatctgcacgtctttagcagggacatcgatagtattgaccctttggccatcgagaagagaatacccttgattttttagtacgattttttcgttgttatctgtatggttgatcaagaagagcaaggtgtagtccttacctttgcggcaagtcacagacactggcgtatctgctgctataaatcttaatgctgttttttctagatgattgtcatggaaaatttttgctaatacgagtgacaaatctgatggtgctaattcagtgccaatataataagcatacccgtcaccataatgattcactgtgatcgcaggggagtctttcaagtcatcattggcgaaatatccaaatgacgttgcttgatctaaatgaatgacttcttcccataaattacttgtgaatgtgtgctggtcaaaggtgatttttccgtgcatagtttcttttaaaggggagaattcttcgacagtaatgcctagtgtctctttaaagaggccagggtaaccgcctaaatatacttgatcattttcattgacgataccgctgaagaaattggtcaagaaaacaccgccattggccacgtaattattgattttcttaccaaacgatcgatgggctgaatatagatttggtgcaatcacaaagcgataggcgctgatatcttcatccgggtggacaaagtcgacagttacattcaaatccctcaaagcttcgtataaacggctcatttgatgaatatattttaatgaacgtggttttgcatcaagttccagcgcccaccagttttcccaatcgaaaactacagctacgtccgccatgaattgtgtaccaaccacttcctgcaattcttttaattcattgcctaactgacagcattctttgaagacacgactctcagcaggttgaccatgtgggacaactgcgctatggaatttctcagcgccgccccttgattgccgccattgaaagaacatgatcccatcagagccatgagcaatcgcttcataactccacaagcgcatttgaccagctttttttctcccgttgacttcccgccagtttacggcacttggggcttgttccatgatcaaaaacggctttttcttaaggctgcgggttaggtcattggctagaaattgagggtagggcatcggactaaaaggatttgggtatgtgttccaactcacaacatccatttcaggagcccatttgaaaccgtctacatatttatgtaaccccataaggttcgtcataaatggtatattttttgagtaggtagcgattgcttctttttcaatcaagtagatttcaaggttcatcgctgaaataaagcgtgcataatccaattgttgtgcgggatttttggaggttggcatttgttcaggcaagaagatttcatgccactccctatagctttgactccaaaatttcgttgaccatgcagtattcaatgcatcgatcgtttggtatttatcttctaaccattgttggaatctagtgcggcatcgagcgcaatagcactcatggatatgacaagtatattcgttgttgatatgccacatgacgattccaggatggtcatggtatcttttggccacttctgcagacaatactgccgcatagtgtcgataagtctctgaagtcgggcagtaatgctgtcttgagccgtgtaccaaacgattgccatgaatagtcatcggcatcatatctgggtatttgtttaccaaccatgcaggaggagaagcggtaccgttagccagatcaatcattatttcgttctgatataataaatcgatcaaccaatcaagaaacgaaaaatcaaaggttgattcatttggttggagggatacccaactaaaaatattgatactcacgtaattgacgccagcttgtttcatcagtgtcatatcttctaaaataacatcttttgaccattgctcaggattgtaatctgcaccataatacatctgggtttgttttttcaatttttttcacctcataaaatagatagttgctacgtgtattctagcaaaataaaaaggctcgtgttagcgctaccagcacattgctttaaatcatgcaaaaatacgaaaattgttcaaaaagagatttctttctatgataaagcaagtcagagggggggcgttgcaatccttatgacttgctgtttttttatatgaaagttaaaattacttatatgtgattatataaagttattttttgatgatgagttattttccttagttattttaaaataaattttatttgactttaatcagtttttattcatacaaatctattcatacaccttatataatcgggagcgtcaataattttgtgtaaatggttcttccctactgtagattgtttctaattctccatcggttgactcagcatttgttcgagctcgccttcggcctgttgaaaacctttatgactgccaccttggtgttagtatcaaatcttagacagcttttcgtagagacaagaataaattaaacttatctacgagaggatgaatttttatgacccgatataaagaaaattttaaacagatgattgttgaactgaataactgttcagtccacaacattttaatacctatctcccttttctaataatcaaattgacgatagtagcgacgaatattcaaaggatgacgcaaaaaatattccatatatgcatccactctgttgttgacgccgtgcatcactaaatgagaaatagacccccggttttcagaacttattcctgctaattcaaattcttttgtatcgatgatcgtataactcccacaaacttttggtaaaaagcgagctacccgttcactcaatgctcgttgctcatcttcaccaatgaacaatgtcactggcgtgttccattcgataacctcttgcataccatggaaaaattctgaactagtcacagatctggcacgaatccacatttgttcctcccaataacacatggcataagaataagttgctccccattgattgcctgagccaatgaaataatggggcatatcaggacggttatgaaaatcttcaacagtctttttagcaaattcgtaagcccaagaatcagattgtttttcaacttcagctaaagctccagctaagtgattctccatttcttcattgtattgtttataatttggaaactcattattcttgaacattaaatagtttgcgaccatataaaattttaattgttcatttttgggtgaaacaacaagataatcattcatttctttttgagtcaaaagtgaatttggtgtgtcaataaaactaaaaatccggcctccaatttccttgatacgcttagcaagctgaaccatttcttttgtatttcctgattctgaagacataatacaaacagattttttcgtaaactttttattaccagtagttagaaattctgctgcattttcaacaaaaattggtaaattagattttccacgaacgtatacttctacttgcatgctagaagcgtatgttccgccgataccaatgaaaaatatattgtcaaacccatcattccaaatttcatcaataacattttcaattttagagcgtaatcttaaaccttcatttacaccatcaattgccttctgctcatcaaaatttcttaataaaggttgtacttcttcttcccacaattctgagttatacatttttttcctcctaattattatagtaattgaaattaataaatcctcaatacctataaatctctcatataatataaattgacagtcgtatggtatgttaagaataatccggtacccatatcttcataaattaattaacccgggcatcaatcattatctctaaatcatagtaattaacagctgattactactctaggtctaatatttaccaaattgaactgtataatcactaatgtctcttctagtaaaatttttagaatactcaatgagtctatgattttcattgtacgttttacattcaataagtaatccagttttatcgttttcaatttttaaaagtttagcttctctcttatccaactcaacaacttctagagtttgttctgcttcagaaagtttaattccataaaactcatatacttcatataatgaaaacactgataaatcaataccttctaatttcggcacaatctcatcagaaacgtaaatttcttctattgaggaaatttgatcttctatataacaaagtctttcaatataatagatatattcttcaggatctatttcaaaaacttccccaaaaaagagccctgcttttctacggcttttctttaatattttcactgatgaattaacatttttttcgtccatcgtttgattaaacccttgaagacgctctaaatctctagttattcttttcccaactacgtaagatcctttaccttgaatacgtaaaattagtccttcttttacaagaccttccaacgctgtatttacggtcaacctacttaatcccagtaaatttgctataacattatctgacggaagggcagtgcccgccctaaattctccagcttcaattttagattttactaattctctaacttgtaaataatacggtgaatcataaccaactgactctttctgtaccatttcatttttcaacctaccacgctccaaaatatgaaattgtttcagttgctgttctagcacctaaatccatagatttttttatatccccatcatactctatctgaccgaaaaggaacccagctatgtaactatccccagcccccattgtatctaacagattatcagcttgataaataccttgttggtaaaaaacgtcatcgtgaagacacatgcttccgttttccccaagcattacgattacatatttaggaccttcatttgcgacttctaacatcttatctctcaacaacggattatcttctccatcatacgaaaaaaacaaatattcggtaaatggaattgcaagtttacaaactttatcatctactctattcgcacaatcaaacgctgtctttataccattgtactgtaaagattgaagatatttttctgaatgcccccaaagatctgcaactacaacatcatgtgaaagaataaaatctatatcactactactcaacttataatctttcattaccccttctctgtactctccgaaaattcgttcgccattaactagctctacatcagttacggcagtatcaccctctttaacttctagatgtgaaatgttaacacctttgctttctaatccttcaattaaaatctttccattatcatcatttccaattggtccgatatatgaagcgtttcctccaagacgagtggtataaacagccatattcactggaccaccaccgggatatcctttcactgaattatgagtatgataacagtcaacacaattactacctatcgctgctaacctcattattaatcacttcctaaaattattatttcaaacatgtcaaaaattttactttatcaccacgaacaaaagaattaaaatattccactggtttattttccctatccattgctgttcctcgtatgataaatatcaactgatcatcattcaatcgtaaaatttctttttcctgactttgtggtaaactaacttcaatattttcttttccttttataattggaaatccaatatctgaaagtgcagaatataaagaatcattttcaaaatttctatcttttattttttcaaaaatatcactttttataaatgaagtttccaaaataataggcacaccatctaagattctcaatctctttaatgctgtaatattggtacccaacggaacttctaacttttttgacaaaattttatttgccattaacgtctctaagcttattaccttagagaaaaatttatattgagaatcattatagatttgagatggagattcaatatcttgaacattcctaataagtttattttcactaacgaaaattcctgatcgattgcgtttcaccaattttccttgtttagcaagacgtgatattgcacttctcaaagttgtccgattaatttcaaaattctcagccaaatcacgttcactaggcagcttatcccccggttttaaattattttttaaaatgtaatacaaaatacattcctcagcatatttcataggactaactttctttagcattcatacaactccttaagaatagaataatagaatctacagtgataacaaaagagaaattatgataattgtcattaataaactactattattctatcactttaaggataatttgttatactactttctaaccaacactatttcttttgttccaaaaataaaacgctggcaaaccagtcgctacagctactacagctgctattaaaccaccaacaggtgcccataaaaatgttgaataaattaaagttccattcataaacatcgcaacaaccggcattaaatagccaaatggcgttttatatgaaggatcatatccagattttttccttcttaggataaaaattgttccaaaggttaaaaagctttttaacaatgcaacaagagtaaagtaacccaataaacccgaaatatctgttgcaaaaatcaatacaatcgcatagaaacattgaatcataatggaaaagtatggtgtttcgtatttaggatgtactttcccaaaggacttgaagaacaatccgtcttttgccatagcatattcaattcgcggttgaaacatgatgcagcttgagagtgagccgataatcactattacggctgtcactgcaacaaatgtgcctgcaaaactaccaatcacagggattttcgaagctaataacgcaatcggtgcatctgaactagctaattcatcaacactcaaaattccagaagctacaaatgttagtccaacataaatcgctaacacgataaaagtggtaaaaattaatcctttaggtatattcttctttggatttttaatctctccagacatatataccggagctgacattccatcaaaagaccaagtagtagcagaaatccctgcaattaatgccataaagcctgtagaagcgccttgtaacggtgttgaagaaaggagtaattctccatttaaattgaacaatccaattccaataatcaaaataaaaggaagaatttttagcaccgtaataatattttgaaaagttcctccaccttcaacagttctaatatgaagatacataaatactagcacaaaaagtacagacactaatttcaaagataggccactgattgggatgaaaaatcctaaataattagcaattgctaaagccataattgaaattgatggaggatcagttgcccaaaaactaatccaaccaccaagaaacgctaacggtttagagcccgcctctctaaagtaaatatatcctccgccatcttctggatatgccgatgctaattctgcataacataaattcgctggaatttgaaccaatccaccaataagaaatgataaaacgagaattaaactacttccggcagctcccgccacctcagataaagaagagaaaattcctgaaccaacagttgttccgactccaagggcaattacagtaccaagccctagctttcgttttaactcagtacttttactctttacacccaaatcttccttgagttccatataatgctcctttcaatattcaatattctttgaatgtattagaaattatttttcttccaccattactaatactgttctttgtgaaggtccgtcgaattcacaaaagaaaatatcttgtgcacctcctttatataaattgccatctacaattggaaaatgacaatgattaccagtaagatgagcttttaaatgccccgtgggatttccagcagtggatccataatcatttaacattcttgcatgaacatatggatgattttctggaataattcttgccaacatttgatctaaatcgctaacaagacattctaaggcttcatttacagctatcccagttgtagtatgctttgttaaaattgttaccattccatgtaatatcccactcttttctattattttttctatatcagaagtgagaataatatactgattatacttgttggttcttaattgaatttcttcaatatacaaagttttcacctcgtttgtcatcagagttaatacccttcaaaaattcatatgcatttttactttttataagctcaacagtactatccctaagcccaagattctgtacagcatctgctaatctaatctgttcgaaacgaggatttgcagatccaaacatcacttgatgacgcagcgatcgatcaatccaagtaattggaatatctttcgtaaaacactggttcataaattcccacgcattgtcaaaatacaagcttccaagactagcgtatatattcttatttttgaccataagcatcgctgtttcccgaatccatggccatccaaattgtgtaagacaaaatcttaagtttggaaaacgattcgctaaattttcaaattccaacggatgtccatattttgatagcgtattaggttcccatgataaacctgaatgaaaaataacaggtttgttatatttaatgcaaatttcgtagtaacgattcaatttttcatcatctggataaaaatgttgtctagctggatataaagctaatcctttcaaatcaagttcttcaaaacttctaatcaattcatcttcagcatttttacttctaggatctatgctagcaaatcccacaaatttatcaggtgctgcatcttcaatttttttacttcatcattagaaactaatggaaatccgtgttcttttgaataatctctgcctaaaataaacatctttccaatattggctaaattcatttgatcgctttcattttcttaacaatcacagaatacatttacacgttaacaaagtcaacaacttttttatatatattttattgtttttataccaaaaagcaaaaaacatactctcgttcgacagaaaaaatctattttacgtcattcatttctaatttttctctattgtaaaggctgcattttatgttatacctaattcagttgatctcaccaatagttataaaagagaataaatttattaaaaggatggttttaatgaaaaaacaaagaaaaatagtaatcaggtcaagtaaaatatataccaaaaaaggtttttcacctgagtcaggttatatttttattgaaggtaatataattaaatcaatcactaaagaaaaccccatatcagacgaagatgtaacttttatcgactgcaaaaacggtttagttaccgccggaaatgttgattcgcattgttttttttctggacatgctatgaacttcattggtgaagatttctctgacgtacaaacttctaatgatttatttactaaactgagtcacctgacaaatttggaagataataaagcaattattttaggtcatgatcttcctcaaaagtttactaatagtaaatatgcaaagaaactaaataagctattccccgacatacctactgtaattatggcaagtggtgctgaaacttgcttgttgaatagtgccgctgaatcaagatttaatttcactagtcaaacatgttacccagaagcatattggcggcttttgcattatgtatttagtgataaaaaattcattaaacccctgttcgtttcatatatgaagttcttaaatagccgaggcattacagcaattaaagaaatgggctttgatgatttttatggtttcactgatattttaaaagaactagaagaatcatccgatttatctctccgtgttaattttatgagtcaaccagtttccgaaaagatgaatatcgattatgcaaaaaaaatgagtgccctatttacaggtgatgctattagattttctggatttaacaaaatgaccgacggttcgattagtgaaatgaaaggtgatttgaagcagccctataccaataattctgaaattactaatattgaaaaaatcgattggaatgaaatcgaacgcgatttaaaaattgctgataatcacggatttcgtttttcgcttcacgcacaaggtgatggtgcagtttcaaaaacggtaagtttaatggaaaaatgtcaaacagatataaatgggaaacttctaaataggcattccattactgacttagaactgacagaaaaagatgatctaaaaaaaatgggggatttgggtattattgcagaaatctatccacaaattacatcactttatgataatcccctcgccaaagttaaacagattaaggaatacgttggacctcgtgcaaaatattactggaatcgcaaagagatgattaataataatattattcttagttgcggtacggatcttccattgctatatgatgatattcctgaatcaatatttaacgcatgtggtggatatttcacagacgactcattccagtttaattcaaataattgtctcaatgtgtcagaattaattgatgcctggacatctggaggtgcttataacttaggactagaagataaaataggaactttagaggcaggaaaacttgctgatattgtcatttattcagatgatttgttttccatccctataaaaaatgtaaaacaagcaaaggtcgtcaccaccatatatgatggtaaaattgtttttaaagatgacagcgtaattatcaattcaaatacaaaataaccatcagttatattacgaaaaattggatataatatggtatgcttggtaagcgtacccttaattccaatttggtgtattaaaaagaaagcaacgatttcaacaaaactatccagtttttaaagttcactcgatagttagttatgataatctttcatcttaactaactcactttctcctcgttggttgcgtcaagaattatgtgtaaatggaaaaaaccattctgtcggttaagttaaaacattgattctaatgtatcttgtatttctttaaaacctttatgaatccgacacaaaaacttctgattatagttgttgaattgagaaactaagaatctctccagagattcttcattaggaaattgttcttttctttttgtatatttctttaattgtttgttaaaaccttcaatcaagttagttgaataaatggttcttctgattgatggaggaaaattataaaaggttaatatagcaggattcatgagtaatttaactactcgtggatactgctttttccatttatctatcataaaacttatttgattcatagcttcttcttttgaagctgcttgataaaccaatttaaaatcattacagacttcttgtcggtcactaacacgaaccttatgagcaatgtttctagagatatggacacaacattgttgaaattgagcatttggataaatactatggatactatcgttaatgccgcttaaaccatcagttacgactaataaaacctcttctaagccacggtcttttaagtcttgaagtatttctttccaaacatacgaagactcagttggagcaatactaaacccaagaacctctttggtcccatctagtcggatacctatgacaatatatacagcttcttttgagacagtttgtctttttaaaggaatgtgagtagcatccataaaaatgattgagtattgggattctaaggacctttctttaaaaggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcaccgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtatcccacggctacaataatcacatcctgctgaaattgctttcctttaaaatgattcatcgtcattcctcctgctatctttttctattattctaccttatttgatagtagatttaaaactttgcaacagaaccctttctctaaatcaagtttaggcagtgattcgtaatttgtgccaggtgtttacgggttatgcattttaattcatcaggttggactatttcaatgcctgatccatattcaatcagctgcttgctcaatatctcaaaggaatctgtctggaattcgatttccattttacttcccaaatcggtttcttcaaggaagccgagagaatacctgttcttgatagaattgtatgtctcccctttttcagctctaagaattacattatatagttttttatatgaaagcatttgttttaatatttgttccaaagagccatcatggctttgacagagctcttcttctatgcaaatgcttttaatccgatccacacgaaaattcctatattcatttcttagcctgcaaaaccgattaagtaccagttctgttcataaaaccccagtgatataggctctatcattctgctttccggttcttgccctcctgatgcaggatattgaattgatattacccttttattgcagattgcagtctgaattgctgcaataacgttatccgccaatgtatttttctgtccagatgtgctgtacacgttaatactgttctccaactcctgtgcatagtttttttcaccatgcttcaaaatagatttgattttatacatagctgaatcaaaatcctttataaatgattcatctccatggcaatttaaaaatttccctgctgtaatcaatgcacccacttccgccgctgtaaacattaccggcggaagtaggaagccctctacaagaaaatatccttttccggcctcagatccaattggtattccggcttcttcaagtgtccggatatctctgtaaactgtccttaagcttatattaaatcgctgtgcaatttctttggcaggaattattttttttgattgcagctgaataagaatagaggttactctgttaatcctgttcaaattttattcctcctctgtgacttccataaaaagtatatcctatgcgttcttaagctagctgctgttagtgcttctcattgcaccctggttataaaagccatactcacaaacctcttcaccaaaactctttacatctctaatatagaactctatctagcgaacttttagaaaagatataaaacatcagagtatggacagttgcggatgtacttcagaaaagattagatgtctaaaaagcttgtagttaaagctttttagacatctaaatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataagcgtaccggttccaattttttcgcagtttaacttttccgacgcatttatcgtcttggtagtaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgatatctttcaggtgccctgctttcatttctgtaatcactgttcccgcctctcttctatatcagcggcatatgtgctatccaggcagccggttttaccagtgtattttttatacatgtccctggtatattttgttatattcctatcatactccggataggcataatgaagcctttccgccacctcaccggataccgccctgaacaattgatggcatagaaataatgcttcccatatgttttcataggaatccatccggtaggtggacaaaagtttctcccacaaatcctcggatatatacctttcaataaacttatagttcttgcctacacttaatttaaagcctgtttcgatgccgaccttccatgatatcattctcagcagctcatggcgaacaatctgattaaaatgatcaatagcaaataaaatttccttacggcacaatcctttaataacataaggtgttacattccaaaattcattgcagcaatcatcatactcccttgcgcttggctttcttacatgataatctatatcagtcggaactatgtcccttttaattctacaatctttatcaattagaacctttattaatttatcgccctttaggtaattatctaactcttccaagggcaataaggtaagatcaattttattgtaatcatcaaatagcataagataggaaaatcccttttcttcaggtgggaataattccatatcctccggcttttgcatcattattatattcccaaattgattaagccagtcatcattagatataaacggttctatatcacttacaaaatatgtaatatcataatcctgaaattcatctttaggtatattaatatttgcgcgtgacccctcaagggtcacaattcgaatacgttcatcctgttctgctaaagaaagtactaaatccatcatttctttttctgatctcatttacatactcctcgtttattttttctatattattacatcttcttttttgccgatacaatcagcatcattgggcgtcgcatttcatccgccatccccggaatatccatcatgttctctggcggctgtggctccacaatctgatttattataaaactatttgaaagcagtgtatttagatatgtggtcagtgttctatgatattttgtaaccttttcttccaaaaacatagctgtccgtttgccctcataataataattgtccaccgggaaatgcagtatttctcctttttcgttataataccagtcttgtgttccatgagcagtaaaaacaggatgttcaactgtaaaaactaaattgccaccagccttcagcatcctatatatcttttttattaaattctcatagtctgctacataatgaaacgcaagcgaacttagtattacatcaaagctctcctctgggaaatccacatcttctatggcacagcattcatattcaatctgtggaaaatgggtttttccttttgctacttcgagcattttatgagaaatatcaacacctactacagaggaagcaccgttttccatcgcatatatacagtgccatccatagccgcatcctaaatcaagcacacgcttacccttaaaatcaggtagcatctttttcaaagtctcccattctcccgcaccagccagtcctttctgcgagcgactcatttgactgtatttttgaaaaaatatattatcatcatatttgttttctttcatctgaactctcctcgtttaaaaagttatttatctccgatacaatttcattcacttcattataaagcttctcggtcatgtcgtagcattcaaaaagtgagataccgagtacttcaaaaatatgatttaccttctcggtatatttttcaggtttatgttcaaaagtttcaagcagttttatagctttcttttcgttgatacaataagcattattacatgcaaataacacttgatttaaacatgaaactatacgaaaaacatgacccgcaatataatatttatcgtctgttcccgaatttgcttttacaaacattaaagagaaccctgcttcaaacataaaaaagttaactaaacttttctgcaaagcattgggataagtttctgcctgtttttttaattcgcataagctttcattcttagcatatagtattttgctaatcgctaattctcctcgatacattgcactaatataaccatggggatgcccagtctgataattggcagtaacaattccgtgctctgtatctttcattatttgttccacacgtttaatatcacgtaaaattaaatccacatgatacccgtttatgactaaccatccgccgccattaatccaatcaccccatgctccgggaggtacaacaaggttatttctatgctcatcatccagctttgtagcgaattgattaatagtatttatgtcaaatgattctgaattgtaatagatgccgatatctatatccgaatcctctgtatgggtgccccttgcacgtgaaccacctaaaacaataccttctatataagacagagaggataatttctctgctactgatttaataatattatctaccatcaagcatgctccttttatcgattcactgctgtaaaaattccaagccaaatcttttgcttctactcaacatatttataatttttttaatttcacaaaagatagttaaaacttatcaattgtctttttatacctctgctgattagatgaagtcttttcaatagcctttaaattaccattcattttgctaacatggtttaaaaataacgttccaagcagaagtcgatcctttctgggtatcctattccccacatatcccttgaataaatctttaacaagaaaaacttcgccatcatttagattttcagtttctctaatagcttcttccaatagctcatttacatcaatcatgttgtccactccttattaataatgggtcagcccccttctactgtttcggtttggtcaatcgcttcaattaattgattttccttttcttccaaagattgacgaatcctttcaatctcttctatagaaagttcatcctttaaatcatctattaactcaggtaagatttttgtttccaccatttgttggtagttttcaagggctttttgatcaaggctatccttatactttaaaatactttttttccaaacgaaagagtatttattcgcatccgcttcaatttttgtaccatcaatgtatagagcactgccactgattaagccactttgaaccagtagctcacgaaattgaacaaatgaatgatctagaatatcgttcataatcggatgaacgcgaaaacgattaatagtacgaaagttagggaattgctcttgagataagtagcgcatccgaatactatctatcagcatattttgtatttggcggcccgaataaaccccttgaatataggcacaaagaataatggaaagtagcatacgaggatgatattggggtctacccatagattgataataaggaagaaagacttcatcgggaatagagtcaacaaactgcacaatggcatgagcaaaatcattttcttctaatttaatttcaagatctataggcaaacaaagttggtttatggtataattttgatacatgataaagcacctctctcaaatggattaatcacctatattatagcagagtgtgctttatttttgtattcactttcaaaagataaatagaggtctttccactactatctaaatggaaagacctctatttttcatataggagctacttttgggtcagccccatgtttattttgaaaaagagataaaatcaatatatcccttttccccaatttttacaacggcattgtagggctttttctctttgtttttgattccttttaccagggtttcttttccctccagtaattcttttacattcgttttggttagttttttctttctaaaatgttcagctaaagtaaacttacattcaggataatttgaacaaccataaaacgatttttttaatacaatattgttgccacacttaggacattttcctacaaggggtcccgagcgcttagtgggaatttgtaccccttatcgatacaaattccccgtaggcgctagggacctctttagcttcttggaagctgtcagtagtatatctaataatttatctccattccctttagtaacgtgtaactttccaaatttaaaaaagcgactcatagaattatttcctcccgttaaataatagataactattaaaaatagacaatacttgctcataagtaacggtacttaaattgtttactttggcgtgtttcattgcttgatgaaactgatttttagtaaacagttgacgatattctcgattgacccattttgaaacaaagtacgtatatagcttccaatatttatctggaacatctgtggtatggcgggtaagttttattaagacactgtttacttttggtttaggatgaaagcattccgctggcagcttaagcaattgctgaatcgagacttgagtgtgcaagagcaaccctagtgttcggtgaatatccaaggtacgcttgtagaatccttcttcaacaatcagatagatgtcagacgcatggctttcaaaaaccacttttttaataatttgtgtgcttaaatggtaaggaatactcccaacaattttatacctctgtttgttagggaattgaaactgtagaatatcttggtgaattaaagtgacacgaatgttcagttttaatttttctgacgataagttgaatagatgactgtctaattcaatagacgttacctgtttacttattttagccagtttcgtcgttaaatgccctttacctgttccaatttcgtaaacggtatcggtttcttttaaattcaattgttttattatttggttgagtactttttcactcgttaaaaagttttgagaatattttatatttttgttcatgtaatcactcctgaagtgattacatctgtaaataaatacagaagttaaacgatttgtttgtaattttagttatctgtttaaaaagtcataagattagtcactggtaggaattaatctaacgtatttatttatctgcgtaatcactgtttttagtctgtttcaaaacagtagatgttttatctacattacgcatttggaataccaacatgacgaatccctccttcttaattacaaatttttagcatctaatttaacttcaattcctattatacacaaaattttaagatactgcactatcaacacactcttaagtttgcttctaagtcttatttccataacttcttttacgtttccgccattctttgctgtttcgatttttatgatatggtgcaagtcagcacgaacacgaaccgtcttatctcccattatatctttttttgcactgattggtgtatcatttcgtttttctttttgtgcgcctaaatttcccacaatcactcacttctttctatttcttcttattcttattttatcatcaacaatcacaaatcacttgtgatttgtgataagtgatttgtgataagtgatttgtgattaatatataaaagccctctttaaagggcttttatgtttattttgagaaagatataaaatcaatatatcccttttccccaatttttacaacggcattgtagggctttttctctttgtttttgattccttttaccagggtttcttttccctccagtaattcttttacattcgttttggttagttttttctttctaaaatgttcagctaaagtaaacttacattcaggggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccgaatttataataagaaaaaagaacgtaaagaaaatgcagatgttgatgtaagtgctgaacatctatggcgtgttgaaattgaacttaaacgagatatggtagattattggaataattgttttaatgacttacacattttgaaacctgcatgggctactttggaaagtttaaaagaacaagcaatggtttatttattacttcatgaagaaagcaaatggggagaattacatagaaattctcgtcgcaaatataaacaaataatacaagaaatatcttcaattgatttaactgatttaatgaaatctactttgaaggataacgaagaaaatttgcaaaagcagattaatttttggcaacgaaaatttgaattttggaagtaaagtaacttttgttttatgcaaaatgattacgtccatataattgtgtaaaagtgaagcatcaaaaaagccattgatctcagttaggagtacaatgttttttgcagaaaacatactcgaataggactgatatcaatgactcaagtacattttacttttgaaagcgaagaaattcaagcaattataaacgaaagcggtgcgaatgataccgcaaaaacacttatgactatcatgtttaatcagctgatggaagaacaacgaaatcaatatattcaggcaaatgcctatgaacgttcagaagaacggcaatcacaaagaaatggttactacgatcgttcgtttacaactcgaattggtacgttagaacttcatgttccacgaaccagagacggtaagtttagtcctactatctttgaaagatatcagcgaagcgaaaaagctttgatcgctgccatgattgaaatggtcatttctggtgtctccactcgcaaagtaactaaaacagttgaactgctaacggatggtgcgactgtttctaaatcattcgtttcaaatctgatgaaacagttggatccatttgtttttgagtggagaaaccggagcctagaaggctcggaatatccatttttcatgtgtgatgccctgtatatgaaagtaagggaaaatcatcgtattgtctcaaaaggtgtatatattggtatcggcattgattctgatggacgacgtacgattcttggttttgatgttcaagacggcgaatcggaagataattgggataccgtttttcaatcgttcgttcaacgaggtttgttcggtgtaaaactggtcatttctgatgcacacaaagggttagttaaggctgttcgcaagaactttttaggtgcgagctggcaaagatgccaagcccactttttgagaaatatttttgataagctgccaaagaaagtttcttctgatgtaaaagacgagttgaagagtatctttaaagcctctgaacttgaattgacacgtgaaagaaaagagcacttcttggaaaaatatggttgtgattcaaaattaagtgctgcttgcgacattttagaaaacggctttgaagatgctattcaaattttgtcttttcctgaaaatatccgccgaaggattcgtacaaccaatgtgttggaacggttgaacgaagagattcgccggagagaacgagtgattcggatttttccaaatatcaattccatcactcggataattggaacacttttgatggaaaaagacactgagtggctggcttctccacgaaaatatttagaatttaattcgaataacatttagcaccatgaacctgtgcgagtctcttctttctgaggagagacatcaagagtcgctgcgctactgctcctgacctctctcctcagaaagaaaggcatggcagttaggttcacaacgcaaaacattgtgcttttgatgaggttgaacttttacacaagattgtggacttgacttgcaaaatgttactttactataattaatatttaagaggtgacataatatatgaaaaaatcagaggattattcctcctaaatataaagaaataagatgaaatttaggaggaaaattatatatgacttttaatattattaatttagaaacttgggatagaaaagaatatttcaatcattattttaatcaacaaacaacttatagtgttactaaagaattagatattaccttgttaaaaagtatgataaaagataaaggatatgaactgtatcctgctttgattcatgcaattgtaagtgttataaatcgaaataaagtatttagaacagggattaatagtgaggggaatttgggttattgggataaattagaacctttatatacagtctttaataaagaaactgaaaaattttctaatatttggacagaatcaaatgctagttttaactctttttataatagttataagaatgatttatttaaatataaagataaaaatgaaatgtttcctaaaaagccgatacctgaaaacacagttcctatctcgatgattccttggattgattttagttcatttaatttaaatattggtaataatagtagatttttattgccaattattacaataggtaaattttatagtaaggatgataagatctatttaccattttcattgcaagttcatcatgcagtatgtgatggttaccatgtttcattatttatgaatgaatttcaaaatataattgataatgtaaatgaatggatttaaatctaaaataaatttcataaacttaagtaatcatgatatttataagtttatagcaaccacatttttggttgcttttgttttgattttgaatttggttttgaactatgagtggctagcattttgccactcattttttgcgtaagcaaaaacataaagggtatgggatataatcccatcaagtacggcgtgctagaacgaagtggatagcaaagccagtgcttgccaaaccacattattacttgatattttgttgattatcctataatctacaaacatagagagtaataaatttcgaagaaacgtggtgggattgaatgagtgaacatgataataatttggctagcgatttgtctgttgggggaaaccgtaaacccaaccgcaaagagccaaaacaaattagtttcagagtgaacgaaggcgaatatgaaaagttaaggtcatctgccgaaactttgaatatgagtgtgccgactttcgttaagaaaaaggcacaaggcagtcgattggtagcgcccaaattagataaagagacgcgacaatcgattgttaaagatttaggcagtatgggggcaaacgtaaatcagattgcgaaatggtttaatcaacataaagaacaagcagtgaatttacctgaacaaaaatacgatgatttaattaagcaatttgatgactttaaaaaggagttgcatgagatatggcaacaactaaaataagctcaacaaaatcaacatcaagggctattaattacgcagagaaacgggcagaagaaaaaagcgctttgaattgcgatatagattatgcaaaaagcagttttaaagcaacacgtgaaatgtatggcaaaacagatggcaacgaaggacatgtggttattcagtcttttaaacctaacgaagtaacgccagaacaatgtaatcaattaggcttagaattagccgaaaagatagcacctaatcatcaagttgccgtatatacgcataacgacacagaccatgttcataatcatattgtgattaattcaattgatttagaaacggggaagaaatttaataataataaaaaaggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcggtgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccgtccgttgcgggtaataccgtaacactgaagggcacgcattaaggcgtcatcttaatgctttcctgtaggacactgacggagattaccagtctcccgagccttacaggggcctttcttttttttgtattttcaattatcacaatttatcgtccaaaagtgcagaacgaaaatcaattcatcacaagcatatcagacaattaaatttaaaacaactaaaaatatacaaaaaagtgtaattgaatattagcagcactgcctgaaaagaagtaatatcaggcttttcagcttggggaaataagtgaattacctctcttcatgaattattataactcaaaaaagcacatatgcaaacactagttccctatttttttgaatgaaaaataactaaaatatctaacgattatgactttaaaacctacgtttgtgattgttttcataaacttttaatctaaaaactccggaataatagctatttatttgtaacatttgtaataaaattaaaatcataaaaaagttctaatttaaaattgatcatttttatagtgatcgctttttatcaactactctagccaattttccgtactaactgttggtaattcgttaaatgtttctctttgttcgtttgcaagctttgccgcaatagctttttcgacaaaccaattttttacataaacgaaaattagattctgcaaattgtttactttttcagttttttgtttttgataagctttcagcaaagtcatatataatcctttgtcagcatcaattccataagattccagttcttcataaacaacaactgtttgctctaattcttcagcttttttctttgcattatgaatagtttggacggttttttgagcgtcttcgtaagtactagaaaatgtttttatcaagtttaatacattttctggtacaaatgtatttatactgtcctctttcatgatgtcgacgaagttatctagtaaaacttgattttgtaactgatcagtttcagtgtctattatgtgtctattagtgtctatagaattagaatagaatagattgtctgcgattttcgcaattacggttgagtccttgatatgactggattttgccgtatttgcgattttcgcaattacggtggtatcattgatttctcgcggttttgccgtatttgcgattttcgcaattacggtggtatcagtattgtcttcctcttccatgattttaaagacgtcttgattcgttacttctggcttgcctaagtacaataaattaggcatggattcaatcttaccgtcacgtttatttactcttcctctcttctgtttcagaagacctgctttttctaattcctttttgattttagatactttaccttcgcggcattgtaacaatttcattaattcttcaactgtgaatatgaaaaatatattatcatcagaatctacccagttatttttgactgaataatcaaatcgatctttaagtagcatataagcaatttttgcatcatttgatagatccatgtatttttcgttagtaaaaaataccttaggcatttgataatatttttcacgataaatttcttttgatttgtaataattaaaatcattcatagccaatcctctttctgtaggatagcgttttgttcaaaactatgttacaatgaattaaacaaatatatctatccactatatatttttctactgctgataagtcgccaaactttgttaaagcagtagtctttttttatctttttttagtttaccttaaaaaataaattaaagcaaaccgctctatttcaaggtttaagctcatagtaactatatcacgatattacaataatattatatcacgatatcgtaatattacaatatgaagataagcgacttatcagctttgatactactgatttttataaaaaaaatatcacgatattatgatatcgtgatattgaatgtaaattaaattttattttgtttctttgctagtttatatccttcaatcaagtattcttcaggtatggactttaatagcgcatcttctataacgtctggtttacttttgtctgattcagcaatagtcgtccaatatttgagtgctgacattagaattggatttatacgaatgctatctgctgttcttacactacttccttgatcttttatgactttacttatatttttcttggttaattcgatttcttctacttcttttgatttaaaattctttttatttttatttcctagtaatctacttactgcagcttgactgcgattatcttctgccatcaaaatcaccaacttcttttaaatattcttctgtaaatgctttatagtcatcttcagctgttgagggtttattaaaattgattagatctgatccagcagcttgcgcttcgtcaacggttattgtcctacgaatataagttttgaaaatttttgcaccaatgactctagaaatttcggttgctgcagacgtcatttctttagaaatgttataacgcttattatacttagtaaatagaactcctcgtacttcaagcttgtcgttcgtatattcttttaccgtttcaatagtttcacttaactttattagtccttttaatgagaaatacgcagcttcaactggaatgataatttcatcagaaacagtaaatgcgttgactgtaagcattcctaaacttggtggacaatcaattataatataatcatagttgtccttgattggttgaagtactcttttaagcctgtgttcacttcctacttgagtaaattccctctctgcagaagaaagggctatgtcggctggcaaaacatcaattcctttatagtccagaatagcatctgtaatgtcagcctccccttttaatacttcataaattgtaggttggtttgttccatctatatcgaaacctacattatctgtagcatttccctgaggatcaatgtccactaaaagtacatttttaccgtaaacaaatttcaaacatgctgctaaattaacgctagtcgtagttttagaaactccacctttttgattggctactgacaatattcttgccattaaaatatcccccattcatcttatattataatataattatatcataatattgtgatattgcaatatcgtatatgcattatattgtaatattgtgtgattattttgttttaaagatatatatcggttcggatataaagattattcatatgttattcgaaattaaaataatcactttttattactttaaaattttttattaatgataagaaatatgttttgcgagcagcaactagaataatttaaacattactaaactgtctatattgttactaataattcccttcttatagtgcattttcttagaaaaaaacaatattacgatatcatgatattaagatatcgtaatattatacaattgtgattgatattatatatgtttttttatttttttatcatgtttaatcttgaaggaatcatattctttttctaaagacaggagcttttcataaacatcagacatgtttaaactagaggccaggcttaaatcataaacgaatgaagcaggtaatgattttattctacgttgtcgggttatccagcttgcaaccgttccttgtgggtaggcatataactcacaaaattgttctacagtgattcctaaattcttgataatgtaaacattgatcgggtgcgagtaaacaaatgtattgatagacatggtgcgtaagcctactttcttttattattgcgtttgcaataatagtttaacacacgcattattctagtatctactcctatttgtaaaaacaaaaaaggattcatagagataactctatagaatccgtaaaataccttatatatataacgggaagatataaaacctaaaattatgataacctgctgcagcttctacatagaaagagaagcgctcaacaccaacctcatttatcaaacgttggccataaccccaaatctcttctgatagctgatcaaaggttatatactttagctcatattgctggataatgttcattctaatcgactccatttattatcctggtaaaattcgatatgacgtatttcgtcgtagtgaattttgtcttttccaacgtagatccccagctcatcactacctaagatcttgccaatgatatcttctggatagtatccttcagcgtttcgttcttctttttgaatagatactgatctattttttatgactgcagcgttcaatacttccgcaatctcttcagtcgtcatttgttcttttgctaaattttgactggttcgttgttcattgtcggcatcaatttcttcagtatgatcagataaataaaaccctgcccactttaaacgtccacgatcattgtaatcaatcatttttaattcccccatttccgcccgcatgaccaccaacaagtgtgcttctagtaatgcttctagcgccttctaacattgaagaagcatgtacaatcgacgtaaaaccatatttttgccgaatcttgtcaataattttatctaaattttcttcgtcaatttgcttttgtggatcactaaataaatccagctgaagcgaatcggtgtacacaagcttgctataggttattccaacatgccttacttcttgtccttcataatacttatcaaacaagaaaagacaataattctgcaattcctttgtattatctgtgatagggatcttcatctggtgtgaaaaccctggtctcgtttctaagatcgacgtgccaatgtgtaaatggacacaacctgttttacagttatgctgcctaatgcgtatcgctacttgttccgccatttcttttaccaccagctcgatttcatttcttctagtataatctcgtggtaacacttgtgaatttccatatgatttttcctttgtcggttctggtgggattgctatatctgttcgatcgatcccattagcatggaagtacagctgtaagccaatcacacctagtctattcttaatcgtataaggattccagttagcaagatctctaatgctcataatccccatctgattgagtctttttttcattcgagagccaattccccaaaagtccgtcatttcaggaatattccatactttttcaggaacgttttcgtacgtccattccgcaacaaatccttcattatgctttgcttcgttgtctaaggctagtttagccaaaaggggattatctccgacacctactgtagcaatcaatcctagctcttctttaatattctcctggatcatttgagccagcttctttctccgttgacttcgtgttccttcagtcgtaaaaagattcagtgatcgggtcacttttaagattgattcatcgatcgagtaaatcagtagatcttcatcagccacatatcttctgaaaatattatttacctgcatatttcgcttgatatataggttcatacgtggtggaacaacgtgtagtgttttaggaaatggttgtggtaagtcacgtggtctactcacatttgtaataccataccgcttttttgcttcaggagaagaagctaatatcaatcctgaaccagtattatcagctcgactcataacaacaagttctgttgttaatggatctaaatttctttctatacattcgacacttgcgtaaaagcttttcatatcgattaaaaagtaatcatttactggctcttttgaataatccatcataaataacactccattctttcacattatacaaacatatgttcgatattgtaaagaagaaatagctaaatacataaaaaaagaagcataggtatgctatcaccctgcttcttcttttgatttgtatgatcaatttattctatcactttactaattaatttgaaaatctaataaaaactctcactctaaaagagtgagagactgcaaattagagtacggacttttttggagttccgttctttaatattaacaaatgaataaaatccttacaacatttgagaataagttatcagtagacacttacaaaaaattctcatactatttcctccatcattagtttttgtctatataaggtttaccctaaatagacactggtataacattgaaaaatatggcttcctcgtgtatgattagggtgtattttaaatagttgcagaaagtaggtaaaagttttgagagttgcatacatacgtgtctcatcgatcgatcaaaatgaacaacgccagattgaagaaatgaaaaaattcggtgcagagagaattttcatcgagaaacaatctggcgcaacgattactcatcgacctgttttccaagaagcattagattacgtccgagatcaagatatttttattgtggaagctattgatcgacttggaagaaattatgacgagatcatcgcttcagtcaattacttgaagaagaaaaatgtgaagctgatcattactagtttaccgatcatggctgaagcaattggcaatcctctcctggataaattcattaaggatctgatcatccaaattttggccatgatcgctgaacaagaacggactgaatcgaaacgtcgccaggcacaaggaattaagatcgcaaaagcaaacggcgtctacaaagggcggcccaaattatacagtgcagacgcaaaagatccccaacgtcgccttgtttacaaaagcatcgttgaagatcttaaaaatggtgttgcgattgctaagattgctaaagactacaatgttacgagacaaaccgtgtatagaataaaaaaagacagcatggtcaatgacaaatagttgatcatgctgcttttattatcttctcatctttaatttcctacatataattactatctataaaattaagtcttactcagaacagataaagcataaaattccaacaaaccattttttacttaactaaataaagagtctgttaatataatcttcacttatttacgttaatcccctactgtatttgttggttccttatctatattttctacaaaatccttattatcttgtgatttagcttcgtataattctttgtatgtcgacacattggttatactaattcctatagctagttcttgagactctacttttctctctagctcctttgacaaagtgatttgagatttatttggttccgttggagtcaattctatagattcttcataaaaatctctatacataaagctatcattaattttataaaaaaaattaaatgtttttagcactgccatataacattcaaaacattcttctatagttggtttacttccttgaggagaatgaaccaatttattacgtttttctatgaaatttttaatttcctttcttatttctttcggaaactcaatattaaagtaccctttaaacatgctccctaataatttgtctacagggggagattgtaaattctcaaatattagagttaaatcaggtttctcttgttgataaaattcctttacccctatttcacaggctgtaattatcgaaataaacctatctctagtatttgatatatttttacttcttttaaggagtataagagaaaaggggatactttcgtgtccatgcatgtaattaactaattgttgagcttcagaagttatatctctaattatatagttaacggaattaggaagtgtctttaactctaatgaaatttctatccaattactatcttctaatctgtatatgctcgaagtataatttgattcgtcagcaagcatcgctacatcccaaacactgatcataaaatcttttaaacgttcaatcatttcagcaatattgctaaaatcagctaatttttctttagaataaaaaaaaacatttatatcagaatcaataaattctattttttttattactatatcgtcatcattatcttgaccatttatgtttattgttccctgagtggggagtacttctttcaaattcaagttaaatttatattccattacttctcctccaatatataaaaattacttaactgtatccaaatttaatatgtaaataaatcattaatttttagctaaattctatgagaagtttatttttgttgtttttgctaattaactaaaactagtacaaaaaatttaaaatagattattaaacctattgcttattctattcagtcatatatataagcgtcatcctttagtaactaacatcccacactacaatagtattataacatatctattcaacttcaaattgttgaaatttaagccatttatatttacttttcctcaactttagaaatgattttactaaccttatatccgtaatacgcgtaacaaacacattcattaataacaatcaacactaagctatattagctttttaaatgactagggtaaataaaataaggatcaaaaacttttaagtttctgaccctttccttacttccgattggttaatagtgatcttttgcagaataaataaatatcgtttcattttcaactctatatatcagtctatgttcatctgtaattcttctggaccattttccagataaatcatgctttaatggctcaggttttcctaatccagcaaagggggaacgatcgatatcttttattaacttgttaatcttttttatattgcttttgtttccttgctcatgccaataaagataatcatcccaagcatcatcagaccaagccttaatcatcagattcaacctcgattaagtcatgtgttttaaatgcacctttggagaattgttcatctcctcgacgaattttttccatgacgtaattattagaaagtgttctcaacgtttcttgcatagaatcataatctctttttgataatacaacaactgtatcttctacatctttacttgttacaataagtgtttcagcatcctcattaacttgtttcatataactacgtaaattttggcggaaatttgaataagctactgcttccattcctttcaccccttatttatttctataaaacaattgtacattatattgtacaattaagcaaatgattaatattctaacttcttataattaaaagtgctatcacttttagtttttaggataaaaagtgacgtcactttttgagtgctggtacctcaaatcctgctttttcttgggcaatcaataaatctaacgcaatacacataatcctggattcacttttgccgtacttctgctttagttgctgcaattctttttgtctcttttcatccaacgtaacgggtaaccgtttatttcctattgcaattggcattagtactctctcctttcatcgaaataaccctatgaaaaatatggctgcaatcatcttgaatagtagactcacaagggctaatacaaagcgccaaaagatcaaacaaaataccagtattgccaaaaatactacgaagtttaaatgcacagctgcagcatggcgcataagtatttcgccaacaaataggactaacaatagaggaatgattttattcatatggatctccttctttctcttaggttatcgggtgttgcccgcttatttcgcaccacctaagcggcgggggcggttggagcgattggtgcgaaataagaaccattcccttagttactaggttttttgtccttatttcacacattctcacttttcggtataaatgattattgcctttttttcctttcaaatcgttgatatggcattcgtttacggtcaagttcattttggatttcttctgtatcgtcgtaagtataggtgtctaaaaaatcagttaaagtcgtgtaccagtcgtcgcctgggttatctacttcttctacatattccctcaaaaatgcttcgggtacagcgagttcataatccattcccattaacacgatagattccgttccacacgtcaaaaatctagtaaatacaaggtaataatcgtctatcgtcgcatctttgctgtttagctcttccatttcttcttccattaattccatgctctcaaaaattgaataatattctgattctgagtaatagtgtttcctgcaaatcgtgtagctgacaaagttttcgaccagctcactcctttctaggtaaacattcatgatgtatttttctgtttctagtcgtagaagctccgttcctttttttaccgtttcaggacgacgtttatacacgtctaaacgattatggctgactgtgaccttcgtttgactcgtttcactttccaaatacaattgttcttcgactctttgaataaagtacttcatttcttccatacaactaaagtctttttgaatccgtctgattacttcattcaaatgttctttgtttgttaaaaagtgtgacacatcttccgttgggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaagttcaagaaatcttatatgatcgtggcattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaaccaaatgattcatctccatggcaatttaaaaatttccctgctgtaatcaatgcacccacttccgccgctgtaaacattaccggcggaagtaggaagccctctacaagaaaatatccttttccggcctcagatccaattggtattccggcttcttcaagtgtccggatatctctgtaaactgtccttaagcttatattaaatcgctgtgcaatttctttggcaggaattattttttttgattgcagctgaataagaatagaggttactctgttaatcctgttcaaattttattcctcctctgtgacttccataaaaagtatatcctatgcgttcttaagctagctgctgttagtgcttctcattgcaccctggttataaaagccatactcacaaacctcttcaccaaaactctttacatctctaatatagaactctatctagcgaacttttagaaaagatataaaacatcagagtatggacagttgcggatgtacttcagaaaagattagatgtctaaaaagcttgtagttaaagctttttagacatctaaatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataagcgtaccggttccaattttttcgcagtttaacttttccgacgcatttatcgtcttggtagtaaagatatattatcttatcagtattgtcaatatattcaaggcaatctgcctcctcatcctcttcatcctcttcgtcttggtagctttttaaatatggcgct

(The sequence listing continues in the following parts.)

What is claimed is:

1. A method of reducing inflammation associated with Th17 differentiation in a subject with a condition mediated by the Th17 pathway, comprising administering orally to the subject a pharmaceutical composition that comprises an amount of a bacteria strain of the species *Enterococcus faecium;*
   wherein said bacteria strain is live and lyophilized; and
   wherein said bacteria strain has an enzyme profile as determined by a Rapid ID 32A analysis that is:
      (i) positive for at least one of: arginine dihydrolase, β-glucosidase, mannose fermentation, glutamic acid decarboxylase, arginine arylamidase, phenylalanine arylamidase, leucine arylamidase, pyroglutamic acid arylamidase, tyrosine arylamidase, glycine arylamidase, histidine arylamidase and serine arylamidase; and
      (ii) intermediate for N-acetyl-β-glucosaminidase;
   wherein said pharmaceutical composition does not comprise *Bacillus subtilis* or *Bacillus coagulans;*
   and wherein said administering reduces inflammation associated with Th17 differentiation.

2. The method of claim 1, wherein said administering decreases an amount of IL-17A, IL-17B, IL-17C, IL-17D, IL-17E, or IL-17F; relative to an amount prior to said administering.

3. The method of claim 1, wherein the condition comprises uveitis; multiple sclerosis; arthritis; neuromyelitis optica; psoriasis; systemic lupus erythematosus; inflammatory bowel disease; celiac disease; asthma; allergic asthma; neutrophilic asthma; chronic obstructive pulmonary disease (COPD); scleritis; vasculitis; Behcet's disease; atherosclerosis; atopic dermatitis; emphysema; periodontitis; allergic rhinitis; or allograft rejection.

4. The method of claim 3, wherein the condition is arthritis, and wherein the arthritis is rheumatoid arthritis, osteoarthritis, psoriatic arthritis, spondyloarthritis, ankylosing spondylitis, or juvenile idiopathic arthritis.

5. The method of claim 3, wherein the condition is inflammatory bowel disease, and wherein the inflammatory bowel disease is Crohn's disease or ulcerative colitis.

6. The method of claim 1, wherein the bacteria strain comprises a polynucleotide sequence that is the 16s rRNA gene sequence of SEQ ID NO:2.

7. The method of claim 1, wherein the subject has the condition, or has been identified as being at risk of the condition.

8. The method of claim 1, wherein the subject has previously received an anti-TNF-α therapy.

9. The method of claim 1, further comprising administering an additional therapeutic agent to the subject.

10. The method of claim 1, wherein said administering comprises providing one or more doses of 1 g, 3 g, 5 g or 10 g of said pharmaceutical composition.

11. The method of claim 3, wherein the condition is uveitis.

12. The method of claim 3, wherein the condition is asthma.

13. A method of reducing inflammation associated with Th17 differentiation in a subject with a condition mediated by the Th17 pathway, comprising administering orally to the subject a pharmaceutical composition consisting essentially of an amount of a bacteria strain of the species *Enterococcus faecium;* wherein said bacteria strain is live and lyophilized;

wherein said administering reduces inflammation associated with Th17 differentiation in uveitis, arthritis, or asthma.

14. The method of claim 1 or 13, wherein the bacteria strain comprises a polynucleotide sequence that is a 16s rRNA gene sequence with at least 95% homology to the polynucleotide of SEQ ID NO:2 as determined by the Smith-Waterman homology search algorithm using an affine gap search with a gap open penalty of 12 and a gap extension penalty of 2, and a BLOSUM matrix of 62.

15. The method of claim 1 or 13, wherein said bacteria strain is the bacteria strain of the species *Enterococcus faecium* deposited under accession number NCIMB 42487.

16. The method of claim 1 or 13, wherein said pharmaceutical composition comprises from about $1 \times 10^6$ to about $1 \times 10^{11}$ CFU/g of said bacteria strain with respect to a total weight of the pharmaceutical composition.

* * * * *